United States Patent 12,569,549 (FLAVIVIRUS VACCINE) - sequence listing, part 19

SEQ ID NO: 8866 - RNA, 9879 nt, synthetic construct
  misc_feature 1..9879: note = derived and/or modified CDS sequence (opt1) from DENV-1__KC692503__SS-prME
  source 1..9879: mol_type = other RNA
agcgtgaccatgctgctcatgctgctgcccaccgccctcgccttccacctgacgacccgcggcggggagccgcacatgatcgtctccaagcaggagcggggcaagagcctgctcttcaagacctccgcgggggtgaacatgtgcaccctgatcgccatggacctgggcgagctctgcgaggacacgatgacctacaagtgcccccgcatcaccgaggccgagcccgacgacgtggactgctggtgcaacgccaccgacacgtgggtcacctacgggacctgcagccagaccggcgagcaccggcgcgagaagcggtccgtggccctggcgccccacgtgggcctggggctcgagacgcgcaccgagacctggatgagctccgagggcgcctggaagcagatccagcgggtcgagacctgggccctgcgccacccggggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcaccccccaggcccccacgagcgagatccagctgaccgactacggggccctgaccctcgactgctccccccgcaccggcctggacttcaacgagatggtcctgctcacgatgaaggagaagagctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggaccggctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccgcctgatcacggccaacccgatcgtcaccgacaaggagaagcccgtgaacatcgagaccgagccccccttcggggagagctacatcgtggtcggcgccggcgagaaggcgctcaagctgtcctggttcaagcgggggagctccatcggcaagatgttcgaggccaccgcccgcggggcccgccggatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccgctccaccagcctctccatgacctgcatcgccgtggggatggtgaccctgtacctgggcgtcatggtgcaggccgacagcgggtgcgtgatcaactggaagggccgggagctcaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctggagaacatcatgtggaagcagatcagcaacgagctcaaccacatcctgctggagaacgacatgaagttcaccgtcgtggtgggggacgccaacggcatcctcgcgcaggggaagaagatgatccggccccagcccatggagcacaagtactcctggaagagctggggcaaggccaagatcatcggcgccgacatccagaacacgaccttcatcatcgacgggcccgacaccccggagtgccccgacggccagcgcgcctggaacatctgggaggtcgaggactacgggttcggcgtgttcaccacgaacatctggctgaagctgcgggactcctacacccagatctgcgaccaccgcctcatgagcgcggccatcaaggactccaaggccgtgcacgccgacatgggctactggatcgagagcgagaagaacgagacctggaagctggcccgggcgtccttcatcgaggtcaagacctgcacgtggcccaagagccacaccctgtggtccaacggggtgctcgagagcgagatgatcatccccaagatcttcggcgggccgatctcccagcacaactaccgccccggctacttcacccagaccgccgggccctggcacctgggcaagctggagctcgacttcgacctgtgcgagggcacgaccgtggtcgtggacgagcactgcgggaaccggggcccgagcctgcgcaccaccacggtgaccgggaagatcatccacgagtggtgctgccggtcctgcaccctcccccccctgcgcttccggggcgaggacgggtgctggtacggcatggagatccgccccgtcaaggagaaggaggagaacctggtgcggagcatggtgtccgccggcagcggggaggtcgacagcttctccctcggcatcctgtgcgtgagcatcatgatcgaggaggtgatgcgctcccgctggagccggaagatgctgatgatcgggaccctcgccgtcttcctgctgctcatcatgggccagctgacgtggaacgacctgatccgcctctgcatcatggtgggggccaacgcgtccgaccggatgggcatgggcaccacctacctggccctgatggccaccttcaagatgcgcccgatgttcgccgtggggctcctgttccggcgcctgacgagccgggaggtcctcctgctgaccatcggcctctccctggtggccagcgtcgagctgcccaactccctcgaggagctgggggacggcctggcgatgggcatcatgatgctcaagctgctgaccgagttccagccccaccagctctggaccacgctgctgagcctcaccttcgtgaagaccaccctgtccctggactacgcctggaagacgaccgccatggtgctcagcatcgtctccctgttccccctgtgcctcagcaccacctcccagaagacgacctggctgccggtgctgctcgggagcttcggctgcaagcccctgaccatgttcctgatcaccgagaacaagatctgggggcgcaagtcctggcccctcaacgagggcatcatggccatcgggatcgtgagcatcctgctgtccagcctcctgaagaacgacgtccccctggcgggcccgctcatcgccggcgggatgctgatcgcctgctacgtgatcagcggctccagcgccgacctgtccctcgagaaggccgcggaggtgagctgggagcaggaggccgagcactccggggccagccacaacatcctggtcgaggtgcaggacgacggcaccatgaagatcaaggacgaggagcgggacgacacgctgaccatcctcctgaaggccaccctgctcgccgtgtccggggtctaccccatgagcatccccgcgaccctgttcgtgtggtacttctggcagaagaagaagcagcgctccggcgtgctgtgggacacgcccagcccgcccgaggtcgagcgggccgtgctcgacgacggcatctaccgcatcctgcagcgggggctgctgggccgctcccaggtgggggtcggcgtgttccaggacggggtgttccacaccatgtggcacgtcacccggggcgccgtgctcatgtaccagggcaagcgcctggagcccagctgggcctccgtgaagaaggacctgatcagctacgggggcgggtggcggttccagggctcctggaacaccggggaggaggtccaggtgatcgccgtggagcccggcaagaacccgaagaacgtccagacgacccccggcaccttcaagacccccgagggggaggtgggcgcgatcgccctcgacttcaagcccgggacgagcggctccccgatcgtgaaccgcgaggagaagatcgtcggcctgtacgggaacggcgtggtgaccaccagcgggacctacgtctccgccatcgcccaggccaaggcgagccaggagggccccctgcccgagatcgaggacgaggtgttcaagaagcggaacctcacgatcatggacctgcacccggggagcggcaagacccgccggtacctgcccgccatcgtgcgcgaggccatcaagcgcaagctccggaccctgatcctggcccccacccgcgtcgtggcgtccgagatggccgaggccctcaagggcatgcccatccggtaccagacgaccgccgtgaagagcgagcacaccgggcgcgagatcgtcgacctgatgtgccacgccaccttcacgatgcggctgctctccccggtgcgcgtgcccaactacaacatgatcatcatggacgaggcgcacttcaccgaccccgccagcatcgccgcccggggctacatctccacccgcgtcgggatgggcgaggccgcggccatcttcatgaccgccacgcccccggggagcgtggaggccttcccccagtccaacgccgtgatccaggacgaggagcgggacatccccgagcgcagctggaactccggctacgactggatcaccgacttccccggcaagaccgtctggttcgtgccgagcatcaagtccgggaacgacatcgcgaactgcctgcggaagaacggcaagcgcgtgatccagctgagccggaagaccttcgacacggagtaccagaagaccaagaacaacgactgggactacgtcgtgaccaccgacatctccgagatgggggccaacttccgcgccgaccgggtgatcgacccccgccggtgcctcaagcccgtcatcctgaaggacggccccgagcgcgtgatcctggccgggccgatgcccgtcacggtggcgagcgccgcccagcggcgcggccgcatcggccggaaccagaacaaggagggggaccagtacgtgtacatgggccagcccctcaacaacgacgaggaccacgcccactggaccgaggccaagatgctgctggacaacatcaacacccccgaggggatcatcccggcgctcttcgagcccgagcgcgagaagtccgccgccatcgacggcgagtaccggctgcgcggggaggcccggaagaccttcgtcgagctgatgcgccggggcgacctccccgtgtggctgagctacaaggtggcctccgagggcttccagtacagcgaccgccggtggtgcttcgacggggagcgcaacaaccaggtcctggaggagaacatggacgtggagatctggacgaaggagggcgagcggaagaagctccgcccccggtggctggacgcgcgcacctactccgacccgctggccctccgggagttcaaggagttcgccgccgggcgccggagcgtgagcggcgacctgatcctggagatcggcaagctcccccagcacctgaccctgcgcgcccagaacgcgctcgacaacctggtcatgctgcacaactccgagcaggggggcaaggcctaccggcacgccatggaggagctccccgacaccatcgagaccctgatgctgctcgccctgatcgcggtgctgacggggggcgtgaccctcttcttcctgagcgggaagggcctgggcaagacctccatcgggctcctgtgcgtcaccgccagctccgccctgctctggatggccagcgtggagccccactggatcgccgcgtccatcatcctggagttcttcctgatggtgctcctgatcccggagcccgaccgccagcggacgccccaggacaaccagctggcctacgtcgtgatcggcctcctgttcatgatcctgaccgtggccgccaacgagatggggctcctggagaccaccaagaaggacctgggcatcgggtacgtcgccgcggagaaccaccagcacgccacgatgctcgacgtggacctgcacccggccagcgcctggaccctgtacgccgtggcgaccaccgtcatcacgcccatgatgcgccacaccatcgagaacaccaccgccaacatctccctcacggccatcgccaaccaggccgcgatcctgatgggcctggacaagggctggcccatcagcaagatggacatcggggtgcccctcctggccctgggctgctactcccaggtgaacccgctcaccctgaccgccgccgtcctgatgctcgtggcgcactacgccatcatcgggcccggcctgcaggccaaggccacccgcgaggcccagaagcggacggcggccgggatcatgaagaaccccaccgtggacggcatcgtcgccatcgacctggaccccgtggtgtacgacgccaagttcgagaagcagctcggccagatcatgctgctgatcctctgcaccagccagatcctgctgatgcgcaccacgtgggccctctgcgagtccatcaccctggcgaccgggccgctgaccacgctctgggagggcagccccgggaagttctggaacaccaccatcgccgtctccatggccaacatcttccggggcagctacctggccggcgccgggctggcgttctccctcatgaagagcctgggcgggggccgccgggggaccggcgcccagggcgagacgctgggggagaagtggaagcgccagctcaaccagctgtccaagagcgagttcaacacctacaagcggagcggcatcatggaggtggaccgctccgaggccaaggaggggctgaagcggggcgagaccaccaagcacgccgtgagccgcgggacggcgaagctccggtggttcgtcgagcgcaacctggtgaagcccgagggcaaggtgatcgacctgggctgcgggcggggcgggtggtcctactactgcgccggcctgaagaaggtcaccgaggtgaaggggtacaccaagggcggccccgggcacgaggagccgatccccatggccacctacggctggaacctcgtgaagctgcacagcgggaaggacgtcttcttcatgccccccgagaagtgcgacaccctgctctgcgacatcggcgagtccagcccgaaccccacgatcgaggaggggcgcaccctgcgggtgctgaagatggtggagccctggctccgcggcaaccagttctgcatcaagatcctgaacccctacatgccgtccgtcgtggagaccctggagcagatgcagcggaagcacggcgggatgctcgtgcgcaaccccctgagccggaactccacccacgagatgtactgggtcagctgcggcacggggaacatcgtgtccgccgtgaacatgaccagccgcatgctgctcaaccgcttcaccatggcccaccggaagcccacctacgagcgcgacgtcgacctgggcgcgggcacgcggcacgtggccgtggagcccgaggtcgccaacctggacatcatcgggcagcgcatcgagaacatcaagaacgagcacaagtccacctggcactacgacgaggacaacccgtacaagacctgggcctaccacggcagctacgaggtgaagccctccgggagcgcctccagcatggtcaacggcgtggtgcggctcctgaccaagccctgggacgtcatccccatggtgacgcagatcgcgatgaccgacaccaccccgttcgggcagcagcgcgtgttcaaggagaaggtcgacacgcggaccccccgcgccaagcggggcaccacccagatcatggaggtgacggccaagtggctgtggggcttcctctcccgcaacaagaagccccggatctgcacccgcgaggagttcacccggaaggtgcgcagcaacgccgccatcggggcggtcttcgtggacgagaaccagtggaacagcgccaaggaggccgtggaggacgagcggttctgggacctggtccaccgcgagcgggagctgcacaagcagggcaagtgcgccacctgcgtgtacaacatgatggggaagcgcgagaagaagctcggcgagttcgggaaggcgaagggctcccgggccatctggtacatgtggctgggcgcccgcttcctggagttcgaggccctcgggttcatgaacgaggaccactggttcagccgggagaactccctgagcggcgtggagggggagggcctgcacaagctcgggtacatcctgcgcgacatctccaagatcccgggcggcaacatgtacgccgacgacacggcggggtgggacacccgcatcaccgaggacgacctgcagaacgaggccaagatcaccgacatcatggagcccgagcacgccctcctggccacgagcatcttcaagctgacctaccagaacaaggtcgtgcgggtgcagcgccccgccaagaacggcaccgtcatggacgtgatctcccggcgcgaccagcgggggagcggccaggtgggcacctacgggctcaacacgttcaccaacatggaggtccagctgatccgccagatggagtccgagggcatcttcctgcccagcgagctcgagaccccgaacctggcggagcgggccctggactggctcgagaagcacggggccgagcgcctgaagcggatggccatctccggcgacgactgcgtggtgaagcccatcgacgaccgcttcgccaccgcgctgacggccctcaacgacatggggaaggtccggaaggacatcccccagtgggagcccagcaagggctggaacgactggcagcaggtgccgttctgctcccaccacttccaccagctgatcatgaaggacggccgcgagatcgtggtcccctgccggaaccaggacgagctggtggggcgcgcccgggtgagccagggcgccgggtggtccctccgcgagaccgcctgcctgggcaagagctacgcgcagatgtggcagctgatgtacttccaccggcgcgacctccggctggccgccaacgccatctgctccgcggtccccgtggactgggtgcccgccagccgcaccacctggagcatccacgcccaccaccagtggatgaccacggaggacatgctgtccgtctggaaccgcgtgtggatcgaggagaacccgtggatggaggacaagacccacgtgagctcctgggaggaggtcccctacctcgggaagcgggaggaccagtggtgcggcagcctgatcggcctgaccgcccgcgccacctgggcgacgaacatccaggtggccatcaaccaggtgcggcgcctcatcgggaacgagaactacctggactacatgacctccatgaagcggttcaagaacgagagcgaccccgagggcgccctgtggtga

SEQ ID NO: 8867 - RNA, 9879 nt, synthetic construct
  misc_feature 1..9879: note = derived and/or modified CDS sequence (opt1) from DENV-1__KC692504__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccggatcaccgaggccgagcccgacgacgtggactgctggtgcaacgccaccgacacgtgggtgacctacgggacctgcagccagaccggcgagcaccggcgcgagaagcggtccgtggccctggcgccccacgtgggcctggggctcgagacgcgcaccgagacctggatgagctccgagggcgcctggcggcagatccagcgcgtcgagacctgggccctgcggcaccccgggttcacggtgatcgccttcttcctggcgcacgccatcggcaccagcatcacccagaaggggatcatcttcatcctcctgatgctggtgaccccctccatggccatgcgctgcgtcggcatcggcaaccgggacttcgtggaggggctcagcggcgccacgtgggtggacgtcgtgctggagcacgggtcctgcgtgaccaccatggccaagaacaagcccaccctggacatcgagctcctgaagacggaggtcatgaaccccgcggtgctgcgcaagctctgcatcgaggccaagatcagcaacaccaccaccgactcccggtgccccacgcagggcgaggccaccctggtggaggagcaggacgccaacttcgtctgccgccggaccttcgtggaccgcggctgggggaacggctgcgggctgttcggcaaggggagcctcctgacctgcgccaagttcaagtgcgtgacgaagctggagggcaagatcgtccagtacgagaacctcaagtactccgtgatcgtgaccgtccacaccggcgaccagcaccaggtggggaacgagaccacggagcacggcaccatcgcgaccatcacgccccaggcccccaccagcgagatccagctgacggactacggggccctgaccctcgactgcagcccccggaccggcctggacttcaacgagatggtcctgctcaccatgaaggagaagtcctggctggtgcacaagcagtggttcctggacctcccgctgccctggacgtccggggccagcaccagccaggagacctggaaccgccaggacctgctcgtgaccttcaagacggcccacgcgaagaagcaggaggtcgtggtgctgggctcccaggagggcgccatgcacaccgccctgaccggggccaccgagatccagacgagcggcaccaccaccatcttcgccgggcacctcaagtgccggctgaagatggacaagctgacgctcaagggcatgtcctacgtcatgtgcaccgggagcttcaagctggagaaggaggtggcggagacccagcacggcaccgtgctggtccaggtgaagtacgagggcacggacgccccctgcaagatccccttctccacccaggacgagaagggggtgacccagaacggccgcctgatcaccgccaacccgatcgtcacggacaaggagaagcccgtgaacatcgagaccgagccgcccttcggggagagctacatcgtggtcggcgccggcgagaaggcgctcaagctgtcctggttcaagcgggggagctccatcggcaagatgttcgaggccaccgcccgcggggcccgccggatggccatcctgggcgacaccgcgtgggacttcgggagcatcggcggcgtgttcacgtccgtggggaagctcgtccaccaggtgttcggcaccgcctacggggtgctgttcagcggcgtctcctggaccatgaagatcgggatcggcatcctgctcacctggctgggcctgaacagccgctccacgagcctctccatgacctgcatcgccgtggggatggtgaccctgtacctgggcgtcatggtgcaggccgacagcgggtgcgtgatcaactggaagggccgggagctcaagtgcgggtccggcatcttcgtcaccaacgaggtgcacacgtggaccgagcagtacaagttccaggccgacagcccgaagcgcctgagcgcggccatcggcaaggcctgggaggagggggtgtgcggcatccggtccgccacccgcctggagaacatcatgtggaagcagatcagcaacgagctcaaccacatcctgctggagaacgacatgaagttcaccgtcgtggtgggggacgccaacggcatcctcgcgcaggggaagaagatgatccggccccagcccatggagcacaagtactcctggaagtcctggggcaaggccaagatcatcggcgccgacatccagaacaccacgttcatcatcgacgggcccgacaccccggagtgccccgacggccagcgcgcctggaacatctgggaggtcgaggactacgggttcggcgtgttcaccaccaacatctggctgaagctgcgggactcctacacgcagatgtgcgaccaccgcctcatgagcgcggccatcaaggactccaaggccgtgcacgccgacatgggctactggatcgagagcgagaagaacgagacctggaagctggcccgggcgtccttcatcgaggtcaagacctgcacctggcccaagagccacacgctgtggtccaacggggtgctcgagagcgagatgatcatccccaagatcttcggcgggccgatctcccagcacaactaccgccccggctacttcacccagaccgccgggccctggcacctgggcaagctggagctcgacttcgacctgtgcgagggcaccacggtggtcgtggacgagcactgcgggaaccggggcccgagcctgcgcaccaccaccgtgacggggaagatcatccacgagtggtgctgccggtcctgcaccctgccgcccctgcgcttccggggcgaggacgggtgctggtacggcatggagatccgccccgtcaaggagaaggaggagaacctggtgcggagcatggtgtccgccggcagcggggaggtcgacagcttctccctcggcatcctgtgcgtgagcatcatgatcgaggaggtgatgcgctcccgctggagccggaagatgctgatgaccgggaccctcgccgtcttcctgctgctcatcatgggccagctgacgtggaacgacctgatccgcctctgcatcatggtgggggccaacgcgtccgaccggatgggcatgggcaccacctacctggccctgatggccaccttcaagatgcgcccgatgttcgccgtggggctcctgttccggcgcctgacgagccgggaggtcctcctgctgaccatcggcctctccctggtggccagcgtcgagctgcccaactccctcgaggagctgggggacggcctggcgatgggcatcatgatgctcaagctgctgaccgagttccagccccaccagctctggaccacgctgctgagcctcaccttcgtgaagaccaccctgtccctggactacgcctggaagacgaccgccatggtgctcagcatcgtctccctgttccccctgtgcctcagcaccacctcccagaagacgacctggctgccggtgctgctcgggagcttcggctgcaagcccctgaccatgttcctgatcaccgagaacaagatctgggggcgcaagtcctggcccctcaacgagggcatcatggccatcgggatcgtgagcatcctgctgtccagcctcctgaagaacgacgtccccctggcgggcccgctcatcgccggcgggatgctgatcgcctgctacgtgatcagcggctccagcgccgacctgtccctcgagaaggccgcggaggtgagctgggagcaggaggccgagcactccggggccagccacaacatcctggtcgaggtgcaggacgacggcaccatgaagatcaaggacgaggagcgggacgacacgctgaccatcctcctgaaggccaccctgctcgccgtgtccggggtctaccccatgagcatccccgcgaccctgttcgtgtggtacttctggcagaagaagaagcagcgctccggcgtgctgtgggacacgcccagcccgcccgaggtcgagcgggccgtgctcgacgacggcatctaccgcatcctgcagcgggggctgctgggccgctcccaggtgggggtcggcgtgttccaggacggggtgttccacaccatgtggcacgtcacccggggcgccgtgctcatgtaccagggcaagcgcctggagcccagctgggcctccgtgaagaaggacctgatcagctacgggggcgggtggcggttccagggctcctggaacaccggggaggaggtccaggtgatcgccgtggagcccggcaagaacccgaagaacgtccagacgacccccggcaccttcaagacccccgagggggaggtgggcgcgatcgccctcgacttcaagcccgggacgagcggctccccgatcgtgaaccgcgagggcaagatcgtcgggctgtacggcaacggggtggtgaccaccagcggcacctacgtctccgccatcgcccaggccaaggcgagccaggaggggcccctgcccgagatcgaggacgaggtgttcaagaagcggaacctcacgatcatggacctgcacccgggcagcggcaagacccgccggtacctgcccgccatcgtgcgcgaggccatcaagcgcaagctccggaccctgatcctggcccccacccgcgtcgtggcgtccgagatggccgaggccctcaaggggatgcccatccggtaccagacgaccgccgtcaagagcgagcacaccggccgcgagatcgtcgacctgatgtgccacgccaccttcacgatgcggctgctctccccggtgcgcgtgcccaactacaacatgatcatcatggacgaggcgcacttcaccgaccccgccagcatcgccgcccgggggtacatctccacccgcgtcggcatgggggaggccgcggccatcttcatgaccgccacgcccccgggcagcgtggaggccttcccccagtccaacgccgtgatccaggacgaggagcgggacatccccgagcgcagctggaactccggctacgactggatcaccgacttccccgggaagaccgtctggttcgtgccgagcatcaagtccggcaacgacatcgcgaactgcctgcggaagaacgggaagcgcgtgatccagctgagccggaagaccttcgacacggagtaccagaagaccaagaacaacgactgggactacgtcgtgaccaccgacatctccgagatgggcgccaacttccgcgccgaccgggtgatcgacccccgccggtgcctcaagcccgtcatcctgaaggacgggcccgagcgcgtgatcctggccggcccgatgcccgtcacggtggcgagcgccgcccagcggcgcggccgcatcgggcggaaccagaacaaggagggcgaccagtacgtgtacatggggcagcccctcaacaacgacgaggaccacgcccactggaccgaggccaagatgctgctggacaacatcaacacccccgagggcatcatcccggccctcttcgagcccgagcgcgagaagtccgccgccatcgacggggagtaccggctgcgcggcgaggcccggaagaccttcgtcgagctgatgcgccggggcgacctccccgtgtggctgagctacaaggtggcctccgaggggttccagtacagcgaccgccggtggtgcttcgacggcgagcgcaacaaccaggtcctggaggagaacatggacgtggagatctggacgaaggagggggagcggaagaagctccgcccccggtggctggacgcgcgcacctactccgacccgctggccctccgggagttcaaggagttcgccgccggccgccggagcgtgagcggcgacctgatcctggagatcgggaagctcccccagcacctgaccctgcgcgcccagaacgcgctcgacaacctggtcatgctgcacaactccgagcagggcgggaaggcctaccggcacgccatggaggagctccccgacaccatcgagaccctgatgctgctcgccctgatcgcggtgctgacgggcggggtgaccctcttcttcctgagcggcaagggcctggggaagacctccatcggcctcctgtgcgtcaccgccagctccgccctgctctggatggccagcgtggagccccactggatcgccgcgtccatcatcctggagttcttcctgatggtgctcctgatcccggagcccgaccgccagcggacgccccaggacaaccagctggcctacgtcgtgatcgggctcctgttcatgatcctgaccgtggccgccaacgagatgggcctcctggagaccaccaagaaggacctggggatcggctacgtcgccgcggagaaccaccagcacgccacgatgctcgacgtggacctgcacccggccagcgcctggaccctgtacgccgtggcgaccaccgtcatcacgcccatgatgcgccacaccatcgagaacaccaccgccaacatctccctcacggccatcgccaaccaggccgcgatcctgatgggcctggacaaggggtggcccatcagcaagatggacatcggcgtgcccctcctggccctggggtgctactcccaggtgaacccgctcaccctgaccgccgccgtcctgatgctcgtggcgcactacgccatcatcggccccgggctgcaggccaaggccacccgcgaggcccagaagcggacggcggccggcatcatgaagaaccccaccgtggacggcatcgtcgccatcgacctggaccccgtggtgtacgacgccaagttcgagaagcagctcgggcagatcatgctgctgatcctctgcaccagccagatcctgctgatgcgcaccacgtgggccctctgcgagtccatcaccctggcgaccggcccgctgaccacgctctgggaggggagccccggcaagttctggaacaccaccatcgccgtctccatggccaacgtgttccggggcagctacctggccggggccggcctggcgttctccctcatgaagtccctcgggggcgggcgccgggggaccggcgcccagggggagacgctgggcgagaagtggaagcgccagctcaaccagctgtccaagagcgagttcaacacctacaagcggagcgggatcatggaggtggaccgctccgaggccaaggagggcctgaagcgcggggagaccaccaagcacgccgtcagccgcggcacggcgaagctccggtggttcgtggagcgcaacctggtgaagcccgagggcaaggtcatcgacctggggtgcggccgcgggggctggtcctactactgcgccgggctgaagaaggtgaccgaggtgaagggctacaccaagggcgggcccggccacgaggagccgatccccatggccacctacgggtggaacctcgtcaagctgcacagcggcaaggacgtgttcttcatgccgcccgagaagtgcgacaccctgctctgcgacatcggggagtccagcccgaaccccacgatcgaggagggccgcaccctgcgggtgctgaagatggtcgagccctggctccgcggcaaccagttctgcatcaagatcctgaacccctacatgccgtccgtggtggagaccctggagcagatgcagcggaagcacgggggcatgctcgtccgcaaccccctgagccggaactccacccacgagatgtactgggtgagctgcgggacgggcaacatcgtgtccgccgtcaacatgaccagccgcatgctgctcaaccgcttcaccatggcccaccggaagcccacctacgagcgcgacgtggacctgggcgcggggacgcggcacgtggccgtcgagcccgaggtggccaacctggacatcatcggccagcgcatcgagaacatcaagaacgagcacaagtccacctggcactacgacgaggacaacccgtacaagacctgggcctaccacgggagctacgaggtcaagccctccggcagcgcctccagcatggtgaacggggtggtccggctcctgaccaagccctgggacgtgatccccatggtgacgcagatcgcgatgaccgacaccaccccgttcggccagcagcgcgtcttcaaggagaaggtggacacgcggacgccccgggccaagcggggcaccacccagatcatggaggtgacggccaagtggctgtgggggttcctctcccgcaacaagaagccccggatctgcacccgcgaggagttcacccggaaggtccgcagcaacgccgccatcggcgcggtgttcgtggacgagaaccagtggaacagcgccaaggaggccgtcgaggacgagcggttctgggacctggtgcaccgcgagcgggagctgcacaagcaggggaagtgcgcgacctgcgtgtacaacatgatgggcaagcgcgagaagaagctcggggagttcggcaaggcgaagggctcccgggccatctggtacatgtggctgggggcccgcttcctggagttcgaggccctcggcttcatgaacgaggaccactggttcagccgggagaactccctgagcggggtcgagggcgaggggctgcacaagctcggctacatcctgcgcgacatctccaagatcccgggcgggaacatgtacgccgacgacacggcgggctgggacacccgcatcaccgaggacgacctgcagaacgaggccaagatcaccgacatcatggagcccgagcacgccctcctggccacgagcatcttcaagctgacctaccagaacaaggtggtgcgggtccagcgccccgccaagaacgggaccgtgatggacgtgatctcccggcgcgaccagcggggcagcggccaggtcgggacctacggcctcaacacgttcaccaacatggaggtgcagctgatccgccagatggagtccgaggggatcttcctgcccagcgagctcgagaccccgaacctggcggagcgggccctggactggctcgagaagcacggcgccgagcgcctgaagcggatggccatctccggggacgactgcgtggtcaagcccatcgacgaccgcttcgccaccgcgctgacggccctcaacgacatgggcaaggtgcggaaggacatcccccagtgggagcccagcaagggctggaacgactggcagcaggtcccgttctgctcccaccacttccaccagctgatcatgaaggacgggcgcgagatcgtcgtgccctgccggaaccaggacgagctggtgggccgcgcccgggtcagccagggggccggctggtccctccgcgagaccgcctgcctgggcaagagctacgcgcagatgtggcagctgatgtacttccaccggcgcgacctccggctggccgccaacgccatctgctccgcggtgcccgtggactgggtccccgccagccgcaccacctggagcatccacgcccaccaccagtggatgaccacggaggacatgctgtccgtgtggaaccgcgtgtggatcgaggagaacccgtggatggaggacaagacccacgtcagctcctgggaggaggtgccctacctcggcaagcgggaggaccagtggtgcggcagcctgatcgggctgaccgcccgcgccacctgggcgacgaacatccaggtggccatcaaccaggtccggcgcctcatcggcaacgagaactacctggactacatgacctccatgaagcggttcaagaacgagagcgaccccgagggggccctgtggtga

SEQ ID NO: 8868 - RNA, 9879 nt, synthetic construct
  misc_feature 1..9879: note = derived and/or modified CDS sequence (opt1) from DENV-1__KC692508__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccaccgcccgcggggcgcgccgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccggtccaccagcctctccatgacctgcatcgccgtggggatggtgaccctgtacctgggcgtcatggtgcaggccgacagcgggtgcgtgatcaactggaagggccgcgagctcaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtcgtggtgggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtcgaggactacgggttcggcgtgttcaccacgaacatctggctgaagctgcgcgactcctacacccagatgtgcgaccaccggctcatgagcgcggccatcaaggactccaaggccgtgcacgccgacatgggctactggatcgagagcgagaagaacgagacctggaagctggcccgcgcgtccttcatcgaggtcaagacctgcacgtggcccaagagccacaccctgtggtccaacggggtgctcgagagcgagatgatcatccccaagatcttcggcgggccgatctcccagcacaactaccggcccggctacttcacccagaccgccgggccctggcacctgggcaagctggagctcgacttcgacctgtgcgagggcacgaccgtggtcgtggacgagcactgcgggaaccgcggcccgagcctgcggaccaccacggtgaccgggaagatcatccacgagtggtgctgccgctcctgcaccctgccgcccctgcggttccgcggcgaggacgggtgctggtacggcatggagatccggcccgtcaaggagaaggaggagaacctggtgcgcagcatggtgtccgccggcagcggggaggtcgacagcttctccctcggcatcctgtgcgtgagcatcatgatcgaggaggtgatgcggtcccgctggagccgcaagatgctgatgaccgggacgctcgccgtcttcctgctgctcatcatgggccagctgacctggaacgacctgatccggctctgcatcatggtgggggccaacgcgtccgaccgcatgggcatgggcaccacctacctggccctgatggccacgttcaagatgcggccgatgttcgccgtggggctcctgttccgccggctgaccagccgcgaggtcctcctgctgaccatcggcctctccctggtggccagcgtcgagctgcccaactccctcgaggagctgggggacggcctggcgatgggcatcatgatgctcaagctgctgaccgagttccagccccaccagctctggacgaccctgctgagcctcaccttcgtgaagaccacgctgtccctggactacgcctggaagaccaccgccatggtgctcagcatcgtctccctgttccccctgtgcctcagcaccacgtcccagaagaccacctggctgccggtgctgctcgggagcttcggctgcaagcccctgaccatgttcctgatcaccgagaacaagatctgggggcggaagtcctggcccctcaacgagggcatcatggccatcgggatcgtgagcatcctgctgtccagcctcctgaagaacgacgtccccctggcgggcccgctcatcgccggcgggatgctgatcgcctgctacgtgatcagcggctccagcgccgacctgtccctcgagaaggccgcggaggtgagctgggagcaggaggccgagcactccggggccagccacaacatcctggtcgaggtgcaggacgacggcacgatgaagatcaaggacgaggagcgcgacgacaccctgaccatcctcctgaaggccaccctgctcgccgtgtccggggtctaccccatgagcatccccgcgacgctgttcgtgtggtacttctggcagaagaagaagcagcggtccggcgtgctgtgggacacccccagcccgcccgaggtcgagcgcgccgtgctcgacgacggcatctaccggatcctgcagcgcgggctgctgggccggtcccaggtgggggtcggcgtgttccaggacggggtgttccacaccatgtggcacgtcacccgcggcgccgtgctcatgtaccagggcaagcggctggagcccagctgggcctccgtgaagaaggacctgatcagctacgggggcgggtggcgcttccagggctcctggaacacgggggaggaggtccaggtgatcgccgtggagcccggcaagaacccgaagaacgtccagaccacccccggcaccttcaagacgcccgagggggaggtgggcgcgatcgccctcgacttcaagcccgggaccagcggctccccgatcgtgaaccgggagggcaagatcgtcgggctgtacggcaacggggtggtgaccaccagcggcacgtacgtctccgccatcgcccaggccaaggcgagccaggaggggcccctgcccgagatcgaggacgaggtgttcaagaagcgcaacctcaccatcatggacctgcacccgggcagcggcaagacccggcgctacctgcccgccatcgtgcgggaggccatcaagcgcaagctccgcaccctgatcctggcccccacgcgggtcgtggcgtccgagatggccgaggccctcaaggggatgcccatccgctaccagaccaccgccgtcaagagcgagcacaccggccgggagatcgtcgacctgatgtgccacgccacgttcaccatgcgcctgctctccccggtgcgggtgcccaactacaacatgatcatcatggacgaggcgcacttcaccgaccccgccagcatcgccgcccgcgggtacatctccacccgggtcggcatgggggaggccgcggccatcttcatgacggccacgccgcccggcagcgtggaggccttcccccagtccaacgccgtgatccaggacgaggagcgcgacatccccgagcggagctggaactccggctacgactggatcaccgacttccccgggaagaccgtctggttcgtgcccagcatcaagtccggcaacgacatcgcgaactgcctgcgcaagaacgggaagcgggtgatccagctgagccgcaagacgttcgacaccgagtaccagaagaccaagaacaacgactgggactacgtcgtgaccacggacatctccgagatgggcgccaacttccgggccgaccgcgtgatcgacccccggcgctgcctcaagcccgtcatcctgaaggacgggcccgagcgggtgatcctggccggcccgatgcccgtcaccgtggcgagcgccgcccagcgccggggccgcatcgggcgcaaccagaacaaggagggcgaccagtacgtgtacatggggcagcccctcaacaacgacgaggagcacgcccactggaccgaggccaagatgctgctggacaacatcaacacccccgagggcatcatcccggccctcttcgagcccgagcgggagaagtccgccgccatcgacggggagtaccgcctgcggggcgaggcccgcaagacgttcgtcgagctgatgcggcgcggcgacctccccgtgtggctgagctacaaggtggcctccgaggggttccagtacagcgaccggcgctggtgcttcgacggcgagcggaacaaccaggtcctggaggagaacatggacgtggagatctggaccaaggagggggagcgcaagaagctccggccccgctggctggacgcgcggacctactccgacccgctggccctccgcgagttcaaggagttcgccgccggccggcgcagcgtgagcggcgacctgatcctggagatcgggaagctcccccagcacctgaccctgcgggcccagaacgcgctcgacaacctggtcatgctgcacaactccgagcagggcgggaaggcctaccgccacgccatggaggagctccccgacaccatcgagacgctgatgctgctcgccctgatcgcggtgctgaccggcggggtgaccctcttcttcctgagcggcaagggcctggggaagacctccatcggcctcctgtgcgtcacggccagctccgccctgctctggatggccagcgtggagccccactggatcgccgcgtccatcatcctggagttcttcctgatggtgctcctgatcccggagcccgaccggcagcgcacgccccaggacaaccagctggcctacgtcgtgatcgggctcctgttcatgatcctgaccgtggccgccaacgagatgggcctcctggagaccacgaagaaggacctggggatcggctacgtcgccgcggagaaccaccagcacgccaccatgctcgacgtggacctgcacccggccagcgcctggaccctgtacgccgtggcgaccacggtcatcacccccatgatgcggcacaccatcgagaacaccacggccaacatctccctcaccgccatcgccaaccaggccgcgatcctgatgggcctggacaaggggtggcccatcagcaagatggacatcggcgtgcccctcctggccctggggtgctactcccaggtgaacccgctcaccctgaccgccgccgtcctgatgctcgtggcgcactacgccatcatcggccccgggctgcaggccaaggccacgcgcgaggcccagaagcgcaccgcggccggcatcatgaagaaccccaccgtggacggcatcgtcgccatcgacctggaccccgtggtgtacgacgccaagttcgagaagcagctcgggcagatcatgctgctgatcctctgcaccagccagatcctgctgatgcggacgacctgggccctctgcgagtccatcaccctggcgaccggcccgctgacgaccctctgggaggggagccccggcaagttctggaacaccaccatcgccgtctccatggccaacatcttccgcggcagctacctggccggggccggcctggcgttctccctcatgaagtccctcgggggcgggcggcgcggcacgggcgcccagggggagaccctgggcgagaagtggaagcggcagctcaaccagctgtccaagagcgagttcaacacctacaagcgcagcgggatcatggaggtggaccggtccgaggccaaggagggcctgaagcgcggggagaccacgaagcacgccgtgagccggggcaccgcgaagctccgctggttcgtcgagcggaacctggtgaagcccgagggcaaggtgatcgacctggggtgcggccgcgggggctggtcctactactgcgccgggctgaagaaggtcaccgaggtgaagggctacaccaagggcgggcccggccacgaggagccgatccccatggccacctacgggtggaacctcgtgaagctgcacagcggcaaggacgtcttcttcatgccgcccgagaagtgcgacacgctgctctgcgacatcggggagtccagcccgaaccccaccatcgaggagggccggaccctgcgcgtgctgaagatggtggagccctggctccggggcaaccagttctgcatcaagatcctgaacccctacatgccgtccgtcgtggagaccctggagcagatgcagcgcaagcacgggggcatgctcgtgcggaaccccctgagccgcaactccacgcacgagatgtactgggtcagctgcgggaccggcaacatcgtgtccgccgtgaacatgaccagccggatgctgctcaaccgcttcaccatggcccaccgcaagcccacgtacgagcgggacgtcgacctgggcgcggggacccgccacgtggccgtggagcccgaggtcgccaacctggacatcatcggccagcggatcgagaacatcaagaacgagcacaagtccacctggcactacgacgaggacaacccgtacaagacctgggcctaccacgggagctacgaggtgaagccctccggcagcgcctccagcatggtcaacggggtggtgcgcctcctgacgaagccctgggacgtcatccccatggtgacccagatcgcgatgaccgacaccacgccgttcggccagcagcgggtgttcaaggagaaggtcgacacccgcacgccccgggccaagcgcggcaccacgcagatcatggaggtgaccgccaagtggctgtggtccttcctcagccggaacaagaagccccgcatctgcacccgggaggagttcacccgcaaggtgcggagcaacgccgccatcggggcggtcttcgtggacgagaaccagtggaactccgccaaggaggccgtggaggacgagcgcttctgggacctggtccaccgggagcgcgagctgcacaagcagggcaagtgcgccacgtgcgtgtacaacatgatggggaagcgggagaagaagctcggcgagttcgggaaggcgaagggcagccgcgccatctggtacatgtggctgggcgcccggttcctggagttcgaggccctcgggttcatgaacgaggaccactggttctcccgcgagaacagcctgtccggcgtggagggggagggcctgcacaagctcgggtacatcctgcgggacatcagcaagatcccgggcggcaacatgtacgccgacgacaccgcggggtgggacacccgcatcaccgaggacgacctgcagaacgaggccaagatcacggacatcatggagcccgagcacgccctcctggccacctccatcttcaagctgacctaccagaacaaggtcgtgcgcgtgcagcggcccgccaagaacggcaccgtcatggacgtgatcagccgccgggaccagcgcgggtccggccaggtgggcacgtacgggctcaacaccttcaccaacatggaggtccagctgatccggcagatggagagcgagggcatcttcctgccctccgagctcgagaccccgaacctggcggagcgcgccctggactggctcgagaagcacggggccgagcggctgaagcgcatggccatcagcggcgacgactgcgtggtgaagcccatcgacgaccggttcgccacggcgctgaccgccctcaacgacatggggaaggtccgcaaggacatcccccagtgggagccctccaagggctggaacgactggcagcaggtcccgttctgcagccaccacttccaccagctgatcatgaaggacggccgggagatcgtggtcccctgccgcaaccaggacgagctggtggggcgggcccgcgtgtcccagggcgccgggtggagcctccgggagaccgcctgcctgggcaagtcctacgcgcagatgtggcagctgatgtacttccaccgccgggacctccgcctggccgccaacgccatctgcagcgcggtccccgtggactgggtgcccgccagccggaccacctggtccatccacgcccaccaccagtggatgacgaccgaggacatgctgagcgtctggaaccgcgtgtggatcgaggagaacccgtggatggaggacaagacccacgtgtccagctgggaggaggtcccctacctcgggaagcgcgaggaccagtggtgcggctccctgatcggcctgaccgcccgggccacgtgggcgaccaacatccaggtggccatcaaccaggtgcgccggctcatcgggaacgagaactacctggactacatgaccagcatgaagcgcttcaagaacgagtccgaccccgagggcgccctgtggtga

SEQ ID NO: 8869 - RNA, 9879 nt, synthetic construct
  misc_feature 1..9879: note = derived and/or modified CDS sequence (opt1) from DENV-1__KC692509__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtggagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcgtctcctacgtgatgtgcaccgggagcttcaagctggagaaggaggtggcggagacccagcacggcacggtcctggtccaggtgaagtacgagggcaccgacgccccctgcaagatccccttctccacccaggacgagaagggggtcacccagaacggccggctgatcacggccaacccgatcgtgaccgacaaggagaagcccgtgaacatcgagaccgagccgcccttcggggagagctacatcgtcgtgggcgccggcgagaaggcgctcaagctgtcctggttcaagcgcgggagctccatcggcaagatgttcgaggccaccgcccgcggggcgcgccgcatggccatcctgggcgacacggcgtgggacttcgggagcatcggcggcgtgttcacctccgtcgggaagctcgtgcaccaggtgttcggcaccgcctacggggtcctgttcagcggcgtgtcctggaccatgaagatcgggatcggcatcctgctcacgtggctgggcctgaacagccggtccaccagcctctccatgacctgcatcgccgtggggatggtcaccctgtacctgggcgtgatggtgcaggccgacagcgggtgcgtcatcaactggaagggccgcgagctcaagtgcgggtccggcatcttcgtgacgaacgaggtgcacacctggaccgagcagtacaagttccaggccgacagcccgaagcggctgagcgcggccatcggcaaggcctgggaggagggggtctgcggcatccgctccgccacccggctggagaacatcatgtggaagcagatcagcaacgagctcaaccacatcctgctggagaacgacatgaagttcaccgtggtggtcggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtggaggactacgggttcggcgtgttcaccacgaacatctggctgaagctgcgcgactcctacacccagatgtgcgaccaccggctcatgagcgcggccatcaaggactccaaggccgtccacgccgacatgggctactggatcgagagcgagaagaacgagacctggaagctggcccgcgcgtccttcatcgaggtgaagacctgcacgtggcccaagagccacaccctgtggtccaacggggtgctcgagagcgagatgatcatccccaagatcttcggcgggccgatctcccagcacaactaccggcccggctacttcacccagaccgccgggccctggcacctgggcaagctggagctcgacttcgacctgtgcgagggcacgaccgtcgtggtggacgagcactgcgggaaccgcggcccgagcctgcggaccaccacggtcaccgggaagatcatccacgagtggtgctgccgctcctgcaccctgccgcccctgcggttccgcggcgaggacgggtgctggtacggcatggagatccggcccgtgaaggagaaggaggagaacctggtgcgcagcatggtctccgccggcagcggggaggtggacagcttctccctcggcatcctgtgcgtgagcatcatgatcgaggaggtcatgcggtcccgctggagccgcaagatgctgatgaccgggacgctcgccgtgttcctgctgctcatcatgggccagctgacctggaacgacctgatccggctctgcatcatggtgggggccaacgcgtccgaccgcatgggcatgggcaccacctacctggccctgatggccacgttcaagatgcggccgatgttcgccgtcgggctcctgttccgccggctgaccagccgcgaggtgctcctgctgaccatcggcctctccctggtcgccagcgtggagctgcccaactccctcgaggagctgggggacggcctggcgatgggcatcatgatgctcaagctgctgaccgagttccagccccaccagctctggacgaccctgctgagcctcaccttcgtgcggaccacgctgtccctggactacgcctggaagaccaccgccatggtcctcagcatcgtgtccctgttccccctgtgcctcagcaccacgtcccagaagaccacctggctgccggtgctgctcgggagcttcggctgcaagcccctgaccatgttcctgatcaccgagaacaagatctgggggcgcaagtcctggcccctcaacgagggcatcatggccatcgggatcgtcagcatcctgctgtccagcctcctgaagaacgacgtgcccctggcgggcccgctcatcgccggcgggatgctgatcgcctgctacgtgatcagcggctccagcgccgacctgtccctcgagaaggccgcggaggtcagctgggagcaggaggccgagcactccggggccagccacaacatcctggtggaggtgcaggacgacggcacgatgaagatcaaggacgaggagcgggacgacaccctgaccatcctcctgaaggccaccctgctcgccgtctccggggtgtaccccatgagcatccccgcgacgctgttcgtgtggtacttctggcagaagaagaagcagcgctccggcgtcctgtgggacacccccagcccgcccgagatggagcgggccgtgctcgacgacggcatctaccgcatcctgcagcgggggctgctgggccgctcccaggtgggggtcggcgtgttccaggacggggtgttccacaccatgtggcacgtcacccggggcgccgtgctcatgtaccagggcaagcgcctggagcccagctgggcctccgtgaagaaggacctgatcagctacgggggcgggtggcggttccagggctcctggaacacgggggaggaggtccaggtgatcgccgtggagcccggcaagaacccgaagaacgtccagaccacccccggcaccttcaagacgcccgagggggaggtgggcgcgatcgccctcgacttcaagcccgggaccagcggctccccgatcgtgaaccgcgagggcaagatcgtcgggctgtacggcaacggggtggtgaccaccagcggcacgtacgtctccgccatcgcccaggccaaggcgagccaggaggggcccctgcccgagatcgaggacgaggtgttcaagaagcggaacctcaccatcatggacctgcacccgggcagcggcaagacccgccggtacctgcccgccatcgtgcgcgaggccatcaagcgcaagctccggaccctgatcctggcccccacgcgcgtcgtggcgtccgagatggccgaggccctcaaggggatgcccatccggtaccagaccaccgccgtcaagagcgagcacaccggccgcgagatcgtcgacctgatgtgccacgccacgttcaccatgcggctgctctccccggtgcgcgtgcccaactacaacatgatcatcatggacgaggcgcacttcaccgaccccgccagcatcgccgcccgggggtacatctccacccgcgtcggcatgggggaggccgcggccatcttcatgacggccacgccgcccggcagcgtggaggccttcccccagtccaacgccgtgatccaggacgaggagcgggacatccccgagcgcagctggaactccggctacgactggatcaccgacttccccgggaagaccgtctggttcgtgcccagcatcaagtccggcaacgacatcgcgaactgcctgcggaagaacgggaagcgcgtgatccagctgagccggaagacgttcgacaccgagtaccagaagaccaagaacaacgactgggactacgtcgtgaccacggacatctccgagatgggcgccaacttccgcgccgaccgggtgatcgacccccgccggtgcctcaagcccgtcatcctgaaggacgggcccgagcgcgtgatcctggccggcccgatgcccgtcaccgtggcgagcgccgcccagcggcgcggccgcatcgggcggaaccagaacaaggagggcgaccagtacgtgtacatggggcagcccctcaacaacgacgaggaccacgcccactggaccgaggccaagatgctgctggacaacatcaacacccccgagggcatcatcccggccctcttcgagcccgagcgcgagaagtccgccgccatcgacggggagtaccggctgcgcggcgaggcccggaagacgttcgtcgagctgatgcgccggggcgacctccccgtgtggctgagctacaaggtggcctccgaggggttccagtacagcgaccgccggtggtgcttcgacggcgagcgcaacaaccaggtcctggaggagaacatggacgtggagatctggaccaaggagggggagcggaagaagctccgcccccggtggctggacgcgcgcacctactccgacccgctggccctccgggagttcaaggagttcgccgccggccgccggagcgtgagcggcgacctgatcctggagatcgggaagctcccccagcacctgaccctgcgcgcccagaacgcgctcgacaacctggtcatgctgcacaactccgagcagggcgggaaggcctaccggcacgccatggaggagctccccgacaccatcgagacgctgatgctgctcgccctgatcgcggtgctgaccggcggggtgaccctcttcttcctgagcggcaagggcctggggaagacctccatcggcctcctgtgcgtcacggccagctccgccctgctctggatggccagcgtggagccccactggatcgccgcgtccatcatcctggagttcttcctgatggtgctcctgatcccggagcccgaccgccagcggacgccccaggacaaccagctggcctacgtcgtgatcgggctcctgttcatgatcctgaccgtggccgccaacgagatgggcctcctggagaccacgaagaaggacctggggatcggctacgtcgccgcggagaaccaccagcacgccaccatgctcgacgtggacctgcacccggccagcgcctggaccctgtacgccgtggcgaccacggtcatcacccccatgatgcgccacaccatcgagaacaccacggccaacatctccctcaccgccatcgccaaccaggccgcgatcctgatgggcctggacaaggggtggcccatcagcaagatggacatcggcgtgcccctcctggccctggggtgctactcccaggtgaacccgctcaccctgaccgccgccgtcctgatgctcgtggcgcactacgccatcatcggccccgggctgcaggccaaggccacgcgcgaggcccagaagcggaccgcggccggcatcatgaagaaccccaccgtggacggcatcgtcgccatcgacctggaccccgtggtgtacgacgccaagttcgagaagcagctcgggcagatcatgctgctgatcctctgcaccagccagatcctgctgatgcgcacgacctgggccctctgcgagtccatcaccctggcgaccggcccgctgacgaccctctgggaggggagccccggcaagttctggaacaccaccatcgccgtctccatggccaacatcttccggggcagctacctggccggggccggcctggcgttctccctcatgaagtccctcgggggcgggcgccgggggacgggcgcccagggggagaccctgggcgagaagtggaagcgccagctcaaccagctgtccaagagcgagttcaacacctacaagcggagcgggatcatggaggtggaccgctccgaggccaaggagggcctgaagcgcggggagaccacgaagcacgccgtgagccgcggcaccgcgaagctccggtggttcgtcgagcgcaacctggtgaagcccgagggcaaggtgatcgacctggggtgcggccgcgggggctggtcctactactgcgccgggctgaagaaggtcaccgaggtgaagggctacaccaagggcgggcccggccacgaggagccgatccccatggccacctacgggtggaacctcgtgaagctgcacagcggcaaggacgtcttcttcatgccgcccgagaagtgcgacacgctgctctgcgacatcggggagtccagcccgaaccccaccatcgaggagggccgcaccctgcgggtgctgaagatggtggagccctggctccgcggcaaccagttctgcatcaagatcctgaacccctacatgccgtccgtcgtggagaccctggagcagatgcagcggaagcacgggggcatgctcgtgcgcaaccccctgagccggaactccacgcacgagatgtactgggtcagctgcgggaccggcaacatcgtgtccgccgtgaacatgaccagccgcatgctgctcaaccgcttcaccatggcccaccggaagcccacgtacgagcgcgacgtcgacctgggcgcggggacccggcacgtggccgtggagcccgaggtcgccaacctggacatcatcggccagcgcatcgagaacatcaagaacgagcacaagtccacctggcactacgacgaggacaacccgtacaagacctgggcctaccacgggagctacgaggtgaagccctccggcagcgcctccagcatggtcaacggggtggtgcggctcctgacgaagccctgggacgtcatccccatggtgacccagatcgcgatgaccgacaccacgccgttcggccagcagcgcgtgttcaaggagaaggtcgacacccggacgccccgggccaagcggggcaccacgcagatcatggaggtgaccgccaagtggctgtgggggttcctctcccgcaacaagaagccccggatctgcacccgcgaggagttcacccggaaggtgcgcagcaacgccgccatcggcgcggtcttcgtggacgagaaccagtggaacagcgccaaggaggccgtggaggacgagcggttctgggacctggtccaccgcgagcgggagctgcacaagcaggggaagtgcgccacgtgcgtgtacaacatgatgggcaagcgcgagaagaagctcggggagttcggcaaggcgaagggctcccgggccatctggtacatgtggctgggggcccgcttcctggagttcgaggccctcggcttcatgaacgaggaccactggttcagccgggagaactccctgagcggggtggagggcgaggggctgcacaagctcggctacatcctgcgcgacatctccaagatcccgggcgggaacatgtacgccgacgacaccgcgggctgggacacccgcatcaccgaggacgacctgcagaacgaggccaagatcacggacatcatggagcccgagcacgccctcctggccaccagcatcttcaagctgacctaccagaacaaggtcgtgcgggtgcagcgccccgccaagaacgggaccgtcatggacgtgatctcccggcgcgaccagcggggcagcggccaggtggggacgtacggcctcaacaccttcaccaacatggaggtccagctgatccgccagatggagtccgaggggatcttcctgcccagcgagctcgagaccccgaacctggcggagcgggccctggactggctcgagaagcacggcgccgagcgcctgaagcggatggccatctccggggacgactgcgtggtgaagcccatcgacgaccgcttcgccacggcgctgaccgccctcaacgacatgggcaaggtccggaaggacatcccccagtgggagcccagcaagggctggaacgactggcagcaggtcccgttctgctcccaccacttccaccagctgatcatgaaggacgggcgcgagatcgtggtcccctgccggaaccaggacgagctggtgggccgcgcccgggtgagccagggggccggctggtccctccgcgagaccgcctgcctgggcaagagctacgcgcagatgtggcagctgatgtacttccaccggcgcgacctccggctggccgccaacgccatctgctccgcggtccccgtggactgggtgcccgccagccgcaccacctggagcatccacgcccaccaccagtggatgacgaccgaggacatgctgtccgtctggaaccgcgtgtggatcgaggagaacccgtggatggaggacaagacccacgtgagctcctgggaggaggtcccctacctcggcaagcgggaggaccagtggtgcggcagcctgatcgggctgaccgcccgcgccacgtgggcgaccaacatccaggtggccatctcccaggtgcggcgcctcatcggcaacgagaactacctggactacatgaccagcatgaagcggttcaagaacgagtccgaccccgagggggccctgtggtga

SEQ ID NO: 8870 - RNA, 9879 nt, synthetic construct
  misc_feature 1..9879: note = derived and/or modified CDS sequence (opt1) from DENV-1__KC692510__SS-prME
  source 1..9879: mol_type = other RNA
agcgtgaccatgctgctcatgctgctgcccaccgcgctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacccgcaccgagacctggatgagctccgagggcgcctggcggcagatccagcgcgtcgagacctgggccctgcggcaccccgggttcacggtgatcgccttcttcctggcgcacgccatcggcaccagcatcacccagaaggggatcatcttcatcctcctgatgctggtgaccccctccatggccatgcgctgcgtcggcatcggcaaccgggacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcgcaagctctgcatcgaggccaagatcagcaacaccaccacggactcccggtgcccgacccagggcgaggccaccctggtggaggagcaggacgccaacttcgtctgccgccggaccttcgtggaccgcggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccgccaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccggctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccgcctgatcacggccaacccgatcgtcaccgacaaggagaagcccgtgaacatcgagaccgagccgcccttcggggagagctacatcgtggtcggcgccggcgagaaggcgctcaagctgtcctggttcaagcgggggagctccatcggcaagatgttcgaggccaccgcccgcggggcccgccggatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccgctccaccagcctctccatgacctgcatcgccgtggggatggtgaccctgtacctgggcgtcatggtgcaggccgacagcgggtgcgtgatcaactggaagggccgggagctcaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctggagaacatcatgtggaagcagatcagcaacgagctcaaccacatcctgctggagaacgacatgaagttcaccgtcgtggtgggggacgccaacggcatcctcgcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcgtgttcaccacgaacatctggctgaagctgcgggactcctacacccagatgtgcgaccaccgcctcatgagcgcggccatcaaggactccaaggccgtgcacgccgacatgggctactggatcgagagcgagaagaacgagacctggaagctggcccgggcgtccttcatcgaggtcaagacctgcacgtggcccaagagccacaccctgtggtccaacggggtgctcgagagcgagatgatcatccccaagatcttcggcgggccgatctcccagcacaactaccgccccggctacttcacccagaccgccgggccctggcacctgggcaagctggagctcgacttcgacctgtgcgagggcacgaccgtggtcgtggacgagcactgcgggaaccggggcccgagcctgcgcaccaccacggtgaccgggaagatcatccacgagtggtgctgccggtcctgcaccctgccgcccctgcgcttccggggcgaggacgggtgctggtacggcatggagatccgccccgtcaaggagaaggaggagaacctggtgcggagcatggtgtccgccggcagcggggaggtcgacagcttctccctcggcatcctgtgcgtgagcatcatgatcgaggaggtgatgcgctcccgctggagccggaagatgctgatgaccgggacgctcgccgtcttcctgctgctcatcatgggccagctgacctggaacgacctgatccgcctctgcatcatggtgggggccaacgcgtccgaccggatgggcatgggcaccacctacctggccctgatggccacgttcaagatgcgcccgatgttcgccgtggggctcctgttccggcgcctgaccagccgggaggtcctcctgctgaccatcggcctctccctggtggccagcgtcgagctgcccaactccctcgaggagctgggggacggcctggcgatgggcatcatgatgctcaagctgctgaccgagttccagccccaccagctctggacgaccctgctgagcctcaccttcgtgaagaccacgctgtccctggactacgcctggaagaccaccgccatggtgctcagcatcgtctccctgttccccctgtgcctcagcaccacgtcccagaagaccacctggctgccggtgctgctcgggagcttcggctgcaagcccctgaccatgttcctgatcaccgagaacaagatctgggggcgcaagtcctggcccctcaacgagggcatcatggccatcgggatcgtgagcatcctgctgtccagcctcctgaagaacgacgtccccctggcgggcccgctcatcgccggcgggatgctgatcgcctgctacgtgatcagcggctccagcgccgacctgtccctcgagaaggccgcggaggtgagctgggagcaggaggccgagcactccggggccagccacaacatcctggtcgaggtgcaggacgacggcacgatgaagatcaaggacgaggagcgggacgacaccctgaccatcctcctgaaggccaccctgctcgccgtgtccggggtctaccccatgagcatccccgcgacgctgttcgtgtggtacttctggcagaagaagaagcagcgctccggcgtgctgtgggacacccccagcccgcccgaggtcgagcgggccgtgctcgacgacggcatctaccgcatcctgcagcgggggctgctgggccgctcccaggtgggggtcggcgtgttccaggacggggtgttccacaccatgtggcacgtcacccggggcgccgtgctcatgtaccagggcaagcgcctggagcccagctgggcctccgtgaagaaggacctgatcagctacgggggcgggtggcggttccagggctcctggaacacgggggaggaggtccaggtgatcgccgtggagcccggcaagaacccgaagaacgtccagaccacccccggcaccttcaagacgcccgagggggaggtgggcgcgatcgccctcgacttcaagcccgggaccagcggctccccgatcgtgaaccgcgagggcaagatcgtcgggctgtacggcaacggggtggtgaccaccagcggcacgtacgtctccgccatcgcccaggccaaggcgagccaggaggggcccctgcccgagatcgaggacgaggtgttcaagaagcggaacctcaccatcatggacctgcacccgggcagcggcaagacccgccggtacctgcccgccatcgtgcgcgaggccatcaagcgcaagctccggaccctgatcctggcccccacgcgcgtcgtggcgtccgagatggccgaggccctcaaggggatgcccatccggtaccagaccaccgccgtcaagagcgagcacaccggccgcgagatcgtcgacctgatgtgccacgccacgttcaccatgcggctgctctccccggtgcgcgtgcccaactacaacatgatcatcatggacgaggcgcacttcaccgaccccgccagcatcgccgcccgggggtacatctccacccgcgtcggcatgggggaggccgcggccatcttcatgacggccacgccgcccggcagcgtggaggccttcccccagtccaacgccgtgatccaggacgaggagcgggacatccccgagcgcagctggaactccggctacgactggatcaccgacttccccgggaagaccgtctggttcgtgcccagcatcaagtccggcaacgacatcgcgaactgcctgcggaagaacgggaagcgcgtgatccagctgagccggaagacgttcgacaccgagtaccagaagaccaagaacaacgactgggactacgtcgtgaccacggacatctccgagatgggcgccaacttccgcgccgaccgggtgatcgacccccgccggtgcctcaagcccgtcatcctgaaggacgggcccgagcgcgtgatcctggccggcccgatgcccgtcaccgtggcgagcgccgcccagcggcgcggccgcatcgggcggaaccagaacaaggagggcgaccagtacgtgtacatggggcagcccctcaacaacgacgaggaccacgcccactggaccgaggccaagatgctgctggacaacatcaacacccccgagggcatcatcccggccctcttcgagcccgagcgcgagaagtccgccgccatcgacggggagtaccggctgcgcggcgaggcccggaagacgttcgtcgagctgatgcgccggggcgacctccccgtgtggctgagctacaaggtggcctccgaggggttccagtacagcgaccgccggtggtgcttcgacggcgagcgcaacaaccaggtcctggaggagaacatggacgtggagatctggaccaaggagggggagcggaagaagctccgcccccggtggctggacgcgcgcacctactccgacccgctggccctccgggagttcaaggagttcgccgccggccgccggagcgtgagcggcgacctgatcctggagatcgggaagctcccccagcacctgaccctgcgcgcccagaacgcgctcgacaacctggtcatgctgcacaactccgagcagggcgggaaggcctaccggcacgccatggaggagctccccgacaccatcgagacgctgatgctgctcgccctgatcgcggtgctgaccggcggggtgaccctcttcttcctgagcggcaagggcctggggaagacctccatcggcctcctgtgcgtcacggccagctccgccctgctctggatggccagcgtggagccccactggatcgccgcgtccatcatcctggagttcttcctgatggtgctcctgatcccggagcccgaccgccagcggacgccccaggacaaccagctggcctacgtcgtgatcgggctcctgttcatgatcctgaccgtggccgccaacgagatgggcctcctggagaccacgaagaaggacctggggatcggctacgtcgccgcggagaaccaccagcacgccaccatgctcgacgtggacctgcacccggccagcgcctggaccctgtacgccgtggcgaccacggtcatcacccccatgatgcgccacaccatcgagaacaccacggccaacatctccctcaccgccatcgccaaccaggccgcgatcctgatgggcctggacaaggggtggcccatcagcaagatggacatcggcgtgcccctcctggccctggggtgctactcccaggtgaacccgctcaccctgaccgccgccgtcctgatgctcgtggcgcactacgccatcatcggccccgggctgcaggccaaggccacgcgcgaggcccagaagcggaccgcggccggcatcatgaagaaccccaccgtggacggcatcgtcgccatcgacctggaccccgtggtgtacgacgccaagttcgagaagcagctcgggcagatcatgctgctgatcctctgcaccagccagatcctgctgatgcgcacgacctgggccctctgcgagtccatcaccctggcgaccggcccgctgacgaccctctgggaggggagccccggcaagttctggaacaccaccatcgccgtctccatggccaacatcttccggggcagctacctggccggggccggcctggcgttctccctcatgaagtccctcgggggcgggcgccgggggacgggcgcccagggggagaccctgggcgagaagtggaagcgccagctcaaccagctgtccaagagcgagttcaacacctacaagcggagcgggatcatggaggtggaccgctccgaggccaaggagggcctgaagcgcggggagaccacgaagcacgccgtgagccgcggcaccgcgaagctccggtggttcgtcgagcgcaacctggtgaagcccgagggcaaggtgatcgacctggggtgcggccgcgggggctggtcctactactgcgccgggctgaagaaggtcaccgaggtgaagggctacaccaagggcgggcccggccacgaggagccgatccccatggccacctacgggtggaacctcgtgaagctgcacagcggcaaggacgtcttcttcatgccgcccgagaagtgcgacacgctgctctgcgacatcggggagtccagcccgaaccccaccatcgaggagggccgcaccctgcgggtgctgaagatggtggagccctggctccgcggcaaccagttctgcatcaagatcctgaacccctacatgccgtccgtcgtggagaccctggagcagatgcagcggaagcacgggggcatgctcgtgcgcaaccccctgagccggaactccacgcacgagatgtactgggtcagctgcgggaccggcaacatcgtgtccgccgtgaacatgaccagccgcatgctgctcaaccgcttcaccatggcccaccggaagcccacgtacgagcgcgacgtcgacctgggcgcggggacccggcacgtggccgtggagcccgaggtcgccaacctggacatcatcggccagcgcatcgagaacatcaagaacgagcacaagtccacctggcactacgacgaggacaacccgtacaagacctgggcctaccacgggagctacgaggtgaagccctccggcagcgcctccagcatggtcaacggggtggtgcggctcctgacgaagccctgggacgtcatccccatggtgacccagatcgcgatgaccgacaccacgccgttcggccagcagcgcgtgttcaaggagaaggtcgacacccggacgccccgggccaagcggggcaccacgcagatcatggaggtgaccgccaagtggctgtgggggttcctctcccgcaacaagaagccccggatctgcacccgcgaggagttcacccggaaggtgcgcagcaacgccgccatcggcgcggtcttcgtggacgagaaccagtggaacagcgccaaggaggccgtggaggacgagcggttctgggacctggtccaccgcgagcgggagctgcacaagcaggggaagtgcgccacgtgcgtgtacaacatgatgggcaagcgcgagaagaagctcggggagttcggcaaggcgaagggctcccgggccatctggtacatgtggctgggggcccgcttcctggagttcgaggccctcggcttcatgaacgaggaccactggttcagccgggagaactccctgagcggggtggagggcgaggggctgcacaagctcggctacatcctgcgcgacatctccaagatcccgggcgggaacatgtacgccgacgacaccgcgggctgggacacccgcatcaccgaggacgacctgcagaacgaggccaagatcacggacatcatggagcccgagcacgccctcctggccaccagcatcttcaagctgacctaccagaacaaggtcgtgcgggtgcagcgccccgccaagaacgggaccgtcatggacgtgatctcccggcgcgaccagcggggcagcggccaggtggggacgtacggcctcaacaccttcaccaacatggaggtccagctgatccgccagatggagtccgaggggatcttcctgcccagcgagctcgagaccccgaacctggcggagcgggccctggactggctcgagaagcacggcgccgagcgcctgaagcggatggccatctccggggacgactgcgtggtgaagcccatcgacgaccgcttcgccacggcgctgaccgccctcaacgacatgggcaaggtccggaaggacatcccccagtgggagcccagcaagggctggaacgactggcagcaggtcccgttctgctcccaccacttccaccagctgatcatgaaggacgggcgcgagatcgtggtcccctgccggaaccaggacgagctggtgggccgcgcccgggtgagccagggggccggctggtccctccgcgagaccgcctgcctgggcaagagctacgcgcagatgtggcagctgatgtacttccaccggcgcgacctccggctggccgccaacgccatctgctccgcggtccccgtggactgggtgcccgccagccgcaccacctggagcatccacgcccaccaccagtggatgacgaccgaggacatgctgtccgtctggaaccgcgtgtggatcgaggagaacccgtggatggaggacaagacccacgtgagctcctgggaggaggtcccctacctcggcaagcgggaggaccagtggtgcggcagcctgatcgggctgaccgcccgcgccacgtgggcgaccaacatccaggtggccatcaaccaggtgcggcgcctcatcggcaacgagaactacctggactacatgacctccatgaagcggttcaagaacgagagcgaccccgagggggccctgtggtga

SEQ ID NO: 8871 - RNA, 9879 nt, synthetic construct
  misc_feature 1..9879: note = derived and/or modified CDS sequence (opt1) from DENV-1__KC692511__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagaccagcgtgggggtgaacatgtgcaccctgatcgcgatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtcggcctggggctcgagacccgcaccgagacctggatgagctccgagggcgcgtggaagcagatccagaaggtggagaactgggccctgcggcaccccgggttcaccgtgatcgccctgttcctcgcccacgcgatcggcacgagcatcacccagaaggggatcatcttcatcctgctgatgctcgtcaccccctccatggccatgcgctgcgtgggcatcggcaaccgggacttcgtggaggggctgagcggcgccacctgggtcgacgtggtgctggagcacgggtcctgcgtcacgaccatggccaagaacaagcccaccctcgacatcgagctgctgaagaccgaggtgacgaaccccgccgtgctccgcaagctgtgcatcgaggcgaagatcagcaacaccaccaccgactcccggtgcccgacgcagggcgaggccaccctggtcgaggagcaggacgccaacttcgtgtgccgccggaccttcgtggaccgcggctgggggaacggctgcggcctcttcggcaaggggagcctgctgacctgcgccaagttcaagtgcgtcacgaagctcgagggcaagatcgtgcagtacgagaacctgaagtactccgtgatcgtcaccgtgcacaccggcgaccagcaccaggtcgggaacgagaccacggagcacggcaccatcgccaccatcacgccccaggcgcccaccagcgagatccagctgacggactacggggccctcaccctggactgcagcccccggaccggcctggacttcaacgagatggtgctcctgaccatgaaggagaagtcctggctggtgcacaagcagtggttcctcgacctgccgctgccctggacgtccggggccagcaccagccaggagacctggaaccgccaggacctcctggtcaccttcaagacggcccacgccaagaagcaggaggtggtggtcctgggctcccaggagggcgcgatgcacaccgccctcaccggggccaccgagatccagacgagcggcaccaccaccatcttcgccgggcacctgaagtgccggctgaagatggacaagctcacgctgaagggcatgtcctacgtgatgtgcaccgggagcttcaagctggagaaggaggtggccgagacccagcacggcaccgtcctggtccaggtgaagtacgagggcacggacgcgccctgcaagatccccttcctcacccaggacgagaagggggtcacccagaacggccgcctgatcaccgccaacccgatcgtgacggacaaggagaagcccgtgaacatcgagaccgagccgcccttcggggagtcctacatcgtcgtgggcgccggcgagaaggccctgaagctcagctggttcaagaaggggtccagcatcggcaagatgttcgaggcgaccgcccgcggggcccgccggatggccatcctgggcgacaccgcctgggacttcgggtccatcggcggcctgttcacgagcgtggggaagctcatccaccagatcttcggcaccgcgtacggggtcctgttctccggcgtgagctggaccatgaagatcgggatcggcatcctgctcacctggctgggcctgaactcccgcagcacgtccctcagcatgacctgcatcgccgtggggatggtcaccctgtacctgggcgtgatggtgcaggccgactccgggtgcgtcatcaactggaagggccgcgagctcaagtgcgggagcggcatcttcgtgaccaacgaggtgcacacgtggaccgagcagtacaagttccaggccgactccccgaagcggctgagcgccgcgatcggcaaggcctgggaggagggggtctgcggcatccgcagcgccacccggctggagaacatcatgtggaagcagatctccaacgagctcaactacatcctgctggagaacgacatgaagttcaccgtggtggtcggggacatcaacggcatcctcgcccaggggaagaagatgatccgcccccagcccatggagcacaagtacagctggaagtcctggggcaaggccaagatcatcggcgcggacatccagaacaccacgttcatcatcgacgggcccgacaccccggagtgccccaacgaccagcgggcctggaacatctgggaggtggaggactacggcttcgggatcttcaccaccaacatctggctgaagctgcgcgacagccacacgcagatgtgcgaccaccggctcatgtccgccgccatcaaggacagcaaggcggtgcacgccgacatgggctactggatcgagtccgagaagaacgagacctggaagctggcccgcgccagcttcatcgaggtcaagacctgcatctggcccaagtcccacaccctgtggagcaacggcgtgctcgagtccgagatggtgatccccaagatctacgggggcccgatcagccagcacaactaccggcccgggtacttcacgcagaccgccggcccctggcacctggggaagctggagctcgacttcgacctgtgcgagggcaccaccgtcgtggtggacgagcactgcggctaccgcgggccgtccctgcggacgaccaccgtcaccggcaagatcatccacgagtggtgctgccgcagctgcacgctgccgcccctgcggttccgcggggaggacggctgctggtacgggatggagatccggcccgtgaaggagaaggaggagaacctggtgcgctccatggtcagcgcgggctccggcgaggtggacagcttcagcctcgggatcctgtgcgtgtccatcctgatcgaggaggtcatgcggagccgctggtcccggaagatgctcatgaccggcaccctggccgtgttcctgctcctgatcatggggcagctgacctggaacgacctcatccgcctgtgcatcatggtgggcgccaacgccagcgaccgcatggggatgggcacgacctacctggccctcatggccaccttcaagatgcggccgatgttcgccgtcgggctgctgttccgccggctcacctcccgcgaggtgctgctgctcacggtggggctgagcctggtcgcctccgtggagctccccaacagcctggaggagctgggcgacgggctcgccatgggcatcatgatgctgaagctgctcaccgacttccagccccaccagctgtggaccaccctgctctccctgacgttcatccggaccagcctgtccctcgactacgcctggaagaccatggcgatggccctgagcatcgtctccctgttccccctctgcctgagcaccacgtcccagaagaccacctggctgccggtgctcctgggcagcttcgggtgcaagcccctgaccatgttcctcatcacggagaacaagatctggggccgcaagtcctggcccatcaacgaggggatcatggccgtgggcatcgtcagcatcctgctgtccagcctcctgaagaacgacgtgcccctggccgggccgctcatcgcgggcggcatgctgatcgcctgctacgtgatcagcgggtccagcgccgacctgtccctcgagaaggccgccgaggtcagctgggaggaggaggcggagcactccggcaccagccacaacatcctggtggaggtgcaggacgacgggaccatgaagatcaaggacgaggagcgggacgacaccctgaccatcctcctgaaggccacgctgctcgccgtctccggcgtgtaccccatgagcatccccgccaccctgttcgtgtggtacttctggcagaagaagaagcagcgctccggggtcctgtgggacacccccagcccgcccgaggtggagcgggccgtgctggacgacggcatctaccgcatcctccagcggggcctgctggggcgctcccaggtcggcgtgggggtgttccaggacggcgtcttccacaccatgtggcacgtgacgcgcggggcggtgctcatgtaccagggcaagcgcctggagcccagctgggcctccgtcaagaaggacctgatcagctacggcgggggctggcggttccaggggtcctggaacaccggcgaggaggtccaggtgatcgccgtcgagcccgggaagaacccgaagaacgtgcagaccacccccggcacgttcaagacccccgagggcgaggtgggggccatcgccctcgacttcaagcccggcaccagcgggtccccgatcgtcaaccgcgagggcaagatcgtgggcctgtacgggaacggcgtggtcaccacgagcgggacctacgtgtccgcgatcgcccaggccaaggccacccaggagggccccctgcccgagatcgaggacgaggtgttcaagaagcggaacctcaccatcatggacctgcacccggggagcggcaagacgcgccggtacctgcccgccatcgtccgcgaggcgatcaagcggaagctccgcaccctgatcctggcccccacccgcgtggtggccagcgagatggccgaggcgctcaagggcatgcccatccggtaccagaccacggccgtcaagtccgagcacaccgggcgcgagatcgtggacctgatgtgccacgccaccttcaccatgcggctgctcagcccggtgcgcgtccccaactacaacatgatcatcatggacgaggcccacttcacggaccccgcctccatcgcggcccggggctacatcagcacccgcgtggggatgggcgaggccgccgccatcttcatgaccgcgacgccgcccgggtccgtggaggccttcccccagagcaacgccgtcatccaggacgaggagcgggacatccccgagcgctcctggaacagcggctacgactggatcacggacttccccggcaagaccgtgtggttcgtgccctccatcaagagcgggaacgacatcgccaactgcctgcggaagaacggcaagcgcgtcatccagctgtcccggaagaccttcgacaccgagtaccagaagacgaagaacaacgactgggactacgtggtgaccaccgacatcagcgagatgggggccaacttccgcgcggaccgggtcatcgacccccgccggtgcctcaagcccgtgatcctgaaggagggccccgagcgcgtgatcctggccgggccgatgcccgtcaccgtggcctccgccgcgcagcggcgcggccggatcggccgcaaccagaacaaggagggggaccagtacatctacatgggccagcccctcaacaacgacgaggaccacgcccactggacggaggccaagatgctgctggacaacatcaacacccccgaggggatcatcccggccctcttcgagcccgagcgcgagaagtccgccgcgatcgacggcgagtaccggctgcgcggggaggcccggaagaccttcgtcgagctgatgcgccggggcgacctccccgtgtggctgtcctacaaggtggccagcgagggcttccagtactccgaccgccggtggtgcttcgacggggagcgcaacaaccaggtcctggaggagaacatggacgtggagatctggaccaaggagggcgagcggaagaagctccgcccccggtggctggacgcccgcacgtacagcgacccgctggccctccgggagttcaaggagttcgcggccgggcgccggtccgtgagcggcgacctgatcctggagatcggcaagctcccccagcacctgaccctgcgcgcccagaacgccctcgacaacctggtcatgctgcacaacagcgagcagggcgggaaggcctaccggcacgcgatggaggagctccccgacaccatcgagaccctgatgctgctcgccctgatcgccgtgctgaccgggggcgtgaccctcttcttcctgtccgggaagggcctgggcaagaccagcatcgggctcctgtgcgtcatggcctccagcgcgctgctctggatggcctccgtggagccccactggatcgccgccagcatcatcctggagttcttcctgatggtgctcctgatcccggagcccgaccgccagcggacgccccaggacaaccagctggcctacgtcgtgatcggcctcctgttcatgatcctgaccgtggcggccaacgagatggggctcctggagacgaccaagaaggacctgggcatcgggcacgtcgccgtggagaaccaccaccacgccaccatgctcgacgtggacctgcgcccggcctccgcgtggaccctgtacgccgtcgccacgaccgtgatcacccccatgatgcggcacaccatcgagaacacgaccgccaacatcagcctcaccgccatcgcgaaccaggccgccatcctgatgggcctggacaagggctggcccatctccaagatggacatcggggtgcccctcctggccctgggctgctacagccaggtcaacccgctcaccctgacggccgcggtgctgatgctcgtggcccactacgccatcatcgggcccggcctgcaggccaaggcgacccgcgaggcccagaagcgcaccgccgccgggatcatgaagaaccccaccgtcgacggcatcgtgacgatcgacctggaccccgtggtctacgacgccaagttcgagaagcagctcggccagatcatgctgctgatcctctgcacctcccagatcctgctgatgcggaccacctgggcgctctgcgagagcatcacgctggccaccgggccgctgaccaccctctgggagggctcccccgggaagttctggaacacgaccatcgccgtgagcatggccaacatcttccgcggctcctacctggccggcgcggggctggccttcagcctcatgaagtccctgggcgggggccggcgcgggaccggcgcccagggcgagaccctgggggagaagtggaagcggcagctcaaccagctgagcaagtccgagttcaacacgtacaagaagtccggcatcatggaggtggaccgcagcgaggccaaggaggggctgaagcggggcgagaccaccaagcacgccgtctcccgcgggaccgcgaagctgcggtggttcgtggagcgcaacctcgtgaagcccgagggcaaggtcatcgacctgggctgcgggcggggcgggtggagctactactgcgccggcctgaagaaggtgacggaggtgaaggggtacaccaagggcggccccgggcacgaggagccgatccccatggccacctacggctggaacctcgtcaagctgcactccgggaaggacgtgttcttcacgccgcccgagaagtgcgacaccctgctctgcgacatcggcgagagctccccgaaccccacgatcgaggaggggcgcaccctgcgggtgctgaagatggtcgagccctggctccgcggcaaccagttctgcatcaagatcctgaacccctacatgccgagcgtggtggagaccctggagcagatgcagcggaagcacggcgggatgctcgtccgcaaccccctgtcccggaacagcacccacgagatgtactgggtgtcctgcggcacggggaacatcgtgagcgccgtcaacatgacctcccgcatgctgctcaaccggttcaccatggcgcaccgcaagcccacctacgagcgcgacgtggacctgggcgccggcacgcggcacgtggccgtcgagcccgaggtggccaacctggacatcatcgggcagcgcatcgagaacatcaagaacgagcacaagagcacctggcactacgacgaggacaacccgtacaagacctgggcctaccacggctcctacgaggtgaagcccagcgggtccgcgagctccatggtcaacggcgtggtccggctcctgaccaagccctgggacgtgatccccatggtgacgcagatcgccatgaccgacaccaccccgttcgggcagcagcgcgtcttcaaggagaaggtggacacgcggacgccccgggccaagcggggcaccgcccagatcatggaggtgaccgccaagtggctgtggggcttcctcagccgcaacaagaagccccggatctgcacgcgcgaggagttcacccggaaggtccgctccaacgcggccatcggggccgtgttcgtggacgagaaccagtggaacagcgccaaggaggccgtcgaggacgagcggttctgggacctggtgcaccgcgagcgggagctgcacaagcagggcaagtgcgcgacctgcgtgtacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtcgagggggagggcctgcacaagctcgggtacatcctgcgcgacatcagcaagatcccgggcggcaacatgtacgccgacgacaccgccgggtgggacacgcggatcaccgaggacgacctgcagaacgaggccaagatcaccgacatcatggagcccgagcacgccctcctggcgacctccatcttcaagctgacgtaccagaacaaggtggtgcgcgtccagcgccccgccaagagcggcaccgtgatggacgtgatctcccggcgcgaccagcgggggagcggccaggtcggcacctacgggctcaacaccttcacgaacatggaggtgcagctgatccgccagatggagtccgagggcatcttcagcccctccgagctggagaccccgaacctcgccaagaaggtgctggactggctggagaagcacggggccgagcggctcaagcgcatggccatcagcggcgacgactgcgtcgtgaagcccatcgacgaccggttcgcgaccgccctgaccgccctgaacgacatggggaaggtgcgcaaggacatcccccagtgggagccctccaagggctggaacgactggcagcaggtcccgttctgcagccaccacttccaccagctcatcatgaaggacggccgggagatcgtggtgccctgccgcaaccaggacgagctggtcgggcgggcccgcgtgtcccagggcgccgggtggagcctgcgggagacggcgtgcctcggcaagtcctacgcccagatgtggcagctgatgtacttccaccgccgggacctgcgcctcgccgccaacgccatctgcagcgcggtgcccgtcgactgggtgcccaccagccggaccacctggtccatccacgcccaccaccagtggatgaccacggaggacatgctgagcgtgtggaaccgcgtctggatcgaggagaacccgtggatggaggacaagacccacgtgtccagctgggaggaggtgccctacctggggaagcgggaggaccagtggtgcggctccctcatcggcctgaccgcccgcgccacctgggcgacgaacatccaggtcgccatcaaccaggtgcgccggctgatcgggaacgagaactacctcgactacatgaccagcatgaagcgcttcaagaacgagtccgaccccgagggcgccctgtggtga

SEQ ID NO: 8872 - RNA, 9879 nt, synthetic construct
  misc_feature 1..9879: note = derived and/or modified CDS sequence (opt1) from DENV-1__KC692512__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagacctccgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagcgcgggagctccatcggcaagatgttcgaggccaccgcccgcggggcccgccgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccggtccaccagcctgtccatgacctgcatcgccgtggggatggtgaccctgtacctcggcgtcatggtgcaggccgacagcgggtgcgtgatcaactggaagggccgcgagctgaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcaccgtcgtggtgggggacgccaacggcatcctggcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtcgaggactacgggttcggcgtgttcaccacgaacatctggctgaagctccgcgactcctacacccagatgtgcgaccaccggctgatgagcgcggccatcaaggactccaaggccgtgcacgccgacatgggctactggatcgagagcgagaagaacgagacctggaagctggcccgcgcgtccttcatcgaggtcaagacctgcacgtggcccaagagccacaccctctggtccaacggggtgctggagagcgagatgatcatccccaagatcttcggcgggccgatctcccagcacaactaccggcccggctacttcacccagaccgccgggccctggcacctgggcaagctcgagctggacttcgacctgtgcgagggcacgaccgtggtcgtggacgagcactgcgggaaccgcggcccgagcctccggaccaccacggtgaccgggaagatcatccacgagtggtgctgccgctcctgcaccctgccgcccctgcggttccgcggcgaggacgggtgctggtacggcatggagatccggcccgtcaaggagaaggaggagaacctcgtgcgcagcatggtgtccgccggcagcggggaggtcgacagcttctccctgggcatcctgtgcgtgagcatcatgatcgaggaggtgatgcggtcccgctggagccgcaagatgctcatgaccgggacgctggccgtcttcctgctcctgatcatgggccagctgacctggaacgacctcatccggctgtgcatcatggtgggggccaacgcgtccgaccgcatgggcatgggcaccacctacctggccctcatggccacgttcaagatgcggccgatgttcgccgtggggctgctgttccgccggctcaccagccgcgaggtcctgctgctcaccatcgggctgtccctggtggccagcgtcgagctccccaactccctggaggagctgggggacggcctcgcgatgggcatcatgatgctgaagctgctcaccgagttccagccccaccagctgtggacgaccctgctcagcctgaccttcgtgaagaccacgctgtccctcgactacgcctggaagaccaccgccatggtgctgagcatcgtctccctgttccccctctgcctgagcaccacgtcccagaagaccacctggctgccggtgctcctggggagcttcggctgcaagcccctgaccatgttcctcatcaccgagaacaagatctgggggcggaagtcctggcccctgaacgagggcatcatggccatcgggatcgtgagcatcctgctctccagcctgctgaagaacgacgtccccctcgcgggcccgctgatcgccggcgggatgctgatcgcctgctacgtgatcagcggctccagcgccgacctctccctggagaaggccgcggaggtgagctgggagcaggaggccgagcactccggggccagccacaacatcctggtcgaggtgcaggacgacggcacgatgaagatcaaggacgaggagcgcgacgacaccctcaccatcctgctgaaggccaccctcctggccgtgtccggggtctaccccatgagcatccccgcgacgctgttcgtgtggtacttctggcagaagaagaagcagcggtccggcgtgctctgggacacccccagcccgcccgaggtcgagcgcgccgtgctggacgacggcatctaccggatcctgcagcgcgggctgctcggccggtcccaggtgggggtcggcgtgttccaggacggggtgttccacaccatgtggcacgtcacccgcggcgccgtgctgatgtaccagggcaagcggctggagcccagctgggcctccgtgaagaaggacctcatcagctacgggggcgggtggcgcttccagggctcctggaacacgggggaggaggtccaggtgatcgccgtggagcccggcaagaacccgaagaacgtccagaccacccccggcaccttcaagacgcccgagggggaggtgggcgcgatcgccctggacttcaagcccgggaccagcggctccccgatcgtgaaccgggaggagaagatcgtcggcctgtacgggaacggcgtggtgaccaccagcgggacgtacgtctccgccatcgcccaggccaaggcgagccaggagggccccctccccgagatcgaggacgaggtgttcaagaagcgcaacctgaccatcatggacctgcacccggggagcggcaagacccggcgctacctccccgccatcgtgcgggaggccatcaagcgcaagctgcgcaccctgatcctcgcccccacgcgggtcgtggcgtccgagatggccgaggccctgaagggcatgcccatccgctaccagaccaccgccgtcaagagcgagcacaccgggcgggagatcgtcgacctgatgtgccacgccacgttcaccatgcgcctcctgtccccggtgcgggtgcccaactacaacatgatcatcatggacgaggcgcacttcaccgaccccgccagcatcgccgcccgcggctacatctccacccgggtcgggatgggcgaggccgcggccatcttcatgacggccacgccgcccgggagcgtggaggccttcccccagtccaacgccgtgatccaggacgaggagcgcgacatccccgagcggagctggaactccggctacgactggatcaccgacttccccggcaagaccgtctggttcgtgcccagcatcaagtccgggaacgacatcgcgaactgcctgcgcaagaacggcaagcgggtgatccagctcagccgcaagacgttcgacaccgagtaccagaagaccaagaacaacgactgggactacgtcgtgaccacggacatctccgagatgggggccaacttccgggccgaccgcgtgatcgacccccggcgctgcctgaagcccgtcatcctgaaggacggccccgagcgggtgatcctcgccgggccgatgcccgtcaccgtggcgagcgccgcccagcgccggggccgcatcggccgcaaccagaacaaggagggggaccagtacgtgtacatgggccagcccctgaacaacgacgaggaccacgcccactggaccgaggccaagatgctgctcgacaacatcaacacccccgaggggatcatcccggcgctgttcgagcccgagcgggagaagtccgccgccatcgacggcgagtaccgcctgcgcggggaggcccgcaagacgttcgtcgagctcatgcggcgcggcgacctgcccgtgtggctgagctacaaggtggcctccgagggcttccagtacagcgaccggcgctggtgcttcgacggggagcggaacaaccaggtcctcgaggagaacatggacgtggagatctggaccaaggagggcgagcgcaagaagctgcggccccgctggctggacgcgcggacctactccgacccgctcgccctgcgcgagttcaaggagttcgccgccgggcggcgcagcgtgagcggcgacctgatcctcgagatcggcaagctgccccagcacctgaccctccgggcccagaacgcgctggacaacctggtcatgctccacaactccgagcagggcgggaaggcctaccgccacgccatggaggagctgcccgacaccatcgagacgctgatgctcctggccctgatcgcggtgctcaccgggggcgtgaccctgttcttcctgagcgggaagggcctcggcaagacctccatcgggctgctgtgcgtcacggccagctccgccctcctgtggatggccagcgtggagccccactggatcgccgcgtccatcatcctggagttcttcctcatggtgctgctgatcccggagcccgaccggcagcgcacgccccaggacaaccagctcgcctacgtcgtgatcggcctgctgttcatgatcctcaccgtggccgccaacgagatggggctgctggagaccacgaagaaggacctcggcatcgggcacgtcgccgcggagaaccaccagcacagcaccatgctggacgtggacctgcacccggcctccgcctggaccctctacgccgtggccaccacggtcatcacccccatgatgcggcacaccatcgagaacaccacggcgaacatcagcctgaccgccatcgccaaccaggccgccatcctgatgggcctcgacaagggctggcccatctccaagatggacatcggggtgcccctgctggcgctcggctgctacagccaggtgaacccgctgaccctgaccgccgccgtcctcatgctggtggcccactacgcgatcatcgggcccggcctgcaggccaaggccacgcgcgaggcccagaagcgcaccgccgcggggatcatgaagaaccccaccgtggacggcatcgtcgccatcgacctcgaccccgtggtgtacgacgccaagttcgagaagcagctgggccagatcatgctgctcatcctgtgcacctcccagatcctgctcatgcggacgacctgggccctgtgcgagagcatcaccctggccaccgggccgctcacgaccctgtgggagggctcccccgggaagttctggaacaccaccatcgcggtcagcatggccaacatcttccgcggctcctacctggccggcgccgggctcgccttcagcctgatgaagtccctgggcgggggccggcgcgggacgggcgcgcagggcgagaccctcggggagaagtggaagcggcagctgaaccagctgagcaagagcgagttcaacacctacaagcgctccggcatcatggaggtggaccggagcgaggccaaggaggggctcaagcgcggcgagaccacgaagcacgccgtgtcccgggggaccgccaagctgcgctggttcgtcgagcggaacctggtgaagcccgagggcaaggtgatcgacctgggctgcgggcgcggcgggtggagctactactgcgcgggcctcaagaaggtcaccgaggtgaaggggtacaccaagggcggccccgggcacgaggagccgatccccatggccacctacggctggaacctggtgaagctgcactccgggaaggacgtcttcttcatgccgcccgagaagtgcgacacgctcctgtgcgacatcggcgagagctccccgaaccccaccatcgaggaggggcggaccctgcgcgtgctcaagatggtggagccctggctgcggggcaaccagttctgcatcaagatcctgaacccctacatgccgagcgtcgtggagaccctcgagcagatgcagcgcaagcacggcgggatgctggtgcggaaccccctgtcccgcaacagcacgcacgagatgtactgggtctcctgcggcaccgggaacatcgtgagcgccgtgaacatgacctcccggatgctcctgaaccgcttcaccatggcccaccgcaagcccacgtacgagcgggacgtcgacctgggcgccggcacccgccacgtggcggtggagcccgaggtcgccaacctcgacatcatcgggcagcggatcgagaacatcaagaacgagcaccgcagcacctggcactacgacgaggacaacccgtacaagacctgggcctaccacggctcctacgaggtgaagcccagcgggtccgccagctccatggtcaacggcgtggtgcggctgctgacgaagccctgggacgtcatccccatggtgacccagatcgccatgaccgacaccacgccgttcgggcagcagcgcgtgttcaaggagaaggtcgacacccggacgccccgggcgaagcggggcaccacgcagatcatggaggtgaccgccaagtggctctggggcttcctgagccgcaacaagaagccccggatctgcacccgcgaggagttcacccggaaggtgcgcagcaacgccgccatcggggccgtcttcgtggacgagaaccagtggaactccgcgaaggaggccgtggaggacgagcggttctgggacctggtccaccgcgagcgggagctccacaagcagggcaagtgcgccacgtgcgtgtacaacatgatggggaagcgcgagaagaagctgggcgagttcgggaaggccaagggcagccgggcgatctggtacatgtggctgggcgcccgcttcctcgagttcgaggccctggggttcatgaacgaggaccactggttctcccgggagaacagcctgtccggcgtggagggggagggcctccacaagctggggtacatcctgcgcgacatcagcaagatcccgggcggcaacatgtacgccgacgacaccgccgggtgggacacccgcatcaccgaggacgacctccagaacgaggcgaagatcacggacatcatggagcccgagcacgccctgctggccacctccatcttcaagctcacctaccagaacaaggtcgtgcgggtgcagcgccccgccaagaacggcaccgtcatggacgtgatcagccggcgcgaccagcgggggtccggccaggtgggcacgtacgggctgaacaccttcaccaacatggaggtccagctgatccgccagatggagagcgagggcatcttcctcccctccgagctggagaccccgaacctggccgagcgggcgctcgactggctggagaagcacggggccgagcgcctgaagcggatggccatcagcggcgacgactgcgtggtgaagcccatcgacgaccgcttcgccacggccctcaccgcgctgaacgacatggggaaggtccggaaggacatcccccagtgggagccctccaagggctggaacgactggcagcaggtcccgttctgcagccaccacttccaccagctgatcatgaaggacggccgcgagatcgtggtcccctgccggaaccaggacgagctcgtggggcgcgcccgggtgtcccagggcgccgggtggagcctgcgcgagaccgcctgcctgggcaagtcctacgcccagatgtggcagctcatgtacttccaccggcgcgacctgcggctggcggccaacgccatctgcagcgccgtccccgtggactgggtgcccgcgagccgcaccacctggtccatccacgcccaccaccagtggatgacgaccgaggacatgctcagcgtctggaaccgcgtgtggatcgaggagaacccgtggatggaggacaagacccacgtgtccagctgggaggaggtcccctacctggggaagcgggaggaccagtggtgcggctccctgatcggcctcaccgcccgcgccacgtgggccaccaacatccaggtggcgatcaaccaggtgcggcgcctgatcgggaacgagaactacctggactacatgaccagcatgaagcggttcaagaacgagtccgaccccgagggcgccctctggtga

SEQ ID NO: 8873 - RNA, 9879 nt, synthetic construct
  misc_feature 1..9879: note = derived and/or modified CDS sequence (opt1) from DENV-1__KC692513__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagacctccgtgggggtgaacatgtgcaccctgatcgcgatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtcggcctggggctcgagacgcgcaccgagacctggatgagctccgagggcgcctggaagcagatccagaaggtggagacctgggccctgcggcacccggggttcacggtgatcgccctgttcctcgcccacgcgatcggcaccagcatcacccagaaggggatcatcttcatcctgctgatgctcgtcaccccctccatggccatgcgctgcgtgggcatcggcaaccgggacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgccgtgctccgcaagctgtgcatcgaggcgaagatcagcaacaccaccacggactcccggtgcccgacccagggcgaggccaccctggtcgaggagcaggacgccaacttcgtgtgccgccggaccttcgtggaccgcggctgggggaacggctgcggcctcttcggcaaggggagcctgctgacgtgcgccaagttcaagtgcgtcaccaagctcgagggcaagatcgtgcagtacgagaacctgaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctcaccctggactgcagcccccggaccggcctggacttcaacgagatggtgctcctgacgatgaaggagaagtcctggctggtgcacaagcagtggttcctcgacctgccgctgccctggacctccggggccagcacgccccaggagacctggaaccgccaggacctcctggtcacgttcaagaccgcccacgccaagaagcaggaggtggtggtcctgggcagccaggagggcgcgatgcacaccgccctcaccggggccacggagatccagacctccggcaccaccacgatcttcgccgggcacctgaagtgccggctgaagatggacaagctcaccctgaagggcatgagctacgtgatgtgcaccgggtccttcaagctggagaaggaggtggccgagacccagcacggcacggtcctggtccaggtgaagtacgagggcaccgacgcgccctgcaagatcccgttcctcacccaggacgagaagggggtcacccagaacggccgcctgatcacggccaaccccatcgtgaccgacaaggagaagcccgtgaacatcgagaccgagcccccgttcggggagagctacatcgtcgtgggcgccggcgagaaggccctgaagctctcctggttcaagaaggggagctccatcggcaagatgttcgaggcgaccgcccgcggggcccgccggatggccatcctgggcgacacggcctgggacttcgggagcatcggcggcctgttcacctccgtggggaagctcatccaccaggtcttcggcaccgcgtacggggtgctgttcagcggcgtgtcctggaccatgaagatcgggatcggcatcctgctcacgtggctgggcctgaacagccgctccaccagcctctccatgacctgcatcgccgtcgggatggtgaccctgtacctgggcgtgatggtccaggccgacagcgggtgcgtgatcaactggaagggccgcgagctcaagtgcgggtccggcatcttcgtgacgaacgaggtccacacctggaccgagcagtacaagttccaggccgacagccccaagcggctgtccgccgcgatcggcaaggcctgggaggagggggtgtgcggcatccgcagcgccacccggctggagaacatcatgtggaagcagatcagcaacgagctcaactacatcctgctggagaacgacatgaagttcaccgtggtcgtgggggacatcaacggcatcctcgcccaggggaagaagatgatccgcccccagcccatggagcacaagtactcctggaagtcctggggcaaggccaagatcatcggcgcggacatccagaacacgaccttcatcatcgacgggccggacacccccgagtgccccgacgaccagcgggcctggaacatctgggaggtggaggactacggcttcgggatcttcaccacgaacatctggctgaagctgcgcgacagccacacccagatgtgcgaccaccggctcatgagcgccgccatcaaggactccaaggcggtccacgccgacatgggctactggatcgagagcgagaagaacgagacctggaagctggcccgcgcctccttcatcgaggtgaagacctgcatctggcccaagagccacacgctgtggtccaacggcgtgctcgagagcgagatggtcatcccgaagatctacgggggccccatctcccagcacaactaccggcccgggtacttcacccagaccgccggcccgtggcacctggggaagctggagctcgacttcgacctgtgcgagggcaccacggtggtggtcgacgagcactgcggctaccgcgggcccagcctgcggaccaccaccgtgacgggcaagatcatccacgagtggtgctgccgctcctgcaccctgccgcccctgcggttccgcggggaggacggctgctggtacgggatggagatccggccggtgaaggagaaggaggagaacctggtccgcagcatggtgtccgcgggcagcggcgaggtggactccttcagcctcgggatcctgtgcgtcagcatcctgatcgaggaggtgatgcggtcccgctggagccggaagatgctcatgaccggcaccctggccgtgttcctgctcctgatcatggggcagctgacgtggaacgacctcatccgcctgtgcatcatggtcggcgccaacgcctccgaccgcatggggatgggcaccacctacctggccctcatggcgaccttcaagatgcggcccatgttcgccgtgggcctgctgttccgccggctcacgagccgcgaggtgctgctgctcaccgtcgggctgtccctggtggccagcgtcgagctccccaactccctggaggagctgggcgacgggctcgccatgggcatcatgatgctgaagctgctcaccgacttccagccccaccagctgtggaccacgctgctcagcctgaccttcatccggacctccctgagcctcgactacgcctggaagaccatggcgatggccctgtccatcgtgagcctgttcccgctctgcctgtccacgaccagccagaagaccacctggctgcccgtgctcctgggctccttcgggtgcaagcccctgacgatgttcctcatcaccgagaacaagatctggggccgcaagagctggcccatcaacgaggggatcatggccgtcggcatcgtgtccatcctgctgagctccctcctgaagaacgacgtgccgctggccgggcccctcatcgcgggcggcatgctgatcgcctgctacgtcatcagcgggagctccgccgacctgagcctcgagaaggccgccgaggtgtcctgggaggaggaggcggagcacagcggcacctcccacaacatcctggtggaggtccaggacgacgggaccatgaagatcaaggacgaggagcgggacgacaccctgacgatcctcctgaaggccaccctgctcgccgtgagcggcgtgtaccccatgtccatccccgccaccctgttcgtctggtacttctggcagaagaagaagcagcgcagcggggtgctgtgggacaccccgagcccgcccgaggtggagcgggccgtcctggacgacggcatctaccgcatcctccagcggggcctgctggggcgcagccaggtgggcgtgggggtcttccaggacggcgtgttccacacgatgtggcacgtgacccgcggggcggtcctcatgtaccagggcaagcgcctggagccctcctgggccagcgtgaagaaggacctgatctcctacggcgggggctggcggttccaggggagctggaacaccggcgaggaggtgcaggtcatcgccgtggagccggggaagaaccccaagaacgtgcagaccacgcccggcaccttcaagacccccgagggcgaggtcggggccatcgccctcgacttcaagccgggcacctccgggagccccatcgtgaaccgcgagggcaagatcgtgggcctgtacgggaacggcgtcgtgacgacctccgggacctacgtgagcgcgatcgcccaggccaaggccacccaggagggccccctgccggagatcgaggacgaggtcttcaagaagcggaacctcacgatcatggacctgcaccccgggtccggcaagacccgccggtacctgcccgccatcgtgcgcgaggcgatcaagcggaagctccgcaccctgatcctggcccccacccgcgtggtcgccagcgagatggccgaggcgctcaagggcatgccgatccggtaccagacgaccgccgtgaagtccgagcacaccgggcgcgagatcgtggacctgatgtgccacgccaccttcacgatgcggctgctctcccccgtccgcgtgcccaactacaacatgatcatcatggacgaggcccacttcaccgaccccgccagcatcgcggcccggggctacatctccacccgcgtggggatgggcgaggccgccgccatcttcatgaccgcgacgccgcccgggagcgtcgaggccttcccccagtccaacgccgtgatccaggacgaggagcgggacatccccgagcgcagctggaactccggctacgactggatcaccgacttcccgggcaagaccgtgtggttcgtccccagcatcaagtccgggaacgacatcgccaactgcctgcggaagaacggcaagcgcgtgatccagctgagccggaagaccttcgacacggagtaccagaagaccaagaacaacgactgggactacgtggtcaccaccgacatctccgagatgggggccaacttccgcgcggaccgggtgatcgacccccgccggtgcctcaagcccgtgatcctgaaggagggcccggagcgcgtcatcctggccgggcccatgcccgtgacggtcgccagcgccgcgcagcggcgcggccggatcggccgcaaccagaacaaggagggggaccagtacatctacatgggccagcccctcaacaacgacgaggaccacgcccactggaccgaggccaagatgctgctggacaacatcaacaccccggaggggatcatccccgccctcttcgagcccgagcgcgagaagtccgccgcgatcgacggcgagtaccggctgcgcggggaggcccggaagaccttcgtggagctgatgcgccggggcgacctccccgtgtggctgagctacaaggtcgcctccgagggcttccagtacagcgaccgccggtggtgcttcgacggggagcgcaacaaccaggtgctggaggagaacatggacgtggagatctggacgaaggagggcgagcggaagaagctccgcccgcggtggctggacgcccgcacctactccgaccccctggccctccgggagttcaaggagttcgcggccgggcgccggagcgtctccggcgacctgatcctggagatcggcaagctcccccagcacctgaccctgcgcgcccagaacgccctcgacaacctggtgatgctgcacaacagcgagcagggcgggaaggcctaccggcacgcgatggaggagctccccgacaccatcgagaccctgatgctgctcgccctgatcgccgtgctgaccggcggggtcaccctcttcttcctgagcgggaaggggctgggcaagacctccatcgggctcctgtgcgtgatggccagctccgcgctgctctggatggccagcgtggagccgcactggatcgccgcctccatcatcctggagttcttcctgatggtcctcctgatccccgagcccgaccgccagcggaccccgcaggacaaccagctggcctacgtggtgatcggcctcctgttcatgatcctgacggtcgcggccaacgagatggggctcctggagaccaccaagaaggacctgggcatcgggcacgtggccgtggagaaccaccaccacgccaccatgctcgacgtcgacctgcgccccgccagcgcgtggacgctgtacgccgtggccaccaccgtgatcacccccatgatgcggcacacgatcgagaacaccaccgccaacatctccctcaccgccatcgcgaaccaggccgccatcctgatgggcctggacaagggctggcccatcagcaagatggacatcggggtcccgctcctggccctgggctgctactcccaggtgaaccccctcacgctgaccgccgcggtgctgatgctcgtcgcccactacgccatcatcgggcccggcctgcaggccaaggcgacccgcgaggcccagaagcgcaccgccgccgggatcatgaagaaccccacggtggacggcatcgtgaccatcgacctggacccggtcgtgtacgacgccaagttcgagaagcagctcggccagatcatgctgctgatcctctgcaccagccagatcctgctgatgcggaccacgtgggcgctctgcgagtccatcaccctggccaccgggcccctgaccacgctctgggagggcagccccgggaagttctggaacaccaccatcgccgtgtccatggccaacatcttccgcggcagctacctggccggcgcggggctggccttctccctcatgaagtccctgggcgggggccggcgcgggaccggcgcccagggcgagacgctgggggagaagtggaagcggcagctcaaccagctgtccaagagcgagttcaacacctacaagaagtccggcatcatggaggtcgaccgcagcgaggccaaggaggggctgaagcggggcgagaccaccaagcacgccgtgagccgcgggacggcgaagctgcggtggttcgtggagcgcaacctcgtcaagcccgagggcaaggtgatcgacctgggctgcgggcggggcgggtggtcctactactgcgccggcctgaagaaggtgaccgaggtcaaggggtacaccaagggcggcccggggcacgaggagcccatccccatggccacctacggctggaacctcgtgaagctgcacagcgggaaggacgtgttcttcacgccgcccgagaagtgcgacacgctgctctgcgacatcggcgagtccagccccaaccccaccatcgaggaggggcgcaccctgcgggtcctgaagatggtggagccctggctccgcggcaaccagttctgcatcaagatcctgaacccctacatgccctccgtggtcgagaccctggagcagatgcagcggaagcacggcgggatgctcgtgcgcaaccccctgagccggaactccacgcacgagatgtactgggtgagctgcggcaccgggaacatcgtctccgccgtgaacatgaccagccgcatgctgctcaaccggttcaccatggcgcaccgcaagcccacgtacgagcgcgacgtggacctgggcgccggcacccggcacgtcgccgtggagccggaggtggccaacctggacatcatcgggcagcgcatcgagaacatcaagaacgagcacaagtccacctggcactacgacgaggacaacccctacaagacctgggcctaccacggcagctacgaggtcaagccctccgggagcgcgtccagcatggtgaacggcgtcgtgcggctcctgacgaagccctgggacgtgatcccgatggtcacccagatcgccatgaccgacaccacgcccttcgggcagcagcgcgtgttcaaggagaaggtggacacccggacgccccgggccaagcggggcaccgcccagatcatggaggtcacggccaagtggctgtggggcttcctctcccgcaacaagaagccgcggatctgcacccgcgaggagttcacccggaaggtgcgcagcaacgcggccatcggggccgtgttcgtcgacgagaaccagtggaactccgccaaggaggccgtggaggacgagcggttctgggacctggtgcaccgcgagcgggagctgcacaagcagggcaagtgcgcgacctgcgtctacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttcagccgggagaactccctgagcggcgtggagggggagggcctgcacaagctcgggtacatcctgcgcgacatctccaagatccccggcggcaacatgtacgccgacgacacggccgggtgggacacccggatcaccgaggacgacctgcagaacgaggccaagatcaccgacatcatggagcccgagcacgccctcctggcgacgagcatcttcaagctgacctaccagaacaaggtggtccgcgtgcagcgccccgccaagtccggcaccgtgatggacgtcatcagccggcgcgaccagcgggggtccggccaggtgggcacctacgggctcaacacgttcaccaacatggaggtgcagctgatccgccagatggagagcgagggcatcttctccccgagcgagctggagacccccaacctcgccaagaaggtcctggactggctggagaagcacggggccgagcggctcaagcgcatggccatctccggcgacgactgcgtggtgaagcccatcgacgaccggttcgcgaccgccctgacggccctgaacgacatggggaaggtccgcaaggacatcccccagtgggagccgagcaagggctggaacgactggcagcaggtccccttctgctcccaccacttccaccagctcatcatgaaggacggccgggagatcgtggtcccctgccgcaaccaggacgagctggtggggcgggcccgcgtgagccagggcgccgggtggtccctgcgggagaccgcgtgcctcggcaagagctacgcccagatgtggcagctgatgtacttccaccgccgggacctgcgcctcgccgccaacgccatctgctccgcggtccccgtggactgggtgccgaccagccggaccacctggagcatccacgcccaccaccagtggatgacgaccgaggacatgctgtccgtctggaaccgcgtgtggatcgaggagaacccctggatggaggacaagacccacgtgagctcctgggaggaggtcccctacctggggaagcgggaggaccagtggtgcggcagcctcatcggcctgaccgcccgcgccacgtgggcgaccaacatccaggtggccatcaaccaggtgcgccggctgatcgggtccgagaactacctcgactacatgaccagcatgaagcgcttcaagaacgagtccgaccccgagggcgccctgtggtga

SEQ ID NO: 8874 - RNA, 9879 nt, synthetic construct
  misc_feature 1..9879: note = derived and/or modified CDS sequence (opt1) from DENV-1__KC692514__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacccgcaccgagacctggatgagctccgagggcgcctggcggcagatccagcgcgtcgagacctgggccctgcggcaccccgggttcacggtgatcgccttcttcctggcgcacgccatcggcaccagcatcacccagaaggggatcatcttcatcctcctgatgctggtgaccccctccatggccatgcgctgcgtcggcatcggcaaccgggacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcgcaagctctgcatcgaggccaagatcagcaacaccaccacggactcccggtgcccgacccagggcgaggccaccctggtggaggagcaggacgccaacttcgtctgccgccggaccttcgtggaccgcggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccgccaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccggctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccgcctgatcacggccaacccgatcgtcaccgacaaggagaagcccgtgaacatcgagaccgagccgcccttcggggagagctacatcgtggtcggcgccggcgagaaggcgctcaagctgtcctggttcaagcgggggagctccatcggcaagatgttcgaggccaccgcccgcggggcccgccggatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccgctccaccagcctctccatgacctgcatcgccgtggggatggtgaccctgtacctgggcgtcatggtgcaggccgacagcgggtgcgtgatcaactggaagggccgggagctcaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctggagaacatcatgtggaagcagatcagcaacgagctcaaccacatcctgctggagaacgacatgaagttcaccgtcgtggtgggggacgccaacggcatcctcgcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcgtgttcaccacgaacatctggctgaagctgcgggactcctacacccagatgtgcgaccaccgcctcatgagcgcggccatcaaggactccaaggccgtgcacgccgacatgggctactggatcgagagcgagaagaacgagacctggaagctggcccgggcgtccttcatcgaggtcaagacctgcacgtggcccaagagccacaccctgtggtccaacggggtgctcgagagcgagatgatcatccccaagatcttcggcgggccgatctcccagcacaactaccgccccggctacttcacccagaccgccgggccctggcacctgggcaagctggagctcgacttcgacctgtgcgagggcacgaccgtggtcgtggacgagcactgcgggaaccggggcccgagcctgcgcaccaccacggtgaccgggaagatcatccacgagtggtgctgccggtcctgcaccctgccgcccctgcgcttccggggcgaggacgggtgctggtacggcatggagatccgccccgtcaaggagaaggaggagaacctggtgcggagcatggtgtccgccggcagcggggaggtcgacagcttctccctcggcatcctgtgcgtgagcatcatgatcgaggaggtgatgcgctcccgctggagccggaagatgctgatgaccgggacgctcgccgtcttcctgctgctcatcatgggccagctgacctggaacgacctgatccgcctctgcatcatggtgggggccaacgcgtccgaccggatgggcatgggcaccacctacctggccctgatggccacgttcaagatgcgcccgatgttcgccgtggggctcctgttccggcgcctgaccagccgggaggtcctcctgctgaccatcggcctctccctggtggccagcgtcgagctgcccaactccctcgaggagctgggggacggcctggcgatgggcatcatgatgctcaagctgctgaccgagttccagccccaccagctctggacgaccctgctgagcctcaccttcgtgaagaccacgctgtccctggactacgcctggaagaccaccgccatggtgctcagcatcgtctccctgttccccctgtgcctcagcaccacgtcccagaagaccacctggctgccggtgctgctcgggagcttcggctgcaagcccctgaccatgttcctgatcaccgagaacaagatctgggggcgcaagtcctggcccctcaacgagggcatcatggccatcgggatcgtgagcatcctgctgtccagcctcctgaagaacgacgtccccctggcgggcccgctcatcgccggcgggatgctgatcgcctgctacgtgatcagcggctccagcgccgacctgtccctcgagaaggccgcggaggtgagctgggagcaggaggccgagcactccggggccagccacaacatcctggtcgaggtgcaggacgacggcacgatgaagatcaaggacgaggagcgggacgacaccctgaccatcctcctgaaggccaccctgctcgccgtgtccggggtctaccccatgagcatccccgcgacgctgttcgtgtggtacttctggcagaagaagaagcagcgctccggcgtgctgtgggacacccccagcccgcccgaggtcgagcgggccgtgctcgacgacggcatctaccgcatcctgcagcgggggctgctgggccgctcccaggtgggggtcggcgtgttccaggacggggtgttccacaccatgtggcacgtcacccggggcgccgtgctcatgtaccagggcaagcgcctggagcccagctgggcctccgtgaagaaggacctgatcagctacgggggcgggtggcggttccagggctcctggaacacgggggaggaggtccaggtgatcgccgtggagcccggcaagaacccgaagaacgtccagaccacccccggcaccttcaagacgcccgagggggaggtgggcgcgatcgccctcgacttcaagcccgggaccagcggctccccgatcgtgaaccgcgagggcaagatcgtcgggctgtacggcaacggggtggtgaccaccagcggcacgtacgtctccgccatcgcccaggccaagaccagccaggaggggcccctgcccgagatcgaggacgaggtgttcaagaagcggaacctcaccatcatggacctgcacccgggcagcggcaagacccgccggtacctgcccgcgatcgtgcgcgaggccatcaagcgcaagctccggacgctgatcctggcccccacccgcgtcgtggcctccgagatggcggaggccctcaaggggatgcccatccggtaccagaccaccgccgtcaagagcgagcacacgggccgcgagatcgtcgacctgatgtgccacgccaccttcaccatgcggctgctctccccggtgcgcgtgcccaactacaacatgatcatcatggacgaggcccacttcaccgaccccgcgagcatcgccgcccgggggtacatctccacgcgcgtcggcatgggggaggccgccgcgatcttcatgaccgccacgccgcccggcagcgtggaggccttcccccagtccaacgccgtgatccaggacgaggagcgggacatccccgagcgcagctggaactccggctacgactggatcaccgacttccccgggaagacggtctggttcgtgcccagcatcaagtccggcaacgacatcgccaactgcctgcggaagaacgggaagcgcgtgatccagctgagccggaagaccttcgacaccgagtaccagaagaccaagaacaacgactgggactacgtcgtgacgaccgacatctccgagatgggcgcgaacttccgcgccgaccgggtgatcgacccccgccggtgcctcaagcccgtcatcctgaaggacgggcccgagcgcgtgatcctggccggcccgatgcccgtcaccgtggccagcgcggcccagcggcgcggccgcatcgggcggaaccagaacaaggagggcgaccagtacgtgtacatggggcagcccctcaacaacgacgaggaccacgcccactggaccgaggccaagatgctgctggacaacatcaacacgcccgagggcatcatcccggccctcttcgagcccgagcgcgagaagtccgcggccatcgacggggagtaccggctgcgcggcgaggcccggaagaccttcgtcgagctgatgcgccggggcgacctccccgtgtggctgagctacaaggtggcctccgaggggttccagtacagcgaccgccggtggtgcttcgacggcgagcgcaacaaccaggtcctggaggagaacatggacgtggagatctggaccaaggagggggagcggaagaagctccgcccccggtggctggacgcccgcacctactccgacccgctggcgctccgggagttcaaggagttcgccgccggccgccggagcgtgagcggcgacctgatcctggagatcgggaagctcccccagcacctgaccctgcgcgcccagaacgccctcgacaacctggtcatgctgcacaactccgagcagggcgggaaggcgtaccggcacgccatggaggagctccccgacacgatcgagaccctgatgctgctcgccctgatcgccgtgctgaccggcggggtgaccctcttcttcctgagcggcaagggcctggggaagacgtccatcggcctcctgtgcgtcaccgcgagctccgccctgctctggatggccagcgtggagccccactggatcgccgcctccatcatcctggagttcttcctgatggtgctcctgatcccggagcccgaccgccagcggacgccccaggacaaccagctggcgtacgtcgtgatcgggctcctgttcatgatcctgaccgtggccgccaacgagatgggcctcctggagacgaccaagaaggacctggggatcggctacgtcgccgccgagaaccaccagcacgcgaccatgctcgacgtggacctgcacccggccagcgcctggaccctgtacgccgtggccacgaccgtcatcacccccatgatgcgccacaccatcgagaacacgaccgcgaacatctccctcaccgccatcgccaaccaggccgccatcctgatgggcctggacaaggggtggcccatcagcaagatggacatcggcgtgcccctcctggcgctggggtgctactcccaggtgaacccgctcaccctgacggccgccgtcctgatgctcgtggcccactacgcgatcatcggccccgggctgcaggccaaggccacccgcgaggcccagaagcggaccgccgcgggcatcatgaagaaccccaccgtggacggcatcgtcgccatcgacctggaccccgtggtgtacgacgccaagttcgagaagcagctcgggcagatcatgctgctgatcctctgcacgagccagatcctgctgatgcgcaccacctgggccctctgcgagtccatcaccctggccacgggcccgctgaccaccctctgggaggggagccccggcaagttctggaacaccacgatcgcggtctccatggccaacatcttccggggcagctacctggccggggccggcctggccttctccctcatgaagtccctcgggggcgggcgccgggggaccggcgcgcagggggagaccctgggcgagaagtggaagcgccagctcaaccagctgtccaagagcgagttcaacacctacaagcggagcgggatcatggaggtggaccgctccgaggccaaggagggcctgaagcgcggggagacgaccaagcacgccgtgagccgcggcaccgccaagctccggtggttcgtcgagcgcaacctggtgaagcccgagggcaaggtgatcgacctggggtgcggccgcgggggctggtcctactactgcgcggggctgaagaaggtcaccgaggtgaagggctacaccaagggcgggcccggccacgaggagccgatccccatggccacgtacgggtggaacctcgtgaagctgcacagcggcaaggacgtcttcttcatgccgcccgagaagtgcgacaccctgctctgcgacatcggggagtccagcccgaaccccaccatcgaggagggccgcaccctgcgggtgctgaagatggtggagccctggctccgcggcaaccagttctgcatcaagatcctgaacccctacatgccgtccgtcgtggagacgctggagcagatgcagcggaagcacgggggcatgctcgtgcgcaaccccctgagccggaactccacccacgagatgtactgggtcagctgcgggaccggcaacatcgtgtccgccgtgaacatgaccagccgcatgctgctcaaccgcttcacgatggcccaccggaagcccacctacgagcgcgacgtcgacctgggcgccgggacccggcacgtggcggtggagcccgaggtcgccaacctggacatcatcggccagcgcatcgagaacatcaagaacgagcacaagtccacctggcactacgacgaggacaacccgtacaagacgtgggcctaccacgggagctacgaggtgaagccctccggcagcgcctccagcatggtcaacggggtggtgcggctcctgaccaagccctgggacgtcatccccatggtgacccagatcgccatgaccgacacgaccccgttcggccagcagcgcgtgttcaaggagaaggtcgacacccggacgccccgggcgaagcggggcacgacccagatcatggaggtgaccgccaagtggctgtgggggttcctctcccgcaacaagaagccccggatctgcacccgcgaggagttcacgcggaaggtgcgcagcaacgccgccatcggcgccgtcttcgtggacgagaaccagtggaacagcgcgaaggaggccgtggaggacgagcggttctgggacctggtccaccgcgagcgggagctgcacaagcaggggaagtgcgcgacctgcgtgtacaacatgatgggcaagcgcgagaagaagctcggggagttcggcaaggccaagggctcccgggcgatctggtacatgtggctgggggcccgcttcctggagttcgaggccctcggcttcatgaacgaggaccactggttcagccgggagaactccctgagcggggtggagggcgaggggctgcacaagctcggctacatcctgcgcgacatctccaagatcccgggcgggaacatgtacgccgacgacaccgccggctgggacacccgcatcacggaggacgacctgcagaacgaggcgaagatcaccgacatcatggagcccgagcacgccctcctggccaccagcatcttcaagctgacctaccagaacaaggtcgtgcgggtgcagcgccccgccaagaacgggacggtcatggacgtgatctcccggcgcgaccagcggggcagcggccaggtggggacctacggcctcaacaccttcaccaacatggaggtccagctgatccgccagatggagtccgaggggatcttcctgcccagcgagctcgagacgccgaacctggccgagcgggcgctggactggctcgagaagcacggcgccgagcgcctgaagcggatggccatctccggggacgactgcgtggtgaagcccatcgacgaccgcttcgccaccgccctgaccgcgctcaacgacatgggcaaggtccggaaggacatcccccagtgggagcccagcaagggctggaacgactggcagcaggtcccgttctgctcccaccacttccaccagctgatcatgaaggacgggcgcgagatcgtggtcccctgccggaaccaggacgagctggtgggccgcgcccgggtgagccagggggccggctggtccctccgcgagaccgcctgcctgggcaagagctacgcccagatgtggcagctgatgtacttccaccggcgcgacctccggctggcggccaacgccatctgctccgccgtccccgtggactgggtgcccgcgagccgcaccacgtggagcatccacgcccaccaccagtggatgaccaccgaggacatgctgtccgtctggaaccgcgtgtggatcgaggagaacccgtggatggaggacaagacccacgtgagctcctgggaggaggtcccctacctcggcaagcgggaggaccagtggtgcggcagcctgatcgggctgacggcccgcgccacctgggccaccaacatccaggtggcgatcaaccaggtgcggcgcctcatcggcaacgagaactacctggactacatgacctccatgaagcggttcaagaacgagagcgaccccgagggggccctgtggtga

SEQ ID NO: 8875 - RNA, 9879 nt, synthetic construct
  misc_feature 1..9879: note = derived and/or modified CDS sequence (opt1) from DENV-1__KC692515__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagacctccgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgggaaggcgctgaagctgtcctggttcaagcgcggcagctccatcgggaagatgttcgaggccaccgcccggggcgcccgccgcatggccatcctcggggacacggcgtgggacttcggcagcatcggcggggtgttcacctccgtgggcaagctggtccaccaggtgttcgggaccgcctacggcgtgctgttcagcggggtctcctggaccatgaagatcggcatcggcatcctcctgacgtggctggggctcaacagccggtccaccagcctgtccatgacctgcatcgccgtgggcatggtgaccctgtacctcggggtcatggtgcaggccgacagcggctgcgtgatcaactggaaggggcgcgagctgaagtgcggctccggcatcttcgtcacgaacgaggtgcacacctggaccgagcagtacaagttccaggccgacagcccgaagcggctgagcgcggccatcgggaaggcctgggaggagggcgtgtgcgggatccgctccgccacccggctcgagaacatcatgtggaagcagatcagcaacgagctgaaccacatcctgctcgagaacgacatgaagttcaccgtcgtggtgggcgacgccaacgggatcctggcgcagggcaagaagatgatccgcccccagcccatggagcacaagtactcctggaagtcctggggcaaggccaagatcatcggggccgacatccagaacacgaccttcatcatcgacggccccgacaccccggagtgccccgacgggcagcgggcctggaacatctgggaggtcgaggactacggcttcggcgtgttcaccacgaacatctggctgaagctccgcgactcctacacccagatgtgcgaccaccggctgatgagcgcggccatcaaggactccaaggccgtgcacgccgacatggggtactggatcgagagcgagaagaacgagacctggaagctggcccgcgcgtccttcatcgaggtcaagacctgcacgtggcccaagagccacaccctctggtccaacggcgtgctggagagcgagatgatcatccccaagatcttcgggggcccgatctcccagcacaactaccggcccgggtacttcacccagaccgccggcccctggcacctgggcaagctcgagctggacttcgacctgtgcgaggggacgaccgtggtcgtggacgagcactgcggcaaccgcgggccgagcctccggaccaccacggtgaccggcaagatcatccacgagtggtgctgccgctcctgcaccctgccgcccctgcggttccgcggggaggacggctgctggtacggcatggagatccggcccgtcaaggagaaggaggagaacctcgtgcgcagcatggtgtccgccgggagcggcgaggtcgacagcttctccctggggatcctgtgcgtgagcatcatgatcgaggaggtgatgcggtcccgctggagccgcaagatgctcatgaccggcacgctggccgtcttcctgctcctgatcatggggcagctgacctggaacgacctcatccggctgtgcatcatggtgggcgccaacgcgtccgaccgcatgggcatggggaccacctacctggccctcatggccacgttcaagatgcggccgatgttcgccgtgggcctgctgttccgccggctcaccagccgcgaggtcctgctgctcaccatcgggctgtccctggtggccagcgtcgagctccccaactccctggaggagctgggcgacggcctcgcgatggggatcatgatgctgaagctgctcaccgagttccagccccaccagctgtggacgaccctgctcagcctgaccttcgtgaagaccacgctgtccctcgactacgcctggaagaccaccgccatggtgctgagcatcgtctccctgttccccctctgcctgagcaccacgtcccagaagaccacctggctgccggtgctcctgggcagcttcgggtgcaagcccctgaccatgttcctcatcaccgagaacaagatctggggccggaagtcctggcccctgaacgaggggatcatggccatcggcatcgtgagcatcctgctctccagcctgctgaagaacgacgtccccctcgcgggcccgctgatcgccgggggcatgctgatcgcctgctacgtgatcagcgggtccagcgccgacctctccctggagaaggccgcggaggtgagctgggagcaggaggccgagcactccggcgccagccacaacatcctggtcgaggtgcaggacgacgggacgatgaagatcaaggacgaggagcgcgacgacaccctcaccatcctgctgaaggccaccctcctggccgtgtccggcgtctaccccatgagcatccccgcgacgctgttcgtgtggtacttctggcagaagaagaagcagcggtccggcgtgctctgggacacccccagcccgcccgaggtcgagcgcgccgtgctggacgacgggatctaccggatcctgcagcgcggcctgctcgggcggtcccaggtgggcgtcggggtgttccaggacggcgtgttccacaccatgtggcacgtcacccgcggcgccgtgctgatgtaccaggggaagcggctggagcccagctgggcctccgtgaagaaggacctcatcagctacggcgggggctggcgcttccaggggtcctggaacacgggcgaggaggtccaggtgatcgccgtggagcccggcaagaacccgaagaacgtccagaccacccccgggaccttcaagacgcccgagggcgaggtgggggcgatcgccctggacttcaagcccggcaccagcggctccccgatcgtgaaccgggaggagaagatcgtcgggctgtacggcaacggggtggtgaccaccagcggcacgtacgtctccgccatcgcccaggccaaggcgagccaggaggggcccctccccgagatcgaggacgaggtgttcaagaagcgcaacctgaccatcatggacctgcacccgggcagcggcaagacccggcgctacctccccgccatcgtgcgggaggccatcaagcgcaagctgcgcaccctgatcctcgcccccacgcgggtcgtggcgtccgagatggccgaggccctgaaggggatgcccatccgctaccagaccaccgccgtcaagagcgagcacaccggccgggagatcgtcgacctgatgtgccacgccacgttcaccatgcgcctcctgtccccggtgcgggtgcccaactacaacatgatcatcatggacgaggcgcacttcaccgaccccgccagcatcgccgcccgcgggtacatctccacccgggtcggcatgggggaggccgcggccatcttcatgacggccacgccgcccggcagcgtggaggccttcccccagtccaacgccgtgatccaggacgaggagcgcgacatccccgagcggagctggaactccggctacgactggatcaccgacttccccgggaagaccgtctggttcgtgcccagcatcaagtccggcaacgacatcgcgaactgcctgcgcaagaacgggaagcgggtgatccagctcagccgcaagacgttcgacaccgagtaccagaagaccaagaacaacgactgggactacgtcgtgaccacggacatctccgagatgggcgccaacttccgggccgaccgcgtgatcgacccccggcgctgcctgaagcccgtcatcctgaaggacgggcccgagcgggtgatcctcgccggcccgatgcccgtcaccgtggcgagcgccgcccagcgccggggccgcatcgggcgcaaccagaacaaggagggcgaccagtacgtgtacatggggcagcccctgaacaacgacgaggaccacgcccactggaccgaggccaagatgctgctcgacaacatcaacacccccgagggcatcatcccggcgctgttcgagcccgagcgggagaagtccgccgccatcgacggggagtaccgcctgcggggcgaggcccgcaagacgttcgtcgagctcatgcggcgcggcgacctgcccgtgtggctgagctacaaggtggcctccgaggggttccagtacagcgaccggcgctggtgcttcgacggcgagcggaacaaccaggtcctcgaggagaacatggacgtggagatctggaccaaggagggggagcgcaagaagctgcggccccgctggctggacgcgcggacctactccgacccgctcgccctgcgcgagttcaaggagttcgccgccggccggcgcagcgtgagcggcgacctgatcctcgagatcgggaagctgccccagcacctgaccctccgggcccagaacgcgctggacaacctggtcatgctccacaactccgagcagggcgggaaggcctaccgccacgccatggaggagctgcccgacaccatcgagacgctgatgctcctggccctgatcgcggtgctcaccggcggggtgaccctgttcttcctgagcggcaagggcctcgggaagacctccatcggcctgctgtgcgtcacggccagctccgccctcctgtggatggccagcgtggagccccactggatcgccgcgtccatcatcctggagttcttcctcatggtgctgctgatcccggagcccgaccggcagcgcacgccccaggacaaccagctcgcctacgtcgtgatcgggctgctgttcatgatcctcaccgtggccgccaacgagatgggcctgctggagaccacgaagaaggacctcgggatcggccacgtcgccgcggagaaccaccagcacagcaccatgctggacgtggacctgcacccggcctccgcctggaccctctacgccgtggccaccacggtcatcacccccatgatgcggcacaccatcgagaacaccacggcgaacatcagcctgaccgccatcgccaaccaggccgccatcctgatgggcctcgacaaggggtggcccatctccaagatggacatcggcgtgcccctgctggcgctcgggtgctacagccaggtgaacccgctgaccctgaccgccgccgtcctcatgctggtggcccactacgcgatcatcggccccgggctgcaggccaaggccacgcgcgaggcccagaagcgcaccgccgcgggcatcatgaagaaccccaccgtggacggcatcgtcgccatcgacctcgaccccgtggtgtacgacgccaagttcgagaagcagctggggcagatcatgctgctcatcctgtgcacctcccagatcctgctcatgcggacgacctgggccctgtgcgagagcatcaccctggccaccggcccgctcacgaccctgtgggaggggtcccccggcaagttctggaacaccaccatcgcggtcagcatggccaacatcttccgcggctcctacctggccggggccggcctcgccttcagcctgatgaagtccctcgggggcgggcggcgcgggacgggcgcgcagggggagaccctcggcgagaagtggaagcggcagctgaaccagctgagcaagagcgagttcaacacctacaagcgctccgggatcatggaggtggaccggagcgaggccaaggagggcctcaagcgcggggagaccacgaagcacgccgtgtcccggggcaccgccaagctgcgctggttcgtcgagcggaacctggtgaagcccgagggcaaggtgatcgacctggggtgcggccgcgggggctggagctactactgcgcggggctcaagaaggtcaccgaggtgaagggctacaccaagggcgggcccggccacgaggagccgatccccatggccacctacgggtggaacctggtgaagctgcactccggcaaggacgtcttcttcatgccgcccgagaagtgcgacacgctcctgtgcgacatcggggagagctccccgaaccccaccatcgaggagggccggaccctgcgcgtgctcaagatggtggagccctggctgcggggcaaccagttctgcatcaagatcctgaacccctacatgccgagcgtcgtggagaccctcgagcagatgcagcgcaagcacgggggcatgctggtgcggaaccccctgtcccgcaacagcacgcacgagatgtactgggtctcctgcgggaccggcaacatcgtgagcgccgtgaacatgacctcccggatgctcctgaaccgcttcaccatggcccaccgcaagcccacgtacgagcgggacgtcgacctgggcgccgggacccgccacgtggcggtggagcccgaggtcgccaacctcgacatcatcggccagcggatcgagaacatcaagaacgagcaccgcagcacctggcactacgacgaggacaacccgtacaagacctgggcctaccacgggtcctacgaggtgaagcccagcggctccgccagctccatggtcaacggggtggtgcggctgctgacgaagccctgggacgtcatccccatggtgacccagatcgccatgaccgacaccacgccgttcggccagcagcgcgtgttcaaggagaaggtcgacacccggacgccccgcgcgaagcggggcaccacgcagatcatggaggtgaccgccaagtggctctgggggttcctgagccgcaacaagaagccccggatctgcacccgcgaggagttcacccggaaggtgcgcagcaacgccgccatcggcgccgtcttcgtggacgagaaccagtggaactccgcgaaggaggccgtggaggacgagcggttctgggacctggtccaccgcgagcgggagctccacaagcaggggaagtgcgccacgtgcgtgtacaacatgatgggcaagcgcgagaagaagctgggggagttcggcaaggccaagggcagccgggcgatctggtacatgtggctgggggcccgcttcctcgagttcgaggccctgggcttcatgaacgaggaccactggttctcccgggagaacagcctgtccggggtggagggcgaggggctccacaagctgggctacatcctgcgcgacatcagcaagatcccgggcgggaacatgtacgccgacgacaccgccggctgggacacccgcatcaccgaggacgacctccagaacgaggcgaagatcacggacatcatggagcccgagcacgccctgctggccacctccatcttcaagctcacctaccagaacaaggtcgtgcgggtgcagcgccccgccaagaacgggaccgtcatggacgtgatcagccggcgcgaccagcggggctccggccaggtggggacgtacggcctgaacaccttcaccaacatggaggtccagctgatccgccagatggagagcgaggggatcttcctcccctccgagctggagaccccgaacctggccgagcgggcgctcgactggctggagaagcacggcgccgagcgcctgaagcggatggccatcagcggggacgactgcgtggtgaagcccatcgacgaccgcttcgccacggccctcaccgcgctgaacgacatgggcaaggtccggaaggacatcccccagtgggagccctccaagggctggaacgactggcagcaggtcccgttctgcagccaccacttccaccagctgatcatgaaggacgggcgcgagatcgtggtcccctgccggaaccaggacgagctcgtgggccgcgcccgggtgtcccagggggccggctggagcctgcgcgagaccgcctgcctggggaagtcctacgcccagatgtggcagctcatgtacttccaccggcgcgacctgcggctggcggccaacgccatctgcagcgccgtccccgtggactgggtgcccgcgagccgcaccacctggtccatccacgcccaccaccagtggatgacgaccgaggacatgctcagcgtctggaaccgcgtgtggatcgaggagaacccgtggatggaggacaagacccacgtgtccagctgggaggaggtcccctacctgggcaagcgggaggaccagtggtgcggctccctgatcgggctcaccgcccgcgccacgtgggccaccaacatccaggtggcgatcaaccaggtgcggcgcctgatcggcaacgagaactacctggactacatgaccagcatgaagcggttcaagaacgagtccgaccccgagggggccctctggtga

SEQ ID NO: 8876 - RNA, 9879 nt, synthetic construct
  misc_feature 1..9879: note = derived and/or modified CDS sequence (opt1) from DENV-1__KC692516__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccaccgcccgcggggcccgccgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccggtccaccagcctctccatgacctgcatcgccgtggggatggtgaccctgtacctgggcgtcatggtgcaggccgacagcgggtgcgtgatcaactggaagggccgcgagctcaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtcgtggtgggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtcgaggactacgggttcggcatcttcaccacgaacatctggctgaagctgcgcgactcctacacccagatgtgcgaccaccggctcatgagcgcggccatcaaggactccaaggccgtgcacgccgacatgggctactggatcgagagcgagaagaacgagacctggaagctggcccgcgcgtccttcatcgaggtgaagacctgcacgtggcccaagagccacaccctgtggtccaacggggtcctcgagagcgagatgatcatccccaagatctacggcgggccgatctcccagcacaactaccggcccggctacttcacccagaccgccgggccctggcacctgggcaagctggagctcgacttcgacctgtgcgagggcacgaccgtggtggtcgacgagcactgcgggaaccgcggcccgagcctgcggaccaccacggtgaccgggaagatcatccacgagtggtgctgccgctcctgcaccctgccgcccctgcggttccgcggcgaggacgggtgctggtacggcatggagatccggcccgtgaaggagaaggaggagaacctggtccgcagcatggtgtccgccggcagcggggaggtggacaacttcagcctcggcatcctgtgcgtctccatcatgatcgaggaggtgatgcggagccgctggtcccgcaagatgctgatgaccgggacgctcgccgtgttcctgctgctcatcatgggccagctgacctggaacgacctgatccggctctgcatcatggtcggggccaacgcgagcgaccgcatgggcatgggcaccacctacctggccctgatggccacgttcaagatgcggccgatgttcgccgtggggctcctgttccgccggctgacctcccgcgaggtgctcctgctgaccatcggcctcagcctggtcgcctccctggagctccccaacagcctggaggagctgggggacggcctcgcgatgggcatcatgatgctgaagctgctcaccgagttccagccccaccagctgtggacgaccctgctctccctgaccttcgtgaagaccacgctgagcctcgactacgcctggaagaccaccgccatggtcctgtccatcgtgagcctgttccccctctgcctgtccaccacgagccagaagaccacctggctgccggtgctcctggggtccttcggctgcaagcccctgaccatgttcctcatcaccgagaacaagatctgggggcgcaagagctggcccctgaacgagggcatcatggccatcgggatcgtctccatcctgctcagctccctgctgaagaacgacgtgcccctcgcgggcccgctgatcgccggcgggatgctgatcgcctgctacgtgatcagcggcagctccgccgacctcagcctggagaaggccgcggaggtctcctgggagcaggaggccgagcacagcggggcctcccacaacatcctggtggaggtgcaggacgacggcacgatgaagatcaaggacgaggagcgcgacgacaccctcaccatcctgctgaaggccaccctcctggccgtcagcggggtgtaccccatgtccatccccgcgacgctgttcgtgtggtacttctggcagaagaagaagcagcggagcggcgtcctctgggacaccccctccccgcccgaggtggagcgcgccgtgctggacgacggcatctaccggatcctgcagcgcgggctgctcggccggagccaggtcggggtgggcgtgttccaggacggggtcttccacaccatgtggcacgtgacccgcggcgccgtgctgatgtaccagggcaagcggctggagccctcctgggcctgcgtcaagaaggacctcatcagctacgggggcgggtggcgcttccagggcctgtggaacacgggggaggaggtccaggtgatcgccgtcgagcccggcaagaacccgaagaacgtgcagaccacccccggcaccttcaagacgcccgagggggaggtgggcgcgatcgccctggacttcaagcccgggacctccggcagcccgatcgtcaaccgggagggcaagatcgtggggctctacggcaacggggtggtcaccacctccggcacgtacgtgagcgccatcgcccaggccaaggcgtcccaggaggggcccctgcccgagatcgaggacgaggtgttcaagaagcgcaacctgaccatcatggacctccacccgggcagcggcaagacccggcgctacctgcccgccatcgtccgggaggccatcaagcgcaagctgcgcaccctcatcctggcccccacgcgggtggtggcgtccgagatggccgaggccctgaaggggatgcccatccgctaccagaccaccgccgtcaagagcgagcacaccggccgggagatcgtggacctcatgtgccacgccacgttcaccatgcgcctgctgagcccggtgcgggtccccaactacaacatgatcatcatggacgaggcgcacttcaccgaccccgcctccatcgccgcccgcgggtacatcagcacccgggtgggcatgggggaggccgcggccatcttcatgacggccacgccgcccggctccgtggaggccttcccccagagcaacgccgtcatccaggacgaggagcgcgacatccccgagcggtcctggaacagcggctacgactggatcaccgacttccccgggaagaccgtgtggttcgtgccctccatcaagagcggcaacgacatcgcgaactgcctccgcaagaacgggaagcgggtcatccagctgtcccgcaagacgttcgacaccgagtaccagaagaccaagaacaacgactgggactacgtggtgaccacggacatcagcgagatgggcgccaacttccgggccgaccgcgtcatcgacccccggcgctgcctgaagcccgtgatcctcaaggacgggcccgagcgggtgatcctggccggcccgatgcccgtcaccgtggcgtccgccgcccagcgccggggccgcatcgggcgcaaccagaacaaggagggcgaccagtacgtctacatggggcagcccctgaacaacgacgaggaccacgcccactggaccgaggccaagatgctcctggacaacatcaacacccccgagggcatcatcccggcgctgttcgagcccgagcgggagaagtccgccgccatcgacggggagtaccgcctccggggcgaggcccgcaagacgttcgtggagctgatgcggcgcggcgacctgcccgtgtggctctcctacaaggtcgccagcgaggggttccagtactccgaccggcgctggtgcttcgacggcgagcggaacaaccaggtgctggaggagaacatggacgtggagatctggaccaaggagggggagcgcaagaagctgcggccccgctggctcgacgcgcggacctacagcgacccgctggccctgcgcgagttcaaggagttcgccgccggccggcgctccgtcagcggcgacctcatcctggagatcgggaagctgccccagcacctcaccctgcgggcccagaacgcgctggacaacctcgtgatgctgcacaactccgagcagggcgggaaggcctaccgccacgccatggaggagctgcccgacaccatcgagacgctcatgctgctggccctcatcgcggtgctgaccggcggggtcaccctgttcttcctcagcggcaagggcctggggaagaccagcatcggcctgctctgcgtgacggcctccagcgccctgctgtggatggcctccgtggagccccactggatcgccgcgagcatcatcctcgagttcttcctgatggtcctgctcatcccggagcccgaccggcagcgcacgccccaggacaaccagctggcctacgtggtgatcgggctcctcttcatgatcctgaccgtcgccgccaacgagatgggcctgctcgagaccacgaagaaggacctggggatcggccacgtggccgcggagaaccaccagcacgccaccatgctggacgtggacctccacccggcctccgcctggaccctgtacgccgtcgcgaccacggtgatcacccccatgatgcggcacaccatcgagaacaccacggccaacatcagcctgaccgccatcgccaaccaggccgcgatcctcatgggcctggacaaggggtggcccatctccaagatggacatcggcgtgcccctgctcgccctggggtgctacagccaggtcaacccgctgaccctcaccgccgccgtgctgatgctggtggcgcactacgccatcatcggccccgggctccaggccaaggccacgcgcgaggcccagaagcgcaccgcggccggcatcatgaagaaccccaccgtcgacggcatcgtggccatcgacctggaccccgtggtctacgacgccaagttcgagaagcagctggggcagatcatgctcctgatcctgtgcacctcccagatcctcctgatgcggacgacctgggccctgtgcgagagcatcaccctcgcgaccggcccgctgacgaccctgtgggaggggtcccccggcaagttctggaacaccaccatcgccgtgagcatggccaacatcttccgcggctcctacctcgccggggccggcctggcgttcagcctgatgaagtccctcgggggcgggcggcgcggcacgggcgcccagggggagaccctgggcgagaagtggaagcggcagctgaaccagctcagcaagtccgagttcaacacctacaagcgcagcgggatcatggaggtggaccggtccgaggccaaggagggcctgaagcgcggggagaccacgaagcacgccgtcagccggggcaccgcgaagctgcgctggttcgtggagcggaacctggtgaagcccgagggcaaggtcatcgacctcgggtgcggccgcgggggctggagctactactgcgccgggctgaagaaggtgaccgaggtgaagggctacaccaagggcgggcccggccacgaggagccgatccccatggccacctacgggtggaacctggtcaagctccactccggcaaggacgtgttcttcatgccgcccgagaagtgcgacacgctgctgtgcgacatcggggagagctccccgaaccccaccatcgaggagggccggaccctccgcgtgctgaagatggtcgagccctggctgcggggcaaccagttctgcatcaagatcctcaacccctacatgccgagcgtggtggagaccctggagcagatgcagcgcaagcacgggggcatgctggtccggaaccccctctcccgcaacagcacgcacgagatgtactgggtgtcccgggggaccggcaacatcgtgagcgccgtcaacatgacctcccgcatgctgctgaaccgcttcaccatggcccaccggaagcccacgtacgagcgcgacgtggacctcggcgcggggacccggcacgtggccgtcgagcccgaggtggccaacctggacatcatcggccagcgcatcgagaacatcaagaacgagcacaagagcacctggcactacgacgaggacaacccgtacaagacctgggcctaccacgggtcctacgaggtgaagcccagcggctccgccagctccatggtcaacggggtggtccggctgctcacgaagccctgggacgtgatccccatggtgacccagatcgcgatgaccgacaccacgccgttcggccagcagcgcgtcttcaaggagaaggtggacacccggacgccccgggccaagcggggcaccacgcagatcatggaggtgaccgccaagtggctgtgggggttcctgagccgcaacaagaagccccggatctgcacccgcgaggagttcacccggaaggtccgctccaacgccgccatcggcgcggtgttcgtggacgagaagcagtggaacagcgccaaggaggccgtcgaggacgagcggttctgggacctcgtgcaccgcgagcgggagctgcacaagcaggggaagtgcgccacgtgcgtgtacaacatgatgggcaagcgcgagaagaagctgggggagttcggcaaggcgaagggctcccgggccatctggtacatgtggctcggggcccgcttcctggagttcgaggccctgggcttcatgaacgaggaccactggttcagccgggagaacagcctctccggggtcgagggcgaggggctgcacaagctgggctacatcctccgcgacatcagcaagatcccgggcgggaacatgtacgccgacgacaccgcgggctgggacacccgcatcaccgaggacgacctgcagaacgaggccaagatcacggacatcatggagcccgagcacgccctgctcgccacctccatcttcaagctgacctaccagaacaaggtggtgcgggtccagcgccccgccaagaacgggaccgtgatggacgtgatcagccggcgcgaccagcggggctccggccaggtcgggacgtacggcctgaacaccttcaccaacatggaggtgcagctcatccgccagatggagagcgaggggatcttcctgccctccgagctggagaccccgaacctcgcggagcgggtgctggactggctggagaagcacggcgccgagcgcctcaagcggatggccatcagcggggacgactgcgtcgtgaagcccatcgacgaccgcttcgccacggccctgaccgcgctgaacgacatgggcaaggtgcggaaggacatcccccagtgggagccctccaagggctggaacgactggcagcaggtcccgttctgcagccaccacttccaccagctcatcatgaaggacgggcgcgagatcgtggtgccctgccggaaccaggacgagctggtcggccgcgcccgggtgtcccagggggccggctggagcctgcgcgagaccgcctgcctcgggaagtcctacgcccagatgtggcagctgatgtacttccaccggcgcgacctgcggctcgcggccaacgccatctgcagcgccgtgcccgtcgactgggtgcccacctcccgcaccacgtggagcatccacgcgcaccaccagtggatgaccaccgaggacatgctgtccgtgtggaaccgcgtctggatcgaggagaacccgtggatggaggacaagacccacgtgagcagctgggaggaggtgccctacctgggcaagcgggaggaccagtggtgcggctccctcatcgggctgacggcccgcgccacctgggccaccaacatccaggtcgccatcaaccaggtgcggcgcctgatcggcaacgagaactacctcgactacatgaccagcatgaagcggttcaagaacgagtccgaccccgagggggcgctgtggtga

SEQ ID NO: 8877 - RNA, 9879 nt, synthetic construct
  misc_feature 1..9879: note = derived and/or modified CDS sequence (opt1) from DENV-1__KC692517__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgatcgagcacggcaccatcgcgaccatcacgccccaggcccccaccagcgagatccagctgacggactacggggccctcaccctggactgcagcccccgcaccggcctggacttcaacgagatggtcctcctgaccatgaaggagaagtcctggctggtgcacaagcagtggttcctcgacctgccgctgccctggacgtccggggccagcacgccccaggagacctggaaccggcaggacctcctggtgaccttcaagacggcccacgcgaagaagcaggaggtcgtggtgctgggcagccaggagggcgccatgcacaccgccctcaccggggccaccgagatccagacgtccggcaccaccaccatcttcgccgggcacctgaagtgccgcctgaagatggacaagctcacgctgaagggcatgagctacgtcatgtgcaccgggtccttcaagctggagaaggaggtggcggagacccagcacggcaccgtgctggtccaggtgaagtacgagggcacggacgccccctgcaagatcccgttcagcacccaggacgagaagggggtgacccagaacggccggctcatcaccgccaaccccatcgtcacggacaaggagaagtccgtgaacatcgagaccgagccgcccttcggggagagctacatcgtggtcggcgtgggcgagaaggccctgaagctgtcctggttcaagaaggggagctccatcggcaagatgttcgaggcgaccgcccgcggggcccggcgcatggccatcctcggcgacaccgcctgggacttcgggagcatcggcggcgtgttcacgtccgtcgggaagctggtgcaccaggtgttcggcaccgcgtacggggtcctgttcagcggcgtgtcctggaccatgaagatcgggatcggcatcctcctgacctggctgggcctcaacagccgctccacgagcctgtccatgacctgcatcgccgtggggatggtcaccctgtacctcggcgtgatggtgcaggccgacagcgggtgcgtcatcaactggaagggccgggagctgaagtgcgggtccggcatcttcgtgaccaacgaggtgcacacgtggaccgagcagtacaagttccaggccgacagcccgaagcgcctgagcgccgcgatcggcaaggcctgggaggagggggtctgcggcatccggtccgccacccgcctcgagaacatcatgtggaagcagatcagcaacgagctgaaccacatcctgctcgagaacgacatgaagttcaccgtggtggtcggggacgccaacggcatcctggcccaggggaagaagatgatccggccccagcccatggagcacaagtactcctggaagtcctggggcaaggcgaagatcatcggcgccgacatccagaacaccacgttcatcatcgacgggcccgacaccccggagtgccccgacggccagcgcgcctggaacatctgggaggtggaggactacgggttcggcatcttcaccaccaacatctggctgaagctccgggactcctacacgcagatgtgcgaccaccgcctgatgagcgccgcgatcaaggactccaaggccgtgcacgccgacatgggctactggatcgagagcgagaagaacgagacctggaagctggcccgggcctccttcatcgaggtcaagacctgcacctggcccaagagccacacgctctggtccaacggggtgctggagagcgagatgatcatccccaagatctacggcgggccgatctcccagcacaactaccgccccggctacttcacccagaccgcggggccctggcacctgggcaagctcgagctggacttcgacctgtgcgagggcaccacggtggtcgtggacgagcactgcgggaaccggggcccgagcctccgcaccaccaccgtgacggggaagatcatccacgagtggtgctgccggtcctgcaccctgccgcccctgcgcttccggggcgaggacgggtgctggtacggcatggagatccgccccgtcaaggagaaggaggagaacctcgtgcggagcatggtgtccgccggcagcggggaggtcgacagcttctccctgggcatcctgtgcgtgagcatcatgatcgaggaggtgatgcgctcccggtggagccgcaagatgctcatgaccgggaccctggccgtcttcctgctcctgatcatgggccagctgacgtggaacgacctcatccgcctgtgcatcatggtgggggccaacgcctccgaccggatgggcatgggcaccacctacctggcgctcatggccaccttcaagatgcgcccgatgttcgccgtggggctgctgttccggcgcctcacgagccgggaggtcctgctgctcaccatcgggctgtccctggtggccagcgtcgagctccccaactccctggaggagctgggggacggcctcgccatgggcatcatgatgctgaagctgctcaccgagttccagccccaccagctgtggaccacgctgctcagcctgaccttcgtgaagaccaccctgtccctcgactacgcgtggaagacgaccgccatggtgctgagcatcgtctccctgttccccctctgcctgagcaccacctcccagaagacgacctggctgccggtgctcctggggagcttcggctgcaaccccctgaccatgttcctcatcaccgagaacaagatctgggggcgcaagtcctggcccctgaacgagggcatcatggccatcgggatcgtgagcatcctgctctccagcctgctgaagaacgacgtccccctcgccggcccgctgatcgcgggcgggatgctgatcgcctgctacgtgatcagcggctccagcgccgacctctccctggagaaggccgccgaggtgagctgggagcaggaggcggagcactccggggccagccacaacatcctggtcgaggtgcaggacgacggcaccatgaagatcaaggacgaggagcgggacgacacgctcaccatcctgctgaaggccaccctcctggccgtgtccggggtctaccccatgagcatccccgccaccctgttcgtgtggtacttctggcagaagaagaagcagcgctccggcgtgctctgggacacgcccagcccgcccaaggtcgagcgggcggtgctggacgacggcatctaccgcatcctgcagcgggggctgctcggccgctcccaggtgggggtcggcgtgttccaggacggggtgttccacaccatgtggcacgtcacccggggcgccgtgctgatgtaccagggcaagcgcctggagcccagctgggcctccgtgaagaaggacctcatcagctacgggggcgggtggcggttccagggctcctggaacaccggggaggaggtccaggtgatcgccgtggagcccggcaagaacccgaagaacgtccagacgacccccggcaccttcaagacccccgagggggaggtgggcgccatcgcgctggacttcaagcccgggacgagcggctccccgatcgtgaaccgcgagggcaagatcgtcgggctgtacggcaacggggtggtgaccaccagcggcacctacgtctccgccatcgcccaggccaaggccagccaggaggggcccctccccgagatcgaggacgaggtgttcaagaagcggaacctgacgatcatggacctgcacccgggcagcggcaagacccgccggtacctccccgcgatcgtgcgcgaggccatcaagcggaagctgcgcaccctgatcctcgcccccacccgcgtcgtggcctccgagatggcggaggccctgaaggggatgcccatccggtaccagacgaccgccgtcaagagcgagcacaccggccgcgagatcgtcgacctgatgtgccacgccaccttcacgatgcggctcctgtccccggtgcgcgtgcccaactacaacatgatcatcatggacgaggcccacttcaccgaccccgcgagcatcgccgcccgggggtacatctccacccgcgtcggcatgggggaggccgccgcgatcttcatgaccgccacgcccccgggcagcgtggaggccttcccccagtccaacgccgtgatccaggacgaggagcgggacatccccgagcgcagctggaactccggctacgactggatcaccgacttccccgggaagaccgtctggttcgtgccgagcatcaagtccggcaacgacatcgccaactgcctgcggaagaacgggaagcgcgtgatccagctcagccggaagaccttcgacacggagtaccagaagaccaagaacaacgactgggactacgtcgtgaccaccgacatctccgagatgggcgcgaacttccgcgccgaccgggtgatcgacccccgccggtgcctgaagcccgtcatcctgaaggacgggcccgagcgcgtgatcctcgccggcccgatgcccgtcacggtggccagcgcggcccagcggcgcggccggatcgggcgcaaccagaacaaggagggcgaccagtacgtgtacatggggcagcccctgaacaacgacgaggaccacgcccactggaccgaggccaagatgctgctcgacaacatcaacacccccgagggcatcatcccggccctgttcgagcccgagcgcgagaagtccgcggccatcgacggggagtaccggctgcgcggcgaggcccggaagaccttcgtcgagctcatgcgccggggcgacctgcccgtgtggctgagctacaaggtggcctccgaggggttccagtacagcgaccgccggtggtgcttcgacggcgagcgcaacaaccaggtcctcgaggagaacatggacgtggagatctggacgaaggagggggagcggaagaagctgcgcccccggtggctggacgcccgcacctactccgacccgctcgcgctgcgggagttcaaggagttcgccgccggccgccggagcgtgagcggcgacctgatcctcgagatcgggaagctgccccagcacctgaccctccgcgcccagaacgccctggacaacctggtcatgctccacaactccgagcagggcgggaaggcgtaccggcacgccatggaggagctgcccgacaccatcgagaccctgatgctcctggccctgatcgccgtgctcacgggcggggtgaccctgttcttcctgagcggcaagggcctcgggaagacctccatcggcctgctgtgcgtcaccgcgagctccgccctcctgtggatggccagcgtggagccccactggatcgccgcctccatcatcctggagttcttcctcatggtgctgctgatcccggagcccgaccgccagcggacgccccaggacaaccagctcgcgtacgtcgtgatcgggctgctgttcatgatcctcaccgtggccgccaacgagatgggcctgctggagaccaccaagaaggacctcgggatcggctacgtcgccgccgagaaccaccagcacgcgacgatgctggacgtggacctgcgcccggccagcgcctggaccctctacgccgtggccaccaccgtcatcacgcccatgatgcggcacaccatcgagaacaccaccgcgaacatctccctgacggccatcgccaaccaggccgccatcctgatgggcctcgacaaggggtggcccatcagcaagatggacatcggcgtgcccctgctggcgctcgggtgctactcccaggtgaacccgctgaccctgaccgccgccgtcctcatgctggtggcccactacgcgatcatcggccccgggctgcaggccaaggccacccgcgaggcccagaagcgcacggccgcgggcatcatgaagaaccccaccgtggacggcatcgtcgccatcgacctcgaccccgtggtgtacgacgccaagttcgagaagcagctggggcagatcatgctgctcatcctgtgcaccagccagatcctgctcatgcggaccacgtgggccctgtgcgagtccatcaccctggccaccggcccgctcaccacgctgtgggaggggagccccggcaagttctggaacaccaccatcgcggtctccatggccaacatcttccgcggcagctacctggccggggccggcctcgccttctccctgatgaagtccctcgggggcgggcggcgcgggaccggcgcgcagggggagacgctcggcgagaagtggaagcggcagctgaaccagctgtccaagagcgagttcaacacctacaagcgcagcgggatcatggaggtggaccggtccgaggccaaggagggcctcaagcgcggggagaccaccaagcacgccgtgagccggggcacggccaagctgcgctggttcgtcgagcggaacctggtgaagcccgagggcaaggtgatcgacctggggtgcggccgcgggggctggtcctactactgcgcggggctcaagaaggtcaccgaggtgaagggctacaccaagggcgggcccggccacgaggagccgatccccatggccacctacgggtggaacctggtgaagctgcacagcggcaaggacgtcttcttcatgccgcccgagaagtgcgacaccctcctgtgcgacatcggggagtccagcccgaaccccacgatcgaggagggccggaccctgcgcgtgctcaagatggtggagccctggctgcggggcaaccagttctgcatcaagatcctgaacccctacatgccgtccgtcgtggagaccctcgagcagatgcagcgcaagcacgggggcatgctggtgcggaaccccctgagccgcaactccacccacgagatgtactgggtcagctgcgggacgggcaacatcgtgtccgccgtgaacatgaccagccggatgctcctgaaccgcttcaccatggcccaccgcaagcccacctacgagcgggacgtcgacctgggcgccgggacgcgccacgtggcggtggagcccgaggtcgccaacctcgacatcatcggccagcggatcgagaacatcaagaacgagcacaagtccacctggcactacgacgaggacaacccgtacaagacctgggcctaccacgggagctacgaggtgaagccctccggcagcgcctccagcatggtcaacggggtggtgcgcctgctgaccaagccctgggacgtcatccccatggtgacgcagatcgccatgaccgacaccaccccgttcggccagcagcgggtgttcaaggagaaggtcgacacgcgcacgccccgggcgaagcgcggcaccacccagatcatggaggtgacggccaagtggctctgggggttcctgtcccggaacaagaagccccgcatctgcacccgggaggagttcacccgcaaggtgcggagcaacgccgccatcggcgccgtcttcgtggacgagaaccagtggaacagcgcgaaggaggccgtggaggacgagcgcttctgggacctggtccaccgggagcgcgagctccacaagcaggggaagtgcgcgacctgcgtgtacaacatgatgggcaagcgggagaagaagctgggggagttcggcaaggccaagggctcccgcgcgatctggtacatgtggctgggggcccggttcctcgagttcgaggccctgggcttcatgaacgaggaccactggttcagccgcgagaactccctgagcggggtggagggcgaggggctccacaagctgggctacatcctgcgggacatctccaagatcccgggcgggaacatgtacgccgacgacacggccggctgggacacccgcatcaccgaggacgacctccagaacgaggcgaagatcaccgacatcatggagcccgagcacgccctgctggccacgagcatcttcaagctcacctaccagaacaaggtcgtgcgcgtgcagcggcccgccaagaacgggaccgtcatggacgtgatctcccgccgggaccagcgcggcagcggccaggtggggacctacggcctgaacacgttcaccaacatggaggtccagctggtgcggcagatggagtccgaggggatcttcctccccagcgagctggagaccccgaacctggccgagcgcgtgctcgactggctggagaagcacggcgtcgagcggctgaagcgcatggcgatctccggggacgactgcgtggtgaagcccatcgacgaccggttcgccaccgccctcacggccctgaacgacatgggcaaggtccgcaaggacatcccccagtgggagcccagcaagggctggaacgactggcagcaggtcccgttctgctcccaccacttccaccagctgatcatgaaggacgggcgggagatcgtggtcccctgccgcaaccaggacgagctcgtgggccgggcccgcgtgagccagggggcgggctggtccctgcgggagaccgcctgcctgggcaagagctacgcccagatgtggcagctcatgtacttccaccgccgggacctgcgcctggccgccaacgcgatctgctccgccgtccccgtggactgggtgcccaccagccggaccacctggagcatccacgcccaccaccagtggatgacgaccgaggacatgctctccgtctggaaccgcgtgtggatcgaggagaacccgtggatggaggacaagacccacgtgagctcctgggaggaggtcccctacctgggcaagcgcgaggaccagtggtgcggcagcctgatcgggctcaccgcccgggcgacgtgggccaccaacatccaggtggccatcaaccaggtgcgccggctgatcggcaacgagaactacctggactacatgacctccatgaagcgcttcaagaacgagagcgaccccgagggggccctctggtga

SEQ ID NO: 8878 - RNA, 9879 nt, synthetic construct
  misc_feature 1..9879: note = derived and/or modified CDS sequence (opt1) from DENV-1__KC762649__SS-prME
  source 1..9879: mol_type = other RNA
agcgtgaccatgctgctcatgctgatgcccaccgccctggccttccacctcaccacccggggcggggagccccacatgatcgtgtccaagcaggagcggggcaagagcctgctgttcaagacctccgccggggtgaacatgtgcaccctcatcgccatggacctgggcgagctgtgcgaggacaccctcacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccctgttcctcgcgcacgccatcggcgccagcatcacccagaaggggatcatcttcatcctgctgatgctcgtgaccccctccatggccatgcggtgcgtcggcatcggcagccgcgacttcgtggaggggctgtccggcgccacctgggtggacgtcgtgctggagcacgggagctgcgtgacgaccatggcgaaggacaagcccaccctcgacatcgagctgctgaagaccgaggtcacgaaccccgccgtgctccggaagctgtgcatcgaggccaagatctccaacaccaccaccgacagccgctgcccgacgcagggcgaggccaccctggtggaggagcaggacgccaacttcgtctgccggcgcaccttcgtggaccggggctgggggaacggctgcgggctgttcggcaaggggtccctgatcacgtgcgcgaagttcaagtgcgtgagcaagctggagggcaagatcgtccagtacgagaacctcaagtactccgtgatcgtgacggtccacaccggcgaccagcaccaggtggggaacgagagcaccgagcacggcaccacggccaccatcacgccccaggcccccaccaccgagatccagctgacggactacggggccctgaccctcgactgcagcccccggaccggcctggacttcaacgagatggtcctgctcaccatgaaggagaagtcctggctggtgcacaagcagtggttcctggacctccccctgccctggacgagcggggcctccaccagccaggagacctggaaccggcaggacctgctcgtgaccttcaagacggcgcacgccaagaagcaggaggtcgtggtgctgggctcccaggagggcgccatgcacaccgccctgaccggggccaccgagatccagacgagcggcaccaccaccatcttcgcggggcacctcaagtgccgcctgaagatggacaagctgacgctcaagggcatgtcctacgtcatgtgcaccgggagcttcaagctggagaaggaggtggccgagacccagcacggcaccgtgctggtccagatcaagtacgagggcacggacgccccctgcaagatccccttctccacccaggacgagaagggggtgacccagaacggccggctgatcaccgccaacccgatcgtgacggacaaggagaagcccgtcaacatcgaggcggagccgcccttcggggagagctacatcgtgatcggcgccggcgagaaggccctcaagctgtcctggttcaagaaggggagctccatcggcaagatgttcgaggccaccgcccgcggggcgcggcgcatggccatcctgggcgacaccgcctgggacttcgggagcatcggcggcgtgttcacctccgtcgggaagctcgtgcaccagatcttcggcacggcctacggggtgctgttcagcggcgtctcctggaccatgaagatcgggatcggcgtgctgctcacctggctgggcctgaacagccgctccaccagcctctccatgacgtgcatcgccgtggggctggtcaccctgtacctcggcgtgatggtgcaggcggacagcgggtgcgtcatcaactggaagggccgggagctgaagtgcgggagcggcatcttcgtgaccaacgaggtgcacacctggacggagcagtacaagttccaggccgactccccgaagcgcctgagcgccgccatcggcaaggcctgggaggagggggtctgcggcatccggtccgcgacccgcctcgagaacatcatgtggaagcagatcagcaacgagctgaaccacatcctgctcgagaacgacatgaagttcaccgtggtggtcggggacgtggccggcatcctggcccaggggaagaagatgatccggccccagcccatggagcacaagtactcctggaagtcctggggcaaggccaagatcatcggcgcggacgtgcagaacaccaccttcatcatcgacgggcccaacacgccggagtgccccgacgaccagcgcgcctggaacatctgggaggtcgaggactacggcttcgggatcttcaccaccaacatctggctgaagctccgggactcctacacccaggtgtgcgaccaccgcctgatgagcgccgccatcaaggactccaaggccgtgcacgcggacatgggctactggatcgagagcgagaagaacgagacgtggaagctggcccgggcctccttcatcgaggtcaagacctgcatctggcccaagagccacaccctctggtccaacggcgtgctggagagcgagatgatcatccccaagatctacgggggcccgatctcccagcacaactaccgccccgggtacttcacccagacggccggcccctggcacctggggaagctcgagctggacttcgacctgtgcgagggcaccaccgtggtcgtggacgagcactgcggcaaccgggggccgagcctccgcaccacgaccgtgaccggcaagatcatccacgagtggtgctgccggtcctgcaccctgccgcccctgcgcttccgcggggaggacggctgctggtacgggatggagatccgccccgtcaaggagaaggaggagaacctcgtcaagagcatggtgagcgccggctccggcgaggtcgacagcttctccctggggctgctctgcatcagcatcatgatcgaggaggtgatgcggtcccgctggagccggaagatgctgatgacgggcaccctggcggtgttcttcctcctgatcatggggcagctgacctggaacgacctcatccgcctgtgcatcatggtcggcgccaacgcctccgaccgcatggggatgggcaccacgtacctggccctcatggccaccttcaagatgcggccgatgttcgcggtgggcctgctgttccgccggctcaccagccgcgaggtgctgctgctcaccatcgggctgtccctggtcgccagcgtggagctccccaactccctggaggagctgggcgacgggctcgccatgggcatcatgatcctgaagctgctcacggacttccagagccaccagctgtgggccaccctgctctccctgaccttcatcaagaccacgttcagcctgcactacgcgtggaagaccatggccatggtcctctccatcgtgagcctgttccccctgtgcctctccaccaccagccagaagacgacctggctgcccgtgctgctcggctccctggggtgcaagccgctgaccatgttcctcatcgccgagaacaagatctggggccgcaagagctggcccctgaacgaggggatcatggccgtcggcatcgtgagcatcctgctctccagcctgctgaagaacgacgtgcccctcgccgggcccctgatcgcgggcggcatgctgatcgcctgctacgtcatctccgggagctccgccgacctcagcctggagaaggccgccgaggtgtcctgggaggaggaggcggagcacagcggcgcctcccacaacatcctggtggaggtccaggacgacgggaccatgaagatcaaggacgaggagcgcgacgacacgctcaccatcctgctgaaggccaccctcctggccgtgagcggcgtgtacccgctgtccatccccgccaccctcttcgtctggtacttctggcagaagaagaagcagcggagcggggtgctgtgggacacccccagcccgcccgaggtggagcgcgcggtcctggacgacggcatctaccggatcatgcagcgcggcctgctcgggcggagccaggtgggcgtgggggtcttccaggagaacgtgttccacacgatgtggcacgtgacccgcggcgccgtcctgatgtaccaggggaagcggctggagccctcctgggccagcgtgaagaaggacctcatctcctacggcggcgggtggcgcctgcagggcagctggaacaccggggaggaggtgcaggtcatcgccgtggagcccggcaagaaccccaagaacgtgcagaccgcccccgggatcttcaagacgcccgagggcgaggtcggcgcgatcgccctggacttcaagcccgggacctccggcagccccatcgtgaaccgggaggggaagatcgtgggcctctacggcaacggggtcgtgaccaccagcggcacgtacgtgtccgccatcgcccaggcgaaggccagccaggaggggccgctgcccgagatcgaggacgaggtcttccgcaagcggaacctgaccatcatggacctccaccccggctccgggaagacccgccggtacctgccggccatcgtgcgcgaggccatcaagcggaagctgcgcaccctcatcctggcccccacgcgcgtggtcgcgagcgagatggccgaggccctgaagggcatgcccatccggtaccagaccaccgccgtgaagtccgagcacaccggcaaggagatcgtggacctcatgtgccacgccacgttcaccatgcgcctgctgagccccgtccgggtgccgaactacaacatgatcatcatggacgaggcgcacttcaccgacccctccagcatcgccgcccgcgggtacatctccacccgggtgggcatgggggaggccgccgcgatcttcatgacggccacgccgcccggcagcgtcgaggccttcccgcagtccaacgccgtgatccaggacgaggagcgcgacatccccgagcggagctggaactccgggtacgagtggatcaccgacttccccggcaagaccgtgtggttcgtccccagcatcaagtccggcaacgacatcgcgaactgcctccgcaagaacgggaagcgggtgatccagctgagccgcaagacgttcgacaccgagtaccagaagaccaagaacaacgactgggactacgtggtcaccacggacatctccgagatgggcgccaacttccgggccgaccgcgtgatcgacccgcggcgctgcctgaagcccgtgatcctcaaggacgggcccgagcgggtcatcctggccggccccatgccggtgaccgtcgccagcgcggcccagcgccgggggcgcgtgggccggaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgcggccatcgacggggagtaccgcctccggggcgaggcccgcaagacgttcgtggagctgatgcggcgcggggacctgcccgtctggctcagctacaaggtggccagcgagggcttccagtactccgaccggcgctggtgcttcgacggcgagcggaacaaccaggtgctggaggagaacatggacgtcgagatctggaccaaggagggggagcgcaagaagctgcggccccgctggctcgacgcccggacctacagcgaccccctggcgctgcgcgagttcaaggagttcgccgccggccggcgctccgtgagcggggacctcatcctggagatcggcaagctgccgcagcacctcacccagcgggcccagaacgcgctggacaacctggtgatgctccacaactccgagcagggcgggcgcgcctaccggcacgccatggaggagctgcccgacacgatcgagaccctgatgctcctggccctgatcgccgtcctcaccggcggggtgaccctgttcttcctgagcggccgcgggctcggcaagacgtccatcggcctgctgtgcgtgatggcgagctccgtcctcctgtggatggccagcgtggagccccactggatcgccgcctccatcatcctggagttcttcctcatggtgctgctgatccccgagccggaccggcagcgcacgccccaggacaaccagctcgcctacgtcgtgatcgggctgctgttcatgatcctcaccgtggcggccaacgagatgggcctgctggagaccaccaagaaggacctcgggatcggccacgtcgccgtggagaaccaccaccacgccgccatgctggacgtggacctgcaccccgcgagcgcctggacgctctacgccgtcgccaccaccatcatcaccccgatgatgcggcacacgatcgagaacaccaccgccaacatctccctgaccgcgatcgccaaccaggccgccatcctgatggggctcgacaagggctggcccatcagcaagatggacatcggcgtgcccctgctggcgctcgggtgctactcccaggtgaaccccctgacgctgaccgccgccgtcctcatgctggtggcccactacgccatcatcggcccggggctgcaggcgaaggccacccgcgaggcccagaagcgcaccgccgccggcatcatgaagaaccccacggtggacgggatcgtcgcgatcgacctcgaccccgtggtgtacgacgccaagttcgagaagcagctgggccagatcatgctgctcatcctgtgcaccagccagatcctgctcatgcggaccacctgggccctgtgcgagtccatcacgctggccaccggccccctcaccaccctgtgggaggggagcccgggcaagttctggaacacgaccatcgccgtctccatggcgaacatcttccgcgggagctacctggccggcgccggcctcgccttcagcctgatgaagtccctcgggggcgggcggcgcgggaccggggcgcagggcgagaccctcggcgagaagtggaagcggcagctgaaccagctgagcaagtccgagttcaacacgtacaagcgcagcgggatcatggaggtggaccggtccgaggccaaggagggcctcaagcgcggggagaccaccaagcacgccgtgagccggggcaccgccaagctgcgctggttcgtcgagcggaacctggtgaagcccgaggggaaggtgatcgacctgggctgcggccgcgggggctggtcctactactgcgccgggctcaagaaggtcacggaggtgaagggctacaccaagggcggccccggccacgaggagcccatcccgatggcgacctacgggtggaacctggtgaagctgcacagcggcaaggacgtcttcttcatcccgcccgagaagtgcgacaccctcctgtgcgacatcggggagtccagccccaacccgacgatcgaggagggccggaccctgcgcgtgctcaagatggtggagccctggctgcgggggaaccagttctgcatcaagatcctgaacccctacatgccctccgtcgtggagaccctcgagcagatgcagcgcaagcacggcggcatgctggtgcggaacccgctgagccgcaactccacccacgagatgtactgggtcagctgcgggacgggcaacatcgtgtccgccgtgaacatgaccagccggatgctcctgaaccgcttcaccatggcccaccgcaagcccacctacgagcgggacgtcgacctgggggccggcacccgccacgtggccgtggagcccgaggtcgcgaacctcgacatcatcggccagcggatcgagaacatcaagcacgagcacaagtccacgtggcactacgacgaggacaacccctacaagacctgggcctaccacgggagctacgaggtgaagccgtccggcagcgccagctccatggtcaacggggtggtgaagctgctgaccaagccctgggacgtcatccccatggtgacccagatcgccatgacggacaccacccccttcggccagcagcgcgtgttcaaggagaaggtcgacacccggacgccgaaggccaagcgcgggaccacccagatcatggaggtgaccgcgcggtggctctggggcttcctgagccgcaacaagaagccccggatctgcacgcgcgaggagttcacccggaaggtgcgctccaacgccgccatcggcgccgtcttcgtggacgagaaccagtggaacagcgcgaaggaggccgtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggtcccgggccatctggtacatgtggctgggcgcgcgcttcctcgagttcgaggccctgggcttcatgaacgaggaccactggttcagccgggagaactccctgagcggggtggagggcgaggggctccacaagctgggctacatcctgcgcgacatctccaagatccccgggggcaacatgtacgccgacgacaccgccggctgggacacgcggatcaccgaggacgacctccagaacgaggccaagatcaccgacatcatggagccggagcacgcgctgctggccaaggccatcttcaagctcacctaccagaacaaggtcgtgcgcgtgcagcgccccgccaagaacgggacggtcatggacgtgatcagccggcgcgaccagcggggctccggccaggtggggacctacggcctgaacaccttcaccaacatggaggcccagctgatccgccagatggagagcgaggggatcttctcccccagcgagctcgagacgcccaacctggcggagcgggtcctggactggctcgagaagtacggcgtggagcgcctgaagcggatggccatctccggggacgactgcgtggtcaagccgatcgacgaccgcttcgccaccgccctgaccgccctcaacgacatgggcaaggtgcggaaggacatcccccagtgggagcccagcaaggggtggaacgactggcagcaggtccccttctgctcccaccacttccaccagctgatcatgaaggacggccgcgagatcgtcgtgccgtgccggaaccaggacgagctggtgggccgcgcgcgggtcagccagggggccggctggagcctccgcgagaccgcctgcctggggaagtcctacgcccagatgtggcagctgatgtacttccaccggcgcgacctccggctggcggccaacgccatctgcagcgccgtgcccgtggactgggtccccacgtcccgcaccacctggagcatccacgcccaccaccagtggatgaccacggaggacatgctgtccgtgtggaaccgggtgtggatcgaggagaacccctggatggaggacaagacccacatcagctcctgggaggacgtcccgtacctcggcaagcgcgaggaccagtggtgcgggagcctgatcggcctgaccgcgcgcgccacctgggccacgaacatccaggtggccatcaaccaggtgcggcgcctcatcggcaacgagaactacctggactacatgacctccatgaagcggttcaagaacgagagcgaccccgagggggccctgtggtga

SEQ ID NO: 8879 - RNA, 9879 nt, synthetic construct
  misc_feature 1..9879: note = derived and/or modified CDS sequence (opt1) from DENV-1__KC762625__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccctcacctacaagtgcccccgcatcaccgaggccgagcccgacgacgtggactgctggtgcaacgccaccgacacctgggtgacctacgggacctgcagccagaccggcgagcaccggcgcgacaagcggagcgtggccctggcgccccacgtgggcctggggctcgagacgcgcaccgagacctggatgagctccgagggcgcctggaagcagatccagcgggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcagccgcgacttcgtggaggggctgtccggcgccacgtgggtggacgtcgtgctggagcacgggagctgcgtgaccaccatggccaaggacaagcccaccctcgacatcgagctgctgaagacggaggtcaccaaccccgcggtgctccggaagctgtgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctgatcacgtgcgccaagttcaagtgcgtgagcaagctggagggcaagatcgtccagtacgagaacctcaagtactccgtgatcgtgaccgtccacaccggcgaccagcaccaggtggggaacgagagcaccgagcacggcacgaccgcgaccatcacgccccaggcccccaccacggagatccagctgaccgactacggggccctgaccctcgactgcagcccccggaccggcctggacttcaacgagatggtcctgctcacgatgaaggagaagtcctggctggtgcacaagcagtggttcctggacctccccctgccctggaccagcggggcctccaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctcaagctgtcctggttcaagaaggggagctccatcggcaagatgttcgaggccaccgcccgcggggcccggcgcatggcgatcctgggcgacaccgcctgggacttcgggagcatcggcggcgtgttcacgtccgtcgggaagctcgtgcaccagatcttcggcaccgcctacggggtgctgttcagcggcgtctcctggaccatgaagatcgggatcggcgtgctgctcacctggctgggcctgaacagccgctccacgagcctctccatgacctgcatcgccgtggggctggtcaccctgtacctcggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctgagcgccgccatcggcaaggcctgggaggagggggtctgcggcatccggtccgccacccgcctcgagaacatcatgtggaagcagatcagcaacgagctgaaccacatcctgctcgagaacgacatgaagttcaccgtggtggtcggggacgtggcgggcatcctggcccaggggaagaagatgatccggccccagcccatggagcacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctccgggactcctacacccaggtgtgcgaccaccgcctgatgagcgccgccatcaaggactccaaggccgtgcacgccgacatgggctactggatcgagagcgagaagaacgagacgtggaagctggcgcgggcctccttcatcgaggtcaagagctgcatctggcccaagtcccacaccctctggagcaacggcgtgctggagtccgagatgatcatccccaagatctacgggggcccgatcagccagcacaactaccgccccgggtacttcacccagacggccggcccctggcacctggggaagctcgagctggacttcgacctgtgcgagggcaccaccgtggtcgtggacgagcactgcggcaaccgggggccgtccctccgcaccacgaccgtgaccggcaagatcatccacgagtggtgctgccggagctgcaccctgccgcccctgcgcttccgcggggaggacggctgctggtacgggatggagatccgccccgtcaaggagaaggaggagaacctcgtcaagagcatggtgtccgccggcagcggcgaggtcgactccttcagcctggggctgctctgcatctccatcatgatcgaggaggtgatgcggagccgctggtcccggaagatgctgatgacgggcaccctggccgtgttcttcctcctgatcatggggcagctgacctggaacgacctcatccgcctgtgcatcatggtcggcgcgaacgccagcgaccgcatggggatgggcaccacgtacctggccctcatggccaccttcaagatgcggccgatgttcgccgtgggcctgctgttccgccggctcacctcccgcgaggtgctgctgctcaccatcgggctgagcctggtcgcgtccgtggagctccccaacagcctggaggagctgggcgacgggctcgccatgggcatcatgatcctgaagctgctcacggacttccagtcccaccagctgtgggccaccctgctcagcctgaccttcatcaagaccacgttctccctgcactacgcctggaagaccatggcgatggtcctcagcatcgtgtccctgttccccctgtgcctcagcaccacctcccagaagacgacctggctgcccgtgctgctcggcagcctggggtgcaagccgctgaccatgttcctcatcgccgagaacaagatctggggccgcaagagctggcccctgaacgaggggatcatggccgtcggcatcgtgtccatcctgctcagctccctgctgaagaacgacgtgcccctcgccgggcccctgatcgccggcggcatgctgatcgcgtgctacgtcatcagcgggtccagcgccgacctctccctggagaaggccgccgaggtgagctgggaggaggaggccgagcactccggcgcgagccacaacatcctggtggaggtccaggacgacgggaccatgaagatcaaggacgaggagcgcgacgacacgctcaccatcctgctgaaggccaccctcctggccgtgtccggcgtgtacccgctgagcatccccgccaccctcttcgtctggtacttctggcagaagaagaagcagcggtccggggtgctgtgggacacccccagcccgcccgaggtggagcgcgccgtcctggacgacggcatctaccggatcatgcagcgcggcctgctcgggcggtcccaggtgggcgtgggggtcttccaggagaacgtgttccacacgatgtggcacgtgacccgcggcgcggtcctgatgtaccaggggaagcggctggagcccagctgggcctccgtgaagaaggacctcatcagctacggcggcgggtggcgcctgcagggctcctggaacaccggggaggaggtgcaggtcatcgccgtggagcccggcaagaaccccaagaacgtgcagaccgcccccgggacgttcaagacccccgagggcgaggtcggcgccatcgcgctggacttcaagcccgggaccagcggcagccccatcgtgaaccgggaggggaagatcgtgggcctctacggcaacggggtcgtgaccacgtccggcacctacgtgagcgccatcgcccaggccaaggcgtcccaggaggggccgctgcccgagatcgaggacgaggtcttccgcaagcggaacctgaccatcatggacctccaccccggcagcgggaagacccgccggtacctgccggccatcgtgcgcgaggccatcaagcggaagctgcgcacgctcatcctggcccccacccgcgtggtcgcctccgagatggcggaggccctgaagggcatgcccatccggtaccagaccaccgccgtcaagagcgagcacacgggcaaggagatcgtggacctcatgtgccacgccaccttcaccatgcgcctgctgtcccccgtccgggtgccgaactacaacatgatcatcatggacgaggcccacttcaccgaccccagctccatcgcggcccgcgggtacatcagcacgcgggtgggcatgggggaggccgccgccatcttcatgaccgcgacgccgcccggctccgtcgaggccttcccgcagagcaacgccgtgatccaggacgaggagcgcgacatccccgagcggtcctggaacagcgggtacgagtggatcaccgacttccccggcaagacggtgtggttcgtcccctccatcaagagcggcaacgacatcgccaactgcctccgcaagaacgggaagcgggtgatccagctgtcccgcaagaccttcgacaccgagtaccagaagaccaagaacaacgactgggactacgtggtcacgaccgacatcagcgagatgggcgcgaacttccgggccgaccgcgtgatcgacccgcggcgctgcctgaagcccgtgatcctcaaggacgggcccgagcgggtcatcctggccggccccatgccggtgaccgtcgcctccgccgcgcagcgccgggggcgcgtgggccggaaccacaacaaggagggcgaccagtacatctacatggggcagcccctgaacaacgacgaggaccacgcccactggaccgaggccaagatgctcctggacaacatcaacacgcccgagggcatcatccccgccctgttcgagccggagcgcgagaagtccgccgcgatcgacggggagtaccgcctccggggcgaggcccgcaagaccttcgtggagctgatgcggcgcggggacctgcccgtctggctcagctacaaggtggcctccgagggcttccagtacagcgaccggcgctggtgcttcgacggcgagcggaacaaccaggtgctggaggagaacatggacgtcgagatctggaccaaggagggggagcgcaagaagctgcggccccgctggctcgacgcccggacctactccgaccccctggccctgcgcgagttcaaggagttcgcggccggccggcgcagcgtgtccggggacctcatcctggagatcggcaagctgccgcagcacctcacgcagcgggcccagaacgccctggacaacctggtgatgctccacaacagcgagcagggcgggcgcgcgtaccggcacgccatggaggagctgcccgacaccatcgagaccctgatgctcctggccctgatcgccgtcctcaccggcggggtgacgctgttcttcctgtccggccgcgggctcggcaagaccagcatcggcctgctgtgcgtgatggcctccagcgtcctcctgtggatggcgtccgtggagccccactggatcgccgccagcatcatcctggagttcttcctcatggtgctgctgatccccgagccggaccggcagcgcacgccccaggacaaccagctcgcctacgtcgtgatcgggctgctgttcatgatcctcaccgtggccgcgaacgagatgggcctgctggagaccacgaagaaggacctcgggatcggccacgtcgccgtggagaaccaccaccacgccgccatgctggacgtggacctgcaccccgcctccgcgtggaccctctacgccgtcgccaccaccatcatcacgccgatgatgcggcacaccatcgagaacaccaccgccaacatcagcctgacggccatcgcgaaccaggccgccatcctgatggggctcgacaagggctggcccatctccaagatggacatcggcgtgcccctgctggccctcgggtgctacagccaggtgaaccccctgaccctgaccgcggccgtcctcatgctggtggcccactacgccatcatcggcccggggctgcaggccaaggcgacccgcgaggcccagaagcgcacggccgccggcatcatgaagaaccccaccgtggacgggatcgtcgccatcgacctcgaccccgtggtgtacgacgcgaagttcgagaagcagctgggccagatcatgctgctcatcctgtgcacctcccagatcctgctcatgcggaccacgtgggccctgtgcgagagcatcaccctggccaccggccccctcaccacgctgtgggaggggtccccgggcaagttctggaacaccaccatcgccgtcagcatggccaacatcttccgcgggagctacctggcgggcgccggcctcgccttctccctgatgaagtccctcgggggcgggcggcgcgggaccggggcccagggcgagacgctcggcgagaagtggaagcggcagctgaaccagctgtccaagagcgagttcaacacctacaagcgctccgggatcatggaggtggaccggagcgaggcgaaggagggcctcaagcgcggggagaccaccaagcacgccgtgtcccggggcacggccaagctgcgctggttcgtcgagcggaacctggtgaagcccgaggggaaggtgatcgacctgggctgcggccgcgggggctggagctactactgcgccgggctcaagaaggtcaccgaggtgaagggctacaccaagggcgggcccggccacgaggagcccatcccgatggccacctacgggtggaacctggtgaagctgcactccggcaaggacgtcttcttcatcccgcccgagaagtgcgacacgctcctgtgcgacatcggggagagctcccccaacccgaccatcgaggagggccggaccctgcgcgtgctcaagatggtggagccctggctgcgggggaaccagttctgcatcaagatcctgaacccctacatgcccagcgtcgtggagaccctcgagcagatgcagcgcaagcacggcggcatgctggtgcggaacccgctgtcccgcaacagcacgcacgagatgtactgggtctcctgcgggaccggcaacatcgtgagcgcggtgaacatgacctcccggatgctcctgaaccgcttcaccatggcccaccgcaagcccacctacgagcgggacgtcgacctgggggccggcacgcgccacgtggccgtggagcccgaggtcgccaacctcgacatcatcggccagcggatcgagaacatcaagcacgagcacaagagcacctggcactacgacgaggacaacccctacaagacctgggcgtaccacgggtcctacgaggtgaagccgagcggcagcgcctccagcatggtcaacggggtggtgaagctgctgaccaagccctgggacgtcatccccatggtgacgcagatcgccatgaccgacaccacccccttcggccagcagcgcgtgttcaaggagaaggtcgacacgcggaccccgaaggccaagcgcgggaccacccagatcatggaggtgacggcccggtggctctggggcttcctgtcccgcaacaagaagccccggatctgcacccgcgaggagttcacccggaaggtgcgcagcaacgcggccatcggcgccgtcttcgtggacgagaaccagtggaactccgccaaggaggcggtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacacggccggctgggacacccggatcaccgaggacgacctccagaacgaggccaagatcaccgacatcatggagccggagcacgccctgctggcgaaggccatcttcaagctcacgtaccagaacaaggtcgtgcgcgtgcagcgccccgccaagaacgggaccgtcatggacgtgatctcccggcgcgaccagcggggcagcggccaggtggggacctacggcctgaacaccttcacgaacatggaggcccagctgatccgccagatggagtccgaggggatcttcagcccctccgagctcgagacccccaacctggccgagcgggtcctggactggctcgagaagtacggcgtggagcgcctgaagcggatggcgatcagcggggacgactgcgtggtcaagccgatcgacgaccgcttcgccaccgccctgaccgccctcaacgacatgggcaaggtgcggaaggacatcccccagtgggagccctccaaggggtggaacgactggcagcaggtccccttctgcagccaccacttccaccagctgatcatgaaggacggccgcgagatcgtcgtgccgtgccggaaccaggacgagctggtgggccgcgcccgggtcagccagggggcgggctggtccctccgcgagacggcctgcctgggcaagagctacgcccagatgtggcagctgatgtacttccaccggcgcgacctccggctggccgcgaacgccatctgctccgccgtgcccgtggactgggtccccaccagccgcaccacctggtccatccacgcccaccaccagtggatgacgaccgaggacatgctgagcgtgtggaaccgggtgtggatcgaggagaacccctggatggaggacaagacccacatctccagctgggaggacgtcccgtacctcggcaagcgcgaggaccagtggtgcgggtccctgatcggcctgaccgcccgcgcgacgtgggccaccaacatccaggtggccatcaaccaggtgcggcgcctcatcggcaacgagaactacctggactacatgaccagcatgaagcggttcaagaacgagtccgaccccgagggggccctgtggtga

SEQ ID NO: 8880 - RNA, 9879 nt, synthetic construct
  misc_feature 1..9879: note = derived and/or modified CDS sequence (opt1) from DENV-1__KC762635__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgctcacctacaagtgcccccggatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctggggctcgagacgcgcaccgagacctggatgagctccgagggcgcctggcggcagatccagcgggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcagccgggacttcgtggaggggctgtccggcgccacgtgggtggacgtcgtgctggagcacgggagctgcgtgaccaccatggccaaggacaagcccaccctcgacatcgagctgctgaagacggaggtcaccaaccccgcggtgctccgcaagctgtgcatcgaggccaagatctccaacaccaccacggacagccggtgcccgacccagggcgaggccaccctggtggaggagcaggacgccaacttcgtctgccgccggaccttcgtggaccgcggctgggggaacggctgcgggctgttcggcaaggggtccctgatcacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccggacgggcctggacttcaacgagatggtcctgctcaccatgaaggagaagtcctggctggtgcacaagcagtggttcctggacctccccctgccctggaccagcggggccagcacctcccaggagacgtggaaccgccaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccggctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccgcctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccgccgcatggcgatcctgggcgacacggcctgggacttcgggtccatcggcggcgtgttcaccagcgtcgggaagctcgtgcaccagatcttcggcaccgcctacggggtgctgttctccggcgtcagctggaccatgaagatcgggatcggcgtgctgctcacgtggctgggcctgaactcccggagcacctccctcagcatgacctgcatcgccgtggggctggtcaccctgtacctcggcgtgatggtgcaggccgactccgggtgcgtcatcaactggaagggccgcgagctgaagtgcgggagcggcatcttcgtgacgaacgaggtgcacacctggaccgagcagtacaagttccaggcggacagcccgaagcggctgtccgccgccatcggcaaggcctgggaggagggggtctgcggcatccgcagcgccacccggctcgagaacatcatgtggaagcagatctccaacgagctgaaccacatcctgctcgagaacgacatgaagttcaccgtggtggtcggggacgtggcgggcatcctggcccaggggaagaagatgatccgcccccagcccatggagcacaagtacagctggaagtcctggggcaaggccaagatcatcggcgccgacgtgcagaacacgaccttcatcatcgacgggcccaacaccccggagtgccccgacgaccagcgggcgtggaacatctgggaggtcgaggactacggcttcgggatcttcaccacgaacatctggctgaagctccgcgacagctacacccaggtgtgcgaccaccggctgatgtccgccgccatcaaggacagcaaggccgtgcacgccgacatgggctactggatcgagtccgagaagaacgagacctggaagctggcgcgcgccagcttcatcgaggtcaagacctgcatctggcccaagtcccacacgctctggagcaacggcgtgctggagtccgagatgatcatccccaagatctacgggggcccgatcagccagcacaactaccggcccgggtacttcacccagaccgccggcccctggcacctggggaagctcgagctggacttcaacctgtgcgagggcaccacggtggtcgtggacgagcactgcggcaaccgcgggccgtccctccggaccaccaccgtgacgggcaagatcatccacgagtggtgctgccgcagctgcaccctgccgcccctgcggttccgcggggaggacggctgctggtacgggatggagatccggcccgtcaaggagaaggaggagaacctcgtgaagtccatggtgagcgccggcagcggcgaggtcgactccttcagcctggggctgctctgcatctccatcatgatcgaggaggtgatgcgcagccggtggtcccgcaagatgctgatgaccggcaccctggccgtgttcttcctcctgatcatggggcagctgacgtggaacgacctcatccgcctgtgcatcatggtcggcgcgaacgccagcgaccggatggggatgggcaccacctacctggccctcatggccaccttcaagatgcgcccgatgttcgccgtgggcctgctgttccggcgcctcacgtcccgggaggtgctgctgctcaccatcgggctgagcctggtcgcgtccgtggagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcctggaagaccatggcgatggtcctcagcatcgtgtccctgttccccctgtgcctcagcacgacctcccagaagaccacctggctgcccgtgctgctcggcagcctggggtgcaagccgctgacgatgttcctcatcgccgagaacaagatctggggccgcaagtcctggcccctgaacgaggggatcatggccgtcggcatcgtgagcatcctgctcagctccctgctgaagaacgacgtgcccctcgccgggcccctgatcgccggcggcatgctgatcgcgtgctacgtcatcagcgggtccagcgccgacctctccctggagaaggccgccgaggtgagctgggaggaggaggccgagcactccggcgcgagccacaacatcctggtggaggtccaggacgacgggaccatgaagatcaaggacgaggagcgggacgacaccctcaccatcctgctgaaggccaccctcctggccgtgtccggcgtgtacccgctgagcatccccgccaccctcttcgtctggtacttctggcagaagaagaagcagcgctccggggtgctgtgggacacccccagcccgcccgaggtggagcgggccgtcctggacgacggcatctaccgcatcatgcagcggggcctgctcgggcgctcccaggtgggcgtgggggtcttccaggagaacgtgttccacaccatgtggcacgtgacccggggcgcggtcctgatgtaccaggggaagcgcctggagcccagctgggcctccgtgaagaaggacctcatcagctacggcggcgggtggcggctgcagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgcgaggggaagatcgtgggcctctacggcaacggggtcgtgaccaccagcggcacctacgtgagcgccatcgcccaggccaaggcgtcccaggaggggccgctgcccgagatcgaggacgaggtcttccggaagcgcaacctgacgatcatggacctccaccccggcagcgggaagacccggcgctacctgccggccatcgtgcgggaggccatcaagcgcaagctgcgcaccctcatcctggcccccacccgggtggtcgcctccgagatggcggaggccctgaagggcatgcccatccgctaccagacgaccgccgtcaagagcgagcacaccggcaaggagatcgtggacctcatgtgccacgccaccttcacgatgcggctgctgtcccccgtccgcgtgccgaactacaacatgatcatcatggacgaggcccacttcaccgaccccagctccatcgcggcccgggggtacatcagcacccgcgtgggcatgggggaggccgccgccatcttcatgaccgcgacgccgcccggctccgtcgaggccttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctccggaagaacgggaagcgcgtgatccagctgtcccggaagaccttcgacacggagtaccagaagaccaagaacaacgactgggactacgtggtcaccaccgacatcagcgagatgggcgcgaacttccgcgccgaccgggtgatcgacccgcgccggtgcctgaagcccgtgatcctcaaggacgggcccgagcgcgtcatcctggccggccccatgccggtgacggtcgcctccgccgcgcagcggcgcgggcgggtgggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccggctccgcggcgaggcccggaagaccttcgtggagctgatgcgccgcggggacctgcccgtctggctctcctacaaggtggccagcgagggcttccagtacagcgaccgccggtggtgcttcgacggcgagcgcaacaaccaggtgctggaggagaacatggacgtcgagatctggacgaaggagggggagcggaagaagctgcgcccccggtggctcgacgcccgcacctactccgaccccctggccctgcgggagttcaaggagttcgcggccggccgccggagcgtgtccggggacctcatcctggagatcggcaagctgccgcagcacctcacccagcgcgcccagaacgccctggacaacctggtgatgctccacaacagcgagcagggcgggcgggcgtaccgccacgccatggaggagctgcccgacaccatcgagacgctgatgctcctggccctgatcgccgtcctcaccggcggggtgaccctgttcttcctgtccggccgggggctcggcaagaccagcatcggcctgctgtgcgtgatggcctccagcgtcctcctgtggatggcgtccgtggagccccactggatcgccgccagcatcatcctggagttcttcctcatggtgctgctgatccccgagccggaccgccagcggacgccccaggacaaccagctcgcctacgtcgtgatcgggctgctgttcatgatcctcacggtggccgcgaacgagatgggcctgctggagaccaccaagaaggacctcgggatcggccacgtcgccgtggagaaccaccaccacgccgccatgctggacgtggacctgcaccccgcctccgcgtggaccctctacgccgtcgccacgaccatcatcaccccgatgatgcgccacaccatcgagaacacgaccgccaacatcagcctgaccgccatcgcgaaccaggccgccatcctgatggggctcgacaagggctggcccatctccaagatggacatcggcgtgcccctgctggccctcgggtgctacagccaggtgaaccccctgaccctgacggcggccgtcctcatgctggtggcccactacgccatcatcggcccggggctgcaggccaaggcgacccgcgaggcccagaagcggaccgccgccggcatcatgaagaaccccaccgtggacgggatcgtcgccatcgacctcgaccccgtggtgtacgacgcgaagttcgagaagcagctgggccagatcatgctgctcatcctgtgcacgtcccagatcctgctcatgcgcaccacctgggccctgtgcgagagcatcaccctggccacgggccccctcaccaccctgtgggaggggtccccgggcaagttctggaacaccacgatcgccgtcagcatggccaacatcttccgggggtcctacctggcgggcgccggcctcgccttcagcctgatgaagtccctcgggggcgggcgccgggggaccggggcccagggcgagaccctcggcgagaagtggaagcgccagctgaaccagctgtccaagagcgagttcaacacctacaagcggtccgggatcatggaggtggaccgcagcgaggcgaaggagggcctcaagcgcggggagacgaccaagcacgccgtgtcccgcggcaccgccaagctgcggtggttcgtcgagcgcaacctggtgaagcccgaggggaaggtgatcgacctgggctgcggccgcggcgggtggagctactactgcgccgggctcaagaaggtcaccgaggtgaaggggtacacgaagggcgggcccggccacgaggagcccatcccgatggccacctacgggtggaacctggtgaagctgcactccggcaaggacgtcttcttcatcccgcccgagaagtgcgacaccctcctgtgcgacatcggggagagctcccccaacccgaccatcgaggagggccgcacgctgcgggtgctcaagatggtggagccctggctgcgcgggaaccagttctgcatcaagatcctgaacccctacatgcccagcgtcgtggagaccctcgagcagatgcagcggaagcacggcggcatgctggtgcgcaacccgctgtcccggaacagcacccacgagatgtactgggtctcctgcgggaccggcaacatcgtgagcgcggtgaacatgacctcccgcatgctcctgaaccgcttcacgatggcccaccggaagcccacctacgagcgcgacgtcgacctgggggccggcacccggcacgtggccgtggagcccgaggtcgccaacctcgacatcatcggccagcgcatcgagaacatcaagcacgagcacaagagcacctggcactacgacgaggacaacccctacaagacgtgggcgtaccacgggtcctacgaggtgaagccgagcggctccgccagcagcatggtcaacggggtggtgaagctgctgaccaagccctgggacgtcatccccatggtgacccagatcgccatgaccgacacgacccccttcggccagcagcgggtgttcaaggagaaggtcgacacccgcaccccgaaggccaagcgggggacgacccagatcatggaggtgaccgcccgctggctctggggcttcctgtcccggaacaagaagccccgcatctgcacccgggaggagttcacgcgcaaggtgcggagcaacgcggccatcggcgccgtcttcgtggacgagaaccagtggaactccgccaaggaggcggtggaggacgagcgcttctgggacctggtccaccgggagcgcgagctccacaagcaggggaagtgcgcgacctgcgtgtacaacatgatgggcaagcgggagaagaagctgggggagttcggcaaggccaaggggagccgcgccatctggtacatgtggctgggcgcccggttcctcgagttcgaggcgctgggcttcatgaacgaggaccactggttctcccgcgagaacagcctgtccggggtggagggcgaggggctccacaagctgggctacatcctgcgggacatcagcaagatccccgggggcaacatgtacgccgacgacaccgccggctgggacacccgcatcacggaggacgacctccagaacgaggccaagatcaccgacatcatggagccggagcacgccctgctggcgaaggccatcttcaagctcacctaccagaacaaggtcgtgcgcgtgcagcggcccgccaagaacgggaccgtcatggacgtgatctcccgccgggaccagcgcggcagcggccaggtgggcacgtacggcctgaacaccttcaccaacatggaggcccagctgatccggcagatggagtccgaggggatcttcagcccctccgagctcgagacccccaacctggccgagcgcgtcctggactggctcgagaagtacggcgtggagcggctgaagcgcatggcgatcagcggggacgactgcgtggtcaagccgatcgacgaccggttcgccacggccctgaccgccctcaacgacatgggcaaggtgcgcaaggacatcccccagtgggagccctccaaggggtggaacgactggcagcaggtccccttctgcagccaccacttccaccagctgatcatgaaggacggccgggagatcgtcgtgccgtgccgcaaccaggacgagctggtgggccgggcccgcgtctcccagggggcgggctggagcctccgggagaccgcctgcctgggcaagagctacgcccagatgtggcagctgatgtacttccaccgccgggacctccgcctggccgcgaacgccatctgctccgccgtgcccgtggactgggtccccaccagccggacgacctggtccatccacgcccaccaccagtggatgaccaccgaggacatgctgagcgtgtggaaccgcgtgtggatcgaggagaacccctggatggaggacaagacgcacatctccagctgggaggacgtcccgtacctcggcaagcgcgaggaccagtggtgcgggtccctgatcggcctgaccgcccgggcgacctgggccaccaacatccaggtggccatcaaccaggtgcgccggctcatcggcaacgagaactacctggactacatgaccagcatgaagcgcttcaagaacgagtccgaccccgagggggccctgtggtga

SEQ ID NO: 8881 - RNA, 9879 nt, synthetic construct
  misc_feature 1..9879: note = derived and/or modified CDS sequence (opt1) from DENV-1__KC762650__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgctcacctacaagtgcccccggatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctggggctcgagacgcgcaccgagacctggatgagctccgagggcgcctggcggcagatccagcgggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcagccgggacttcgtggaggggctgtccggcgccacgtgggtggacgtcgtgctggagcacgggagctgcgtgaccaccatggccaaggacaagcccaccctcgacatcgagctgctgaagacggaggtcaccaaccccgcggtgctccgcaagctgtgcatcgaggccaagatctccaacaccaccacggacagccggtgcccgacccagggcgaggccaccctggtggaggagcaggacgccaacttcgtctgccgccggaccttcgtggaccgcggctgggggaacggctgcgggctgttcggcaaggggtccctgatcacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccggacgggcctggacttcaacgagatggtcctgctcaccatgaaggagaagtcctggctggtgcacaagcagtggttcctggacctccccctgccctggaccagcggggccagcacctcccaggagacgtggaaccgccaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccggctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccgcctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccgccgcatggcgatcctgggcgacacggcctgggacttcgggtccatcggcggcgtgttcaccagcgtcgggaagctcgtgcaccagatcttcggcaccgcctacggggtgctgttctccggcgtcagctggaccatgaagatcgggatcggcgtgctgctcacgtggctgggcctgaactcccggagcacctccctcagcatgacctgcatcgccgtggggctggtcaccctgtacctcggcgtgatggtgcaggccgactccgggtgcgtcatcaactggaagggccgcgagctgaagtgcgggagcggcatcttcgtgacgaacgaggtgcacacctggaccgagcagtacaagttccaggcggacagcccgaagcggctgtccgccgccatcggcaaggcctgggaggagggggtctgcggcatccgcagcgccacccggctcgagaacatcatgtggaagcagatctccaacgagctgaaccacatcctgctcgagaacgacatgaagttcaccgtggtggtcggggacgtggcgggcatcctggcccaggggaagaagatgatccgcccccagcccatggagcacaagtacagctggaagtcctggggcaaggccaagatcatcggcgccgacgtgcagaacacgaccttcatcatcgacgggcccaacaccccggagtgccccgacgaccagcgggcgtggaacatctgggaggtcgaggactacggcttcgggatcttcaccacgaacatctggctgaagctccgcgacagctacacccaggtgtgcgaccaccggctgatgtccgccgccatcaaggacagcaaggccgtgcacgccgacatgggctactggatcgagtccgagaagaacgagacctggaagctggcgcgcgccagcttcatcgaggtcaagacctgcatctggcccaagtcccacacgctctggagcaacggcgtgctggagtccgagatgatcatccccaagatctacgggggcccgatcagccagcacaactaccggcccgggtacttcacccagaccgccggcccctggcacctggggaagctcgagctggacttcaacctgtgcgagggcaccacggtggtcgtggacgagcactgcggcaaccgcgggccgtccctccggaccaccaccgtgacgggcaagatcatccacgagtggtgctgccgcagctgcaccctgccgcccctgcggttccgcggggaggacggctgctggtacgggatggagatccggcccgtcaaggagaaggaggagaacctcgtgaagtccatggtgagcgccggcagcggcgaggtcgactccttcagcctggggctgctctgcatctccatcatgatcgaggaggtgatgcgcagccggtggtcccgcaagatgctgatgaccggcaccctggccgtgttcttcctcctgatcatggggcagctgacgtggaacgacctcatccgcctgtgcatcatggtcggcgcgaacgccagcgaccggatggggatgggcaccacctacctggccctcatggccaccttcaagatgcgcccgatgttcgccgtgggcctgctgttccggcgcctcacgtcccgggaggtgctgctgctcaccatcgggctgagcctggtcgcgtccgtggagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcctggaagaccatggcgatggtcctcagcatcgtgtccctgttccccctgtgcctcagcacgacctcccagaagaccacctggctgcccgtgctgctcggcagcctggggtgcaagccgctgacgatgttcctcatcgccgagaacaagatctggggccgcaagtcctggcccctgaacgaggggatcatggccgtcggcatcgtgagcatcctgctcagctccctgctgaagaacgacgtgcccctcgccgggcccctgatcgccggcggcatgctgatcgcgtgctacgtcatcagcgggtccagcgccgacctctccctggagaaggccgccgaggtgagctgggaggaggaggccgagcactccggcgcgagccacaacatcctggtggaggtccaggacgacgggaccatgaagatcaaggacgaggagcgggacgacaccctcaccatcctgctgaaggccaccctcctggccgtgtccggcgtgtacccgctgagcatccccgccaccctcttcgtctggtacttctggcagaagaagaagcagcgctccggggtgctgtgggacacccccagcccgcccgaggtggagcgggccgtcctggacgacggcatctaccgcatcatgcagcggggcctgctcgggcgctcccaggtgggcgtgggggtcttccaggagaacgtgttccacaccatgtggcacgtgacccggggcgcggtcctgatgtaccaggggaagcgcctggagcccagctgggcctccgtgaagaaggacctcatcagctacggcggcgggtggcggctgcagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgcgaggggaagatcgtgggcctctacggcaacggggtcgtgaccaccagcggcacctacgtgagcgccatcgcccaggccaaggcgtcccaggaggggccgctgcccgagatcgaggacgaggtcttccggaagcgcaacctgacgatcatggacctccaccccggcagcgggaagacccggcgctacctgccggccatcgtgcgggaggccatcaagcgcaagctgcgcaccctcatcctggcccccacccgggtggtcgcctccgagatggcggaggccctgaagggcatgcccatccgctaccagacgaccgccgtcaagagcgagcacaccggcaaggagatcgtggacctcatgtgccacgccaccttcacgatgcggctgctgtcccccgtccgcgtgccgaactacaacatgatcatcatggacgaggcccacttcaccgaccccagctccatcgcggcccgggggtacatcagcacccgcgtgggcatgggggaggccgccgccatcttcatgaccgcgacgccgcccggctccgtcgaggccttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctccggaagaacgggaagcgcgtgatccagctgtcccggaagaccttcgacacggagtaccagaagaccaagaacaacgactgggactacgtggtcaccaccgacatcagcgagatgggcgcgaacttccgcgccgaccgggtgatcgacccgcgccggtgcctgaagcccgtgatcctcaaggacgggcccgagcgcgtcatcctggccggccccatgccggtgacggtcgcctccgccgcgcagcggcgcgggcgggtgggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccggctccgcggcgaggcccggaagaccttcgtggagctgatgcgccgcggggacctgcccgtctggctctcctacaaggtggccagcgagggcttccagtacagcgaccgccggtggtgcttcgacggcgagcgcaacaaccaggtgctggaggagaacatggacgtcgagatctggacgaaggagggggagcggaagaagctgcgcccccggtggctcgacgcccgcacctactccgaccccctggccctgcgggagttcaaggagttcgcggccggccgccggagcgtgtccggggacctcatcctggagatcggcaagctgccgcagcacctcacccagcgcgcccagaacgccctggacaacctggtgatgctccacaacagcgagcagggcgggcgggcgtaccgccacgccatcgaggagctgcccgacaccatcgagacgctgatgctcctggccctgatcgccgtcctcaccggcggggtgaccctgttcttcctgtccggccgggggctcggcaagaccagcatcggcctgctgtgcgtgatggcctccagcgtcctcctgtggatggcgtccgtggagccccactggatcgccgccagcatcatcctggagttcttcctcatggtgctgctgatccccgagccggaccgccagcggacgccccaggacaaccagctcgcctacgtcgtgatcgggctgctgttcatgatcctcacggtggccgcgaacgagatgggcctgctggagaccaccaagaaggacctcgggatcggccacgtcgccgtggagaaccaccaccacgccgccatgctggacgtggacctgcaccccgcctccgcgtggaccctctacgccgtcgccacgaccatcatcaccccgatgatgcgccacaccatcgagaacacgaccgccaacatcagcctgaccgccatcgcgaaccaggccgccatcctgatggggctcgacaagggctggcccatctccaagatggacatcggcgtgcccctgctggccctcgggtgctacagccaggtgaaccccctgaccctgacggcggccgtcctcatgctggtggcccactacgccatcatcggcccggggctgcaggccaaggcgacccgcgaggcccagaagcggaccgccgccggcatcatgaagaaccccaccgtggacgggatcgtcgccatcgacctcgaccccgtggtgtacgacgcgaagttcgagaagcagctgggccagatcatgctgctcatcctgtgcacgtcccagatcctgctcatgcgcaccacctgggccctgtgcgagagcatcaccctggccacgggccccctcaccaccctgtgggaggggtccccgggcaagttctggaacaccacgatcgccgtcagcatggccaacatcttccgggggtcctacctggcgggcgccggcctcgccttcagcctgatgaagtccctcgggggcgggcgccgggggaccggggcccagggcgagaccctcggcgagaagtggaagcgccagctgaaccagctgtccaagagcgagttcaacacctacaagcggtccgggatcatggaggtggaccgcagcgaggcgaaggagggcctcaagcgcggggagacgaccaagcacgccgtgtcccgcggcaccgccaagctgcggtggttcgtcgagcgcaacctggtgaagcccgaggggaaggtgatcgacctgggctgcggccgcggcgggtggagctactactgcgccgggctcaagaaggtcaccgaggtgaaggggtacacgaagggcgggcccggccacgaggagcccatcccgatggccacctacgggtggaacctggtgaagctgcactccggcaaggacgtcttcttcatcccgcccgagaagtgcgacaccctcctgtgcgacatcggggagagctcccccaacccgaccatcgaggagggccgcacgctgcgggtgctcaagatggtggagccctggctgcgcgggaaccagttctgcatcaagatcctgaacccctacatgcccagcgtcgtggagaccctcgagcagatgcagcggaagcacggcggcatgctggtgcgcaacccgctgtcccggaacagcacccacgagatgtactgggtctcctgcgggaccggcaacatcgtgagcgcggtgaacatgacctcccgcatgctcctgaaccgcttcacgatggcccaccggaagcccacctacgagcgcgacgtcgacctgggggccggcacccggcacgtggccgtggagcccgaggtcgccaacctcgacatcatcggccagcgcatcgagaacatcaagcacgagcacaagagcacctggcactacgacgaggacaacccctacaagacgtgggcgtaccacgggtcctacgaggtgaagccgagcggctccgccagcagcatggtcaacggggtggtgaagctgctgaccaagccctgggacgtcatccccatggtgacccagatcgccatgaccgacacgacccccttcggccagcagcgggtgttcaaggagaaggtcgacacccgcaccccgaaggccaagcgggggacgacccagatcatggaggtgaccgcccgctggctctggggcttcctgtcccggaacaagaagccccgcatctgcacccgggaggagttcacgcgcaaggtgcggagcaacgcggccatcggcgccgtcttcgtggacgagaaccagtggaactccgccaaggaggcggtggaggacgagcgcttctgggacctggtccaccgggagcgcgagctccacaagcaggggaagtgcgcgacctgcgtgtacaacatgatgggcaagcgggagaagaagctgggggagttcggcaaggccaaggggagccgcgccatctggtacatgtggctgggcgcccggttcctcgagttcgaggcgctgggcttcatgaacgaggaccactggttctcccgcgagaacagcctgtccggggtggagggcgaggggctccacaagctgggctacatcctgcgggacatcagcaagatccccgggggcaacatgtacgccgacgacaccgccggctgggacacccgcatcacggaggacgacctccagaacgaggccaagatcaccgacatcatggagccggagcacgccctgctggcgaaggccatcttcaagctcacctaccagaacaaggtcgtgcgcgtgcagcggcccgccaagaacgggaccgtcatggacgtgatctcccgccgggaccagcgcggcagcggccaggtgggcacgtacggcctgaacaccttcaccaacatggaggcccagctgatccggcagatggagtccgaggggatcttcagcccctccgagctcgagacccccaacctggccgagcgcgtcctggactggctcgagaagtacggcgtggagcggctgaagcgcatggcgatcagcggggacgactgcgtggtcaagccgatcgacgaccggttcgccacggccctgaccgccctcaacgacatgggcaaggtgcgcaaggacatcccccagtgggagccctccaaggggtggaacgactggcagcaggtccccttctgcagccaccacttccaccagctgatcatgaaggacggccgggagatcgtcgtgccgtgccgcaaccaggacgagctggtgggccgggcccgcgtctcccagggggcgggctggagcctccgggagaccgcctgcctgggcaagagctacgcccagatgtggcagctgatgtacttccaccgccgggacctccgcctggccgcgaacgccatctgctccgccgtgcccgtggactgggtccccaccagccggacgacctggtccatccacgcccaccaccagtggatgaccaccgaggacatgctgagcgtgtggaaccgcgtgtggatcgaggagaacccctggatggaggacaagacgcacatctccagctgggaggacgtcccgtacctcggcaagcgcgaggaccagtggtgcgggtccctgatcggcctgaccgcccgggcgacctgggccaccaacatccaggtggccatcaaccaggtgcgccggctcatcggcaacgagaactacctggactacatgaccagcatgaagcgcttcaagaacgagtccgaccccgagggggccctgtggtga

SEQ ID NO: 8882 - RNA, 9879 nt, synthetic construct
  misc_feature 1..9879: note = derived and/or modified CDS sequence (opt1) from DENV-1__KC762623__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggggagctgtgcgaggacaccctcacctacaagtgcccccgcatcaccgaggccgagcccgacgacgtggactgctggtgcaacgccaccgacacctgggtgacctacgggacctgcagccagaccggggagcaccggcgcgacaagcggagcgtggccctggcgccccacgtgggcctggggctcgagacgcgcaccgagacctggatgagctccgagggcgcctggaagcagatccagcgggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcagccgcgacttcgtggaggggctgtccggcgccacgtgggtggacgtcgtgctggagcacgggagctgcgtgaccaccatggccaaggacaagcccaccctcgacatcgagctgctgaagacggaggtcaccaaccccgcggtgctccggaagctgtgcatcgaggccaagatctccaacaccaccacggacagccgctgcccgacccagggcgaggccaccctggtggaggagcaggacgccaacttcgtctgccggcgcaccttcgtggaccggggctgggggaacggctgcggcctgttcggcaaggggtccctgatcacgtgcgccaagttcaagtgcgtgagcaagctggagggcaagatcgtccagtacgagaacctcaagtactccgtgatcgtgaccgtccacaccggcgaccagcaccaggtggggaacgagagcaccgagcacggcacgaccgcgaccatcacgccccaggcccccaccacggagatccagctgaccgactacggggccctgaccctcgactgcagcccccggaccggcctggacttcaacgagatggtcctgctcacgatgaaggagaagtcctggctggtgcacaagcagtggttcctggacctccccctgccctggaccagcggggcctccaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctcaagctgtcctggttcaagaaggggagctccatcggcaagatgttcgaggccaccgcccgcggggcccggcgcatggcgatcctgggcgacaccgcctgggacttcgggagcatcggcggcgtgttcacgtccgtcgggaagctcgtgcaccagatcttcggcaccgcctacggggtgctgttcagcggcgtctcctggaccatgaagatcgggatcggcgtgctgctcacctggctgggcctgaacagccgctccacgagcctctccatgacctgcatcgccgtggggctggtcaccctgtacctcggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctgagcgccgccatcggcaaggcctgggaggagggggtctgcggcatccggtccgccacccgcctcgagaacatcatgtggaagcagatcagcaacgagctgaaccacatcctgctcgagaacgacatgaagttcaccgtggtggtcggggacgtggcgggcatcctggcccaggggaagaagatgatccggccccagcccatggagcacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctccgggactcctacacccaggtgtgcgaccaccgcctgatgagcgccgccatcaaggactccaaggccgtgcacgccgacatgggctactggatcgagagcgagaagaacgagacgtggaagctggcgcgggcctccttcatcgaggtcaagagctgcatctggcccaagtcccacaccctctggagcaacggcgtgctggagtccgagatgatcatccccaagatctacgggggcccgatcagccagcacaactaccgccccgggtacttcacccagacggccggcccctggcacctggggaagctcgagctggacttcgacctgtgcgagggcaccaccgtggtcgtggacgagcactgcggcaaccgggggccgtccctccgcaccacgaccgtgaccggcaagatcatccacgagtggtgctgccggagctgcaccctgccgcccctgcgcttccgcggggaggacggctgctggtacgggatggagatccgccccgtcaaggagaaggaggagaacctcgtcaagagcatggtgtccgccggcagcggcgaggtcgactccttcagcctggggctgctctgcatctccatcatgatcgaggaggtgatgcggagccgctggtcccggaagatgctgatgacgggcaccctggccgtgttcttcctcctgatcatggggcagctgacctggaacgacctcatccgcctgtgcatcatggtcggcgcgaacgccagcgaccgcatggggatgggcaccacgtacctggccctcatggccaccttcaagatgcggccgatgttcgccgtgggcctgctgttccgccggctcacctcccgcgaggtgctgctgctcaccatcgggctgagcctggtcgcgtccgtggagctccccaacagcctggaggagctgggcgacgggctcgccatgggcatcatgatcctgaagctgctcacggacttccagtcccaccagctgtgggccaccctgctcagcctgaccttcatcaagaccacgttctccctgcactacgcctggaagaccatggcgatggtcctcagcatcgtgtccctgttccccctgtgcctcagcaccacctcccagaagacgacctggctgcccgtgctgctcggcagcctggggtgcaagccgctgaccatgttcctcatcgccgagaacaagatctggggccgcaagagctggcccctgaacgaggggatcatggccgtcggcatcgtgtccatcctgctcagctccctgctgaagaacgacgtgcccctcgccgggcccctgatcgccggcggcatgctgatcgcgtgctacgtcatcagcgggtccagcgccgacctctccctggagaaggccgccgaggtgagctgggaggaggaggccgagcactccggcgcgagccacaacatcctggtggaggtccaggacgacgggaccatgaagatcaaggacgaggagcgcgacgacacgctcaccatcctgctgaaggccaccctcctggccgtgtccggcgtgtacccgctgagcatccccgccaccctcttcctgtggtacttctggcagaagaagaagcagcggtccggggtcctgtgggacacccccagcccgcccgaggtggagcgcgccgtgctggacgacggcatctaccggatcatgcagcgcggcctcctggggcggtcccaggtcggcgtgggggtgttccaggagaacgtcttccacacgatgtggcacgtgacccgcggcgcggtgctgatgtaccaggggaagcggctcgagcccagctgggcctccgtcaagaaggacctgatcagctacggcggcgggtggcgcctgcagggctcctggaacaccggggaggaggtccaggtgatcgccgtcgagcccggcaagaaccccaagaacgtgcagaccgcccccgggacgttcaagacccccgagggcgaggtgggcgccatcgcgctcgacttcaagcccgggaccagcggcagccccatcgtcaaccgggaggggaagatcgtgggcctgtacggcaacggggtggtcaccacgtccggcacctacgtgagcgccatcgcccaggccaaggcgtcccaggaggggccgctgcccgagatcgaggacgaggtgttccgcaagcggaacctcaccatcatggacctgcaccccggcagcgggaagacccgccggtacctgccggccatcgtccgcgaggccatcaagcggaagctccgcacgctgatcctggcccccacccgcgtggtggcctccgagatggcggaggccctcaagggcatgcccatccggtaccagaccaccgccgtcaagagcgagcacacgggcaaggagatcgtggacctgatgtgccacgccaccttcaccatgcgcctgctctcccccgtgcgggtcccgaactacaacatgatcatcatggacgaggcccacttcaccgaccccagctccatcgcggcccgcgggtacatcagcacgcgggtgggcatgggggaggccgccgccatcttcatgaccgcgacgccgcccggctccgtggaggccttcccgcagagcaacgccgtcatccaggacgaggagcgcgacatccccgagcggtcctggaacagcgggtacgagtggatcaccgacttccccggcaagacggtgtggttcgtgccctccatcaagagcggcaacgacatcgccaactgcctgcgcaagaacgggaagcgggtcatccagctgtcccgcaagaccttcgacaccgagtaccagaagaccaagaacaacgactgggactacgtggtgacgaccgacatcagcgagatgggcgcgaacttccgggccgaccgcgtcatcgacccgcggcgctgcctcaagcccgtgatcctgaaggacgggcccgagcgggtgatcctggccggccccatgccggtcaccgtggcctccgccgcgcagcgccgggggcgcgtcggccggaaccacaacaaggagggcgaccagtacatctacatggggcagcccctcaacaacgacgaggaccacgcccactggaccgaggccaagatgctgctggacaacatcaacacgcccgagggcatcatccccgccctcttcgagccggagcgcgagaagtccgccgcgatcgacggggagtaccgcctgcggggcgaggcccgcaagaccttcgtggagctgatgcggcgcggggacctccccgtgtggctgagctacaaggtcgcctccgagggcttccagtacagcgaccggcgctggtgcttcgacggcgagcggaacaaccaggtgctggaggagaacatggacgtggagatctggaccaaggagggggagcgcaagaagctccggccccgctggctggacgcccggacctactccgaccccctggccctccgcgagttcaaggagttcgcggccggccggcgcagcgtctccggggacctgatcctggagatcggcaagctcccgcagcacctgacgcagcgggcccagaacgccctggacaacctcgtgatgctgcacaacagcgagcagggcgggcgcgcgtaccggcacgccatggaggagctgcccgacaccatcgagaccctcatgctgctggccctcatcgccgtgctgaccggcggggtcacgctgttcttcctctccggccgcgggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagccggaccggcagcgcacgccccaggacaaccagctggcctacgtggtcatcgggctcctcttcatgatcctgaccgtggccgcgaacgagatgggcctgctcgagaccacgaagaaggacctggggatcggccacgtggccgtcgagaaccaccaccacgccgccatgctggacgtggacctccaccccgcctccgcgtggaccctgtacgccgtggccaccaccatcatcacgccgatgatgcggcacaccatcgagaacaccaccgccaacatcagcctgacggccatcgcgaaccaggccgccatcctcatggggctggacaagggctggcccatctccaagatggacatcggcgtccccctgctcgccctggggtgctacagccaggtgaaccccctgaccctcaccgcggccgtgctgatgctggtcgcccactacgccatcatcggcccggggctccaggccaaggcgacccgcgaggcccagaagcgcacggccgccggcatcatgaagaaccccaccgtggacgggatcgtggccatcgacctggaccccgtcgtgtacgacgcgaagttcgagaagcagctgggccagatcatgctcctgatcctgtgcacctcccagatcctcctgatgcggaccacgtgggccctgtgcgagagcatcaccctcgccaccggccccctgaccacgctgtgggaggggtccccgggcaagttctggaacaccaccatcgccgtgagcatggccaacatcttccgcgggagctacctcgcgggcgccggcctggccttctccctgatgaagtccctcgggggcgggcggcgcggcaccggggcccagggcgagacgctgggcgagaagtggaagcggcagctgaaccagctctccaagagcgagttcaacacctacaagcgctccgggatcatggaggtcgaccggagcgaggcgaaggagggcctgaagcgcggggagaccaccaagcacgccgtgtcccggggcacggccaagctgcgctggttcgtggagcggaacctggtcaagcccgaggggaaggtgatcgacctcggctgcggccgcgggggctggagctactactgcgccgggctgaagaaggtgaccgaggtcaagggctacaccaagggcgggcccggccacgaggagcccatcccgatggccacctacgggtggaacctggtgaagctccactccggcaaggacgtgttcttcatcccgcccgagaagtgcgacacgctgctgtgcgacatcggggagagctcccccaacccgaccatcgaggagggccggaccctccgcgtcctgaagatggtggagccctggctgcgggggaaccagttctgcatcaagatcctcaacccctacatgcccagcgtggtcgagaccctggagcagatgcagcgcaagcacggcggcatgctggtgcggaacccgctctcccgcaacagcacgcacgagatgtactgggtgtcctgcgggaccggcaacatcgtcagcgcggtgaacatgacctcccggatgctgctgaaccgcttcaccatggcccaccgcaagcccacctacgagcgggacgtggacctcggggccggcacgcgccacgtcgccgtggagcccgaggtggccaacctggacatcatcggccagcggatcgagaacatcaagcacgagcacaagagcacctggcactacgacgaggacaacccctacaagacctgggcgtaccacgggtcctacgaggtcaagccgagcggcagcgcctccagcatggtgaacggggtcgtgaagctgctcaccaagccctgggacgtgatccccatggtcacgcagatcgccatgaccgacaccacccccttcggccagcagcgcgtgttcaaggagaaggtggacacgcggaccccgaaggccaagcgcgggaccacccagatcatggaggtcacggcccggtggctgtggggcttcctgtcccgcaacaagaagccccggatctgcacccgcgaggagttcacccggaaggtgcgcagcaacgcggccatcggcgccgtgttcgtcgacgagaaccagtggaactccgccaaggaggcggtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggagccgggccatctggtacatgtggctcggcgcccgcttcctggagttcgaggcgctgggcttcatgaacgaggaccactggttctcccgggagaacagcctctccggggtggagggcgaggggctgcacaagctgggctacatcctccgcgacatcagcaagatccccgggggcaacatgtacgccgacgacacggccggctgggacacccggatcaccgaggacgacctgcagaacgaggccaagatcaccgacatcatggagccggagcacgccctgctcgcgaaggccatcttcaagctgacgtaccagaacaaggtggtccgcgtgcagcgccccgccaagaacgggaccgtgatggacgtcatctcccggcgcgaccagcggggcagcggccaggtggggacctacggcctgaacaccttcacgaacatggaggcccagctcatccgccagatggagtccgaggggatcttcagcccctccgagctggagacccccaacctggccgagcgggtgctcgactggctggagaagtacggcgtcgagcgcctgaagcggatggcgatcagcggggacgactgcgtggtgaagccgatcgacgaccgcttcgccaccgccctcaccgccctgaacgacatgggcaaggtccggaaggacatcccccagtgggagccctccaaggggtggaacgactggcagcaggtccccttctgcagccaccacttccaccagctgatcatgaaggacggccgcgagatcgtggtcccgtgccggaaccaggacgagctcgtgggccgcgcccgggtgagccagggggcgggctggtccctgcgcgagacggcctgcctgggcaagagctacgcccagatgtggcagctcatgtacttccaccggcgcgacctgcggctggccgcgaacgccatctgctccgccgtccccgtggactgggtgcccaccagccgcaccacctggtccatccacgcccaccaccagtggatgacgaccgaggacatgctcagcgtctggaaccgggtgtggatcgaggagaacccctggatggaggacaagacccacatctccagctgggaggacgtgccgtacctgggcaagcgcgaggaccagtggtgcgggtccctgatcggcctcaccgcccgcgcgacgtgggccaccaacatccaggtcgccatcaaccaggtgcggcgcctgatcggcaacgagaactacctggactacatgaccagcatgaagcggttcaagaacgagtccgaccccgagggggccctctggtga

SEQ ID NO: 8883 - RNA, 9879 nt, synthetic construct
  misc_feature 1..9879: note = derived and/or modified CDS sequence (opt1) from DENV-1__KC762632__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacaccctcacctacaagtgcccccggatcaccgaggccgagcccgacgacgtggactgctggtgcaacgccaccgacacctgggtgacctacgggacctgcagccagaccggcgagcaccggcgggacaagcggtccgtggccctggcgccccacgtgggcctggggctcgagacccgcaccgagacctggatgagctccgagggcgcctggcggcagatgcagcgggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcagccgggacttcgtggaggggctgtccggcgccacgtgggtggacgtcgtgctggagcacgggagctgcgtgaccaccatggccaaggacaagcccaccctcgacatcgagctgctgaagacggaggtcaccaaccccgcggtgctccgcaagctgtgcatcgaggccaagatctccaacatcaccaccgacagccggtgcccgacgcagggcgaggccaccctggtggaggagcaggacgccaacttcgtctgccgccggaccttcgtggaccgcggctgggggaacggctgcgggctgttcggcaaggggtccctgatcacgtgcgccaagttcaagtgcgtgacgaagctggagggcaagatcgtccagtacgagaacctcaagtacagcgtgatcgtgaccgtccacaccggcgaccagcaccaggtggggaacgagtccaccgagcacggcacgaccgcgaccatcacgccccaggcccccaccacggagatccagctgaccgactacggggccctgaccctcgactgcagcccccggaccggcctggacttcaacgagatggtcctgctcacgatgaaggagaagtcctggctggtgcacaagcagtggttcctggacctccccctgccctggaccagcggggccagcacctcccaggagacctggaaccgccaggacctgctcgtgacgttcaagaccgcccacgcgaagaagcaggaggtcgtggtgctgggcagccaggagggcgccatgcacaccgccctgaccggggccacggagatccagacctccggcaccaccacgatcttcgccgggcacctcaagtgccggctgaagatggacaagctgaccctcaagggcatgagctacgtcatgtgcaccgggtccttcaagctggagaaggaggtggcggagacccagcacggcacggtgctggtccagatcaagtacgagggcaccgacgccccctgcaagatccccttcagcacccaggacgagaagggggtgacccagaacggccgcctgatcacggccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccgccgcatggcgatcctgggcgacaccgcctgggacttcgggtccatcggcggcgtgttcacgagcgtcgggaagctcgtgcaccagatcttcggcaccgcctacggggtgctgttctccggcgtcagctggaccatgaagatcgggatcggcgtgctgctcacctggctgggcctgaactcccggagcacgtccctcagcatgacctgcatcgccgtggggctggtcaccctgtacctcggcgtgatggtgcaggccgactccgggtgcgtcatcaactggaagggccgcgagctgaagtgcgggagcggcatcttcgtgaccaacgaggtgcacacgtggaccgagcagtacaagttccaggcggacagcccgaagcggctgtccgccgccatcggcaaggcctgggaggagggggtctgcggcatccgcagcgccacccggctcgagaacatcatgtggaagcagatctccaacgagctgaaccacatcctgctcgagaacgacatgaagttcaccgtggtggtcggggacgtggcgggcatcctggcccaggggaagaagatgatccgcccccagcccatggagcacaagtacagctggaagtcctggggcaaggccaagatcatcggcgccgacgtgcagaacaccacgttcatcatcgacgggcccaacaccccggagtgccccgacgaccagcgggcgtggaacatctgggaggtcgaggactacggcttcgggatcttcaccaccaacatctggctgaagctccgcgacagctacacccaggtgtgcgaccaccggctgatgtccgccgccatcaaggacagcaaggccgtgcacgccgacatgggctactggatcgagtccgagaagaacgagacgtggaagctggcgcgcgccagcttcatcgaggtcaagacctgcatctggcccaagtcccacaccctctggagcaacggcgtgctggagtccgagatgatcatccccaagatctacgggggcccgatcagccagcacaactaccggcccgggtacttcacgcagaccgccggcccctggcacctggggaagctcgagctggacttcaacctgtgcgagggcaccaccgtggtcgtggacgagcactgcggcaaccgcgggccgtccctccggacgaccaccgtgaccggcaagatcatccacgagtggtgctgccgcagctgcacgctgccgcccctgcggttccgcggggaggacggctgctggtacgggatggagatccggcccgtcaaggagaaggaggagaacctcgtgaagtccatggtgagcgccggcagcggcgaggtcgactccttcagcctggggctgctctgcatctccatcatgatcgaggaggtgatgcgcagccggtggtcccgcaagatgctgatgaccggcaccctggccgtgttcttcctcctgatcatggggcagctgacctggaacgacctcatccgcctgtgcatcatggtcggcgcgaacgccagcgaccggatggggatgggcacgacctacctggccctcatggccaccttcaagatgcgcccgatgttcgccgtgggcctgctgttccggcgcctcacctcccgggaggtgctgctgctcacgatcgggctgagcctggtcgcgtccgtggagctccccaacagcctggaggagctgggcgacgggctcgccatgggcatcatgatcctgaagctgctcaccgacttccagtcccaccagctgtgggccaccctgctcagcctgaccttcatcaagacgaccttctccctgcactacgcctggaagaccatggcgatggtcctcagcatcgtgtccctgttccccctgtgcctcagcaccacgtcccagaagaccacctggctgcccgtgctgctcggcagcctggggtgcaagccgctgaccatgttcctcatcgccgagaacaagatctggggccgcaagtcctggcccctgaacgaggggatcatggccgtcggcatcgtgagcatcctgctcagctccctgctgaagaacgacgtgcccctcgccgggcccctgatcgccggcggcatgctgatcgcgtgctacgtcatcagcgggtccagcgccgacctctccctggagaaggccgccgaggtgagctgggaggaggaggccgagcactccggcgcgagccacaacatcctggtggaggtccaggacgacgggacgatgaagatcaaggacgaggagcgggacgacaccctcaccatcctgctgaaggccaccctcctggccgtgtccggcgtgtacccgctgagcatccccgccaccctcttcgtctggtacttctggcagaagaagaagcagcgctccggggtgctgtgggacacgcccagcccgcccgaggtggagcgggccgtcctggacgacggcatctaccgcatcatgcagcggggcctgctcgggcgctcccaggtgggcgtgggggtcttccaggagaacgtgttccacaccatgtggcacgtgacccggggcgcggtcctgatgtaccaggggaagcgcctggagcccagctgggcctccgtgaagaaggacctcatcagctacggcggcgggtggcggctgcagggctcctggaacaccggggaggaggtgcaggtcatcgccgtggagcccggcaagaaccccaagaacgtgcagacggcccccgggaccttcaagacccccgagggcgaggtcggcgccatcgcgctggacttcaagcccgggaccagcggctcccccatcgtgaaccgcgaggggaagatcgtgggcctctacggcaacggggtcgtgacgaccagcggcacctacgtgagcgccatcgcccaggccaaggcgtcccaggaggggccgctgcccgagatcgaggacgaggtcttccggaagcgcaacctgaccatcatggacctccaccccggcagcgggaagacgcggcgctacctgccggccatcgtgcgggaggccatcaagcgcaagctgcgcaccctcatcctggcccccacccgggtggtcgcctccgagatggcggaggccctgaagggcatgcccatccgctaccagaccacggccgtcaagagcgagcacaccggcaaggagatcgtggacctcatgtgccacgccaccttcaccatgcggctgctgtcccccgtccgcgtgccgaactacaacatgatcatcatggacgaggcccacttcacggaccccagctccatcgcggcccgggggtacatcagcacccgcgtgggcatgggggaggccgccgccatcttcatgaccgcgacgccgcccggctccgtcgaggccttcccgcagagcaacgccgtgatccaggacgaggagcgggacatccccgagcgctcctggaacagcgggtacgagtggatcacggacttccccggcaagaccgtgtggttcgtcccctccatcaagagcggcaacgacatcgccaactgcctccggaagaacgggaagcgcgtgatccagctgtcccggaagaccttcgacaccgagtaccagaagacgaagaacaacgactgggactacgtggtcaccaccgacatcagcgagatgggcgcgaacttccgcgccgaccgggtgatcgacccgcgccggtgcctgaagcccgtgatcctcaaggacgggcccgagcgcgtcatcctggccggccccatgccggtgaccgtcgcctccgccgcgcagcggcgcgggcgggtgggccgcaaccacaacaaggagggcgaccagtacatctacatggggcagcccctgaacaacgacgaggaccacgcccactggacggaggccaagatgctcctggacaacatcaacacccccgagggcatcatccccgccctgttcgagccggagcgcgagaagtccgccgcgatcgacggggagtaccggctccgcggcgaggcccggaagaccttcgtggagctgatgcgccgcggggacctgcccgtctggctctcctacaaggtggccagcgagggcttccagtacagcgaccgccggtggtgcttcgacggcgagcgcaacaaccaggtgctggaggagaacatggacgtcgagatctggaccaaggagggggagcggaagaagctgcgcccccggtggctcgacgcccgcacgtactccgaccccctggccctgcgggagttcaaggagttcgcggccggccgccggagcgtgtccggggacctcatcctggagatcggcaagctgccgcagcacctcacccagcgcgcccagaacgccctggacaacctggtgatgctccacaacagcgagcagggcgggcgggcgtaccgccacgccatggaggagctgcccgacaccatcgagaccctgatgctcctggccctgatcgccgtcctcacgggcggggtgaccctgttcttcctgtccggccgggggctcggcaagaccagcatcggcctgctgtgcgtgatggcctccagcgtcctcctgtggatggcgtccgtggagccccactggatcgccgccagcatcatcctggagttcttcctcatggtgctgctgatccccgagccggaccgccagcggacgccccaggacaaccagctcgcctacgtcgtgatcgggctgctgttcatgatcctcaccgtggccgcgaacgagatgggcctgctggagacgaccaagaaggacctcgggatcggccacgtcgccgtggagaaccaccaccacgccgccatgctggacgtggacctgcaccccgcctccgcgtggaccctctacgccgtcgccaccacgatcatcaccccgatgatgcgccacaccatcgagaacaccacggccaacatcagcctgaccgccatcgcgaaccaggccgccatcctgatggggctcgacaagggctggcccatctccaagatggacatcggcgtgcccctgctggccctcgggtgctacagccaggtgaaccccctgaccctgaccgcggccgtcctcatgctggtggcccactacgccatcatcggcccggggctgcaggccaaggcgacgcgcgaggcccagaagcggaccgccgccggcatcatgaagaaccccaccgtggacgggatcgtcgccatcgacctcgaccccgtggtgtacgacgcgaagttcgagaagcagctgggccagatcatgctgctcatcctgtgcacctcccagatcctgctcatgcgcacgacctgggccctgtgcgagagcatcaccctggccaccggccccctcacgaccctgtgggaggggtccccgggcaagttctggaacaccaccatcgccgtcagcatggccaacatcttccgggggtcctacctggcgggcgccggcctcgccttcagcctgatgaagtccctcgggggcgggcgccgggggacgggggcccagggcgagaccctcggcgagaagtggaagcgccagctgaaccagctgtccaagagcgagttcaacacctacaagcggtccgggatcatggaggtggaccgcagcgaggcgaaggagggcctcaagcgcggggagaccacgaagcacgccgtgtcccgcggcaccgccaagctgcggtggttcgtcgagcgcaacctggtgaagcccgaggggaaggtgatcgacctgggctgcggccgcggcgggtggagctactactgcgccgggctcaagaaggtcaccgaggtgaaggggtacaccaagggcgggcccggccacgaggagcccatcccgatggccacgtacgggtggaacctggtgaagctgcactccggcaaggacgtcttcttcatcccgcccgagaagtgcgacaccctcctgtgcgacatcggggagagctcccccaacccgaccatcgaggagggccgcaccctgcgggtgctcaagatggtggagccctggctgcgcgggaaccagttctgcatcaagatcctgaacccctacatgcccagcgtcgtggagacgctcgaccagatgcagcggaagcacggcggcatgctggtgcgcaacccgctgtcccggaacagcacccacgagatgtactgggtctcctgcgggaccggcaacatcgtgagcgcggtgaacatgacctcccgcatgctcctgaaccgcttcaccatggcccaccggaagcccacgtacgagcgcgacgtcgacctgggggccggcacccggcacgtggccgtggagcccgaggtcgccaacctcgacatcatcggccagcgcatcgagaacatcaagcacgagcacaagagcacctggcactacgacgaggacaacccctacaagacctgggcgtaccacgggtcctacgaggtgaagccgagcggctccgccagcagcatggtcaacggggtggtgaagctgctgacgaagccctgggacgtcatccccatggtgacccagatcgccatgaccgacaccacgcccttcggccagcagcgggtgttcaaggagaaggtcgacacccgcaccccgaaggccaagcgggggaccacgcagatcatggaggtgaccgcccgctggctctggggcttcctgtcccggaacaagaagccccgcatctgcacccgggaggagttcacccgcaaggtgcggagcaacgcggccatcggcgccgtcttcgtggacgagaaccagtggaactccgccaaggaggcggtggaggacgagcgcttctgggacctggtccaccgggagcgcgagctccacaagcaggggaagtgcgccacgtgcgtgtacaacatgatgggcaagcgggagaagaagctgggggagttcggcaaggccaaggggagccgcgccatctggtacatgtggctgggcgcccggttcctcgagttcgaggcgctgggcttcatgaacgaggaccactggttctcccgcgagaacagcctgtccggggtggagggcgaggggctccacaagctgggctacatcctgcgggacatcagcaagatccccgggggcaacatgtacgccgacgacaccgccggctgggacacccgcatcaccgaggacgacctccagaacgaggccaagatcacggacatcatggagccggagcacgccctgctggcgaaggccatcttcaagctcacctaccagaacaaggtcgtgcgcgtgcagcggcccgccaagaacgggaccgtcatggacgtgatctcccgccgggaccagcgcggcagcggccaggtgggcacctacggcctgaacacgttcaccaacatggaggcccagctgatccggcagatggagtccgaggggatcttcagcccctccgagctcgagacccccaacctggccgagcgcgtcctggactggctcgagaagtacggcgtggagcggctgaagcgcatggcgatcagcggggacgactgcgtggtcaagccgatcgacgaccggttcgccaccgccctgacggccctcaacgacatgggcaaggtgcgcaaggacatcccccagtgggagccctccaaggggtggaacgactggcagcaggtccccttctgcagccaccacttccaccagctgatcatgaaggacggccgggagatcgtcgtgccgtgccgcaaccaggacgagctggtgggccgggcccgcgtctcccagggggcgggctggagcctccgggagaccgcctgcctgggcaagagctacgcccagatgtggcagctgatgtacttccaccgccgggacctccgcctggccgcgaacgccatctgctccgccgtgcccgtggactgggtccccaccagccggaccacgtggtccatccacgcccaccaccagtggatgaccaccgaggacatgctgagcgtgtggaaccgcgtgtggatcgaggagaacccctggatggaggacaagacccacatctccagctgggaggacgtcccgtacctcggcaagcgcgaggaccagtggtgcgggtccctgatcggcctgacggcccgggcgacctgggccaccaacatccaggtggccatcaaccaggtgcgccggctcatcggcaacgagaactacctggactacatgaccagcatgaagcgcttcaagaacgagtccgaccccgagggggccctgtggtga

SEQ ID NO: 8884 - RNA, 9879 nt, synthetic construct
  misc_feature 1..9879: note = derived and/or modified CDS sequence (opt1) from DENV-1__KC762637__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgctcacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcagccgcgacttcgtggaggggctgtccggcgccacgtgggtggacgtcgtgctggagcacgggagctgcgtgaccaccatggccaaggacaagcccaccctcgacatcgagctgctgaagacggaggtcaccaaccccgcggtgctccggaagctgtgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctgatcacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctcgtgcaccagatcttcggcaccgcctacggggtgctgttctccggcgtcagctggaccatgaagatcgggatcggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcaccgtggtggtcggggacgtggcgggcatcctggcccaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctccgggacagctacacccaggtgtgcgaccaccgcctgatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacacgctctggagcaacggcgtgctggagtccgagatgatcatccccaagatctacgggggcccgatcagccagcacaactaccgccccgggtacttcacccagaccgccggcccctggcacctggggaagctcgagctggacttcgacctgtgcgagggcaccacggtggtcgtggacgagcactgcggcaaccgggggccgtccctccgcaccaccaccgtgacgggcaagatcatccacgagtggtgctgccggagctgcaccctgccgcccctgcgcttccgcggggaggacggctgctggtacgggatggagatccgccccgtcaaggagaaggaggagaacctcgtgaagtccatggtgagcgccggcagcggcgaggtcgactccttcagcctggggctgctctgcatctccatcatgatcgaggaggtgatgcggagccgctggtcccggaagatgctgatgaccggcaccctggccgtgttcttcctcctgatcatggggcagctgacgtggaacgacctcatccgcctgtgcatcatggtcggcgcgaacgccagcgaccgcatggggatgggcaccacctacctggccctcatggccaccttcaagatgcggccgatgttcgccgtgggcctgctgttccgccggctcacgtcccgcgaggtgctgctgctcaccatcgggctgagcctggtcgcgtccgtggagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcctggaagaccatggcgatggtcctcagcatcgtgtccctgttccccctgtgcctcagcacgacctcccagaagaccacctggctgcccgtgctgctcggcagcctggggtgcaagccgctgacgatgttcctcatcgccgagaacaagatctggggccggaagtcctggcccctgaacgaggggatcatggccgtcggcatcgtgagcatcctgctcagctccctgctgaagaacgacgtgcccctcgccgggcccctgatcgccggcggcatgctgatcgcgtgctacgtcatcagcgggtccagcgccgacctctccctggagaaggccgccgaggtgagctgggaggaggaggccgagcactccggcgcgagccacaacatcctggtggaggtccaggacgacgggaccatgaagatcaaggacgaggagcgcgacgacaccctcaccatcctgctgaaggccaccctcctggccgtgtccggcgtgtacccgctgagcatccccgccaccctcttcgtctggtacttctggcagaagaagaagcagcggtccggggtgctgtgggacacccccagcccgcccgaggtggagcgcgccgtcctggacgacggcatctaccggatcatgcagcgcggcctgctcgggcggtcccaggtgggcgtgggggtcttccaggagaacgtgttccacaccatgtggcacgtgacccgcggcgcggtcctgatgtaccaggggaagcggctggagcccagctgggcctccgtgaagaaggacctcatcagctacggcggcgggtggcgcctgcagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgggaggggaagatcgtgggcctctacggcaacggggtcgtgaccaccagcggcacctacgtgagcgccatcgcccaggccaaggcgtcccaggaggggccgctgcccgagatcgaggacgaggtcttccgcaagcggaacctgacgatcatggacctccaccccggcagcgggaagacccgccggtacctgccggccatcgtgcgcgaggccatcaagcggaagctgcgcaccctcatcctggcccccacccgcgtggtcgcctccgagatggcggaggccctgaagggcatgcccatccggtaccagacgaccgccgtcaagagcgagcacaccggcaaggagatcgtggacctcatgtgccacgccaccttcacgatgcgcctgctgtcccccgtccgggtgccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctccgcaagaacgggaagcgggtgatccagctgtcccgcaagaccttcgacacggagtaccagaagaccaagaacaacgactgggactacgtggtcaccaccgacatcagcgagatgggcgcgaacttccgggccgaccgcgtgatcgacccgcggcgctgcctgaagcccgtgatcctcaaggacgggcccgagcgggtcatcctggccggccccatgccggtgacggtcgcctccgccgcgcagcgccgggggcgcgtgggccggaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccgcctccggggcgaggcccgcaagaccttcgtggagctgatgcggcgcggggacctgcccgtctggctctcctacaaggtggccagcgagggcttccagtacagcgaccggcgctggtgcttcgacggcgagcggaacaaccaggtgctggaggagaacatggacgtcgagatctggacgaaggagggggagcgcaagaagctgcggccccgctggctcgacgcccggacctactccgaccccctggccctgcgcgagttcaaggagttcgcggccggccggcgcagcgtgtccggggacctcatcctggagatcggcaagctgccgcagcacctcacccagcgggcccagaacgccctggacaacctggtgatgctccacaacagcgagcagggcgggcgcgcgtaccggcacgccatggaggagctgcccgacaccatcgagacgctgatgctcctggccctgatcgccgtcctcaccggcggggtgaccctgttcttcctgtccggccgcgggctcggcaagaccagcatcggcctgctgtgcgtgatggcctccagcgtcctcctgtggatggcgtccgtggagccccactggatcgccgccagcatcatcctggagttcttcctcatggtgctgctgatccccgagccggaccggcagcgcacgccccaggacaaccagctcgcctacgtcgtgatcgggctgctgttcatgatcctcacggtggccgcgaacgagatgggcctgctggagaccaccaagaaggacctcgggatcggccacgtcgccgtggagaaccaccaccacgccgccatgctggacgtggacctgcaccccgcctccgcgtggaccctctacgccgtcgccacgaccatcatcaccccgatgatgcggcacaccatcgagaacacgaccgccaacatcagcctgaccgccatcgcgaaccaggccgccatcctgatggggctcgacaagggctggcccatctccaagatggacatcggcgtgcccctgctggccctcgggtgctacagccaggtgaaccccctgaccctgacggcggccgtcctcatgctggtggcccactacgccatcatcggcccggggctgcaggccaaggcgacccgcgaggcccagaagcgcaccgccgccggcatcatgaagaaccccaccgtggacgggatcgtcgccatcgacctcgaccccgtggtgtacgacgcgaagttcgagaagcagctgggccagatcatgctgctcatcctgtgcacgtcccagatcctgctcatgcggaccacctgggccctgtgcgagagcatcaccctggccacgggccccctcaccaccctgtgggaggggtccccgggcaagttctggaacaccacgatcgccgtcagcatggccaacatcttccgcgggtcctacctggcgggcgccggcctcgccttcagcctgatgaagtccctcgggggcgggcggcgcgggaccggggcccagggcgagaccctcggcgagaagtggaagcggcagctgaaccagctgtccaagagcgagttcaacacctacaagcgctccgggatcatggaggtggaccggagcgaggcgaaggagggcctcaagcgcggggagacgaccaagcacgccgtgtcccggggcaccgccaagctgcgctggttcgtcgagcggaacctggtgaagcccgaggggaaggtgatcgacctgggctgcggccgcgggggctggagctactactgcgccgggctcaagaaggtcaccgaggtgaagggctacacgaagggcgggcccggccacgaggagcccatcccgatggccacctacgggtggaacctggtgaagctgcactccggcaaggacgtcttcttcatcccgcccgagaagtgcgacaccctcctgtgcgacatcggggagagctcccccaacccgaccatcgaggagggccggacgctgcgcgtgctcaagatggtggagccctggctgcgggggaaccagttctgcatcaagatcctgaacccctacatgcccagcgtcgtggagaccctcgagcagatgcagcgcaagcacggcggcatgctggtgcggaacccgctgtcccgcaacagcacccacgagatgtactgggtctcctgcgggaccggcaacatcgtgagcgcggtgaacatgacctcccggatgctcctgaaccgcttcacgatggcccaccgcaagcccacctacgagcgggacgtcgacctgggggccggcacccgccacgtggccgtggagcccgaggtcgccaacctcgacatcatcggccagcggatcgagaacatcaagcacgagcacaagagcacctggcactacgacgaggacaacccctacaagacgtgggcgtaccacgggtcctacgaggtgaagccgagcggctccgccagcagcatggtcaacggggtggtgaagctgctgaccaagccctgggacgtcatccccatggtgacccagatcgccatgaccgacacgacccccttcggccagcagcgcgtgttcaaggagaaggtcgacacccggaccccgaaggccaagcgcgggacgacccagatcatggaggtgaccgcccggtggctctggggcttcctgtcccgcaacaagaagccccggatctgcacccgcgaggagttcacgcggaaggtgcgcagcaacgcggccatcggcgccgtcttcgtggacgagaaccagtggaactccgccaaggaggcggtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggccaagatcaccgacatcatggagccggagcacgccctgctggcgaaggccatcttcaagctcacctaccagaacaaggtcgtgcgcgtgcagcgccccgccaagaacgggaccgtcatggacgtgatctcccggcgcgaccagcggggcagcggccaggtggggacgtacggcctgaacaccttcaccaacatggaggcccagctgatccgccagatggagtccgaggggatcttcagcccctccgagctcgagacccccaacctggccgagcgggtcctggactggctcgagaagtacggcgtggagcgcctgaagcggatggcgatcagcggggacgactgcgtggtcaagccgatcgacgaccgcttcgccacggccctgaccgccctcaacgacatgggcaaggtgcggaaggacatcccccagtgggagccctccaaggggtggaacgactggcagcaggtccccttctgcagccaccacttccaccagctgatcatgaaggacggccgcgagatcgtcgtgccgtgccggaaccaggacgagctggtgggccgcgcccgggtctcccagggggcgggctggagcctccgcgagaccgcctgcctgggcaagagctacgcccagatgtggcagctgatgtacttccaccggcgcgacctccggctggccgcgaacgccatctgctccgccgtgcccgtggactgggtccccaccagccgcacgacctggtccatccacgcccaccaccagtggatgaccaccgaggacatgctgagcgtgtggaaccgggtgtggatcgaggagaacccctggatggaggacaagacgcacatctccagctgggaggacgtcccgtacctcggcaagcgcgaggaccagtggtgcgggtccctgatcggcctgaccgcccgcgcgacctgggccaccaacatccaggtggccatcaaccaggtgcggcgcctcatcggcaacgagaactacctggactacatgaccagcatgaagcggttcaagaacgagtccgaccccgagggggccctgtggtga

SEQ ID NO: 8885 - RNA, 9879 nt, synthetic construct
  misc_feature 1..9879: note = derived and/or modified CDS sequence (opt1) from DENV-1__KC762620__SS-prME
  source 1..9879: mol_type = other RNA
agcgtgaccatgctgttcatgctcctgcccaccgccctggccttccacctcaccacccgcggcggggagccccacatgatcgtgtccaagcaggagcggggcaagagcctgctgttcaagacctccgccggggtgaacatgtgcaccctcatcgccatggacctgggcgagctgtgcgaggacacgatgacctacaagtgcccccgcatcaccgagaccgagcccgacgacgtggactgctggtgcaacgccacggagacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagaaggtggagacgtgggccctccggcaccccgggttcaccgtgatcgccctgttcctggcccacgcgatcggcaccagcatcacccagaaggggatcatcttcatcctcctgatgctggtgacgccctccatggccatgcgctgcgtcggcatcggcaaccgggacttcgtggaggggctcagcggcgccacctgggtggacgtcgtgctggagcacgggtcctgcgtgaccaccatggccaaggacaagcccacgctggacatcgagctcctgaagaccgaggtcaccaaccccgccgtgctgcgcaagctctgcatcgaggcgaagatcagcaacaccacgaccgactcccggtgcccgacccagggcgaggccaccctggtggaggagcaggacacgaacttcgtctgccgccggaccttcgtggaccgcggctgggggaacggctgcgggctgttcggcaaggggagcctcatcacgtgcgccaagttcaagtgcgtgaccaagctggagggcaagatcgtccagtacgagaacctgaagtactccgtgatcgtgacggtccacaccggcgaccagcaccaggtggggaacgagaccatcgagcacggcaccaccgccacgatcacgccccaggcccccaccagcgagatccagctcaccgactacggggcgctgacgctggactgcagcccccggaccggcctcgacttcaacgagatggtcctgctgaccatgaaggagaagtcctggctcgtgcacaagcagtggttcctggacctgccgctcccctggacctccggggccagcacgagccaggagacctggaaccgccaggacctgctggtgaccttcaagaccgcccacgccaagaagcaggaggtcgtggtgctcggctcccaggagggcgccatgcacacggcgctgaccggggccaccgagatccagaccagcggcacgaccaccatcttcgccgggcacctgaagtgccggctcaagatggacaagctgaccctgaagggcgtctcctacgtgatgtgcacggggagcttcaagctcgagaaggaggtggccgagacccagcacggcaccgtcctggtccaggtgaagtacgagggcaccgacgccccctgcaagatccccttctccagccaggacgagcgcggggtcatccagaacggccggctgatcacggcgaacccgatcgtgaccgacaaggagaagcccgtgaacatcgaggccgagccgcccttcggggagtcctacatcgtcgtgggcgccggcgagaaggccctgaagctcagctggttcaagaaggggtccagcatcggcaagatgttcgaggcgaccgcccgcggggcccggcgcatggccatcctgggcgacaccgcctgggacttcgggtccatcggcggcgtgttcacgagcgtcgggaagctggtgcaccagatcttcggcaccgcgtacggggtgctgttctccggcgtcagctggaccatgaagatcgggatcggcatcctgctgacctggctcggcctgaactcccgcaacacgagcctgtccatgacctgcatcgccgtggggatggtgaccctctacctgggcgtcatggtgcaggccgacagcgggtgcgtgatcaactggaagggccgggagctgaagtgcgggtccggcatcttcgtcaccaacgaggtgcacacgtggaccgagcagtacaagttccaggccgacagcccgaagcgcctcagcgccgcgatcggcaaggcctgggaggagggggtgtgcggcatccggtccgccacccgcctggagaacatcatgtggaagcagatcagcaacgagctgaaccacatcctcctggagaacgacatgaagttcaccgtcgtggtgggggacgtctccggcatcctggcccaggggaagaagatgatccggccccagcccatggagcacaagtacagctggaagtcctggggcaaggccaagatcatcggcgcggacgtgcagaacaccacgttcatcatcgacgggcccaacaccccggagtgccccgacaaccagcgcgcctggaacatctgggaggtggaggactacggcttcggggtcttcaccaccaacatctggctcaagctgcgggacagctacacccaggtgtgcgaccaccgcctgatgtccgccgccatcaaggacagcaaggcggtgcacgccgacatgggctactggatcgagtccgagaagaacgagacctggaagctcgagcgggccagcttcatcgaggtcaagacctgcatctggccccgctcccacaccctgtggagcaacggcgtgctggagtccgagatgatcatccccaagacgtacgggggcccggtgagccagcacaactaccggcccgggtacttcacccagaccgccggcccctggcacctcgggaagctggagctggacttcgacctctgcgagggcaccacggtcgtggtggacgagaactgcggcaaccgcgggccgtccctgcggaccaccaccgtcacgggcaagatcatccacgagtggtgctgccgcagctgcaccctgccgcccctccggttcaagggggaggacggctgctggtacgggatggagatccgccccgtgaaggagaaggaggagaacctggtgaagtccatggtcagcgccggcagcggcgaggtggactccttcagcctggggctcctgtgcatctccatcatgatcgaggaggtgatgcggagccgctggtccggcaagatgctgatgaccgggaccctcgcggtcttcctgctgctcacgatgggccagctgacctggaacgacctgatccggctctgcatcatggtgggggccaacgccagcgacatgatgggcatgggcaccacctacctggccctgatggccacgttccgcatgcgcccgatgttcgcggtcgggctcctgttccggcgcctgacctcccgggaggtgctcctgctgaccgtgggcctcagcctggccgcctccgtcgagctgcccaacagcctcgaggagctgggggacggcctggccatgggcatcatgatgctcaagctgctgaccgacttccagtcccaccagctctgggccacgctgctgagcctcaccttcgtgaagaccaccttctccctgcactacgcgtggaagacgatggccatgatcctgagcatcgtgtccctcttccccctgtgcctgagcaccacctcccagaagaccacgtggctccccgtcctgctggggagcctcggctgcaagccgctgaccatgctgctcatcaccgagaacaagatctgggggcgccggtcctggcccatcaacgagggcatcatggccatcgggatcgtgagcatcctgctgagctccctcctgaagaacgacgtgcccctggccggccccctcatcgcgggcgggatgctgatcgcctgctacgtcatcagcggctccagcgccgacctgtccctcgagaaggccgccgaggtgagctgggaggacgaggcggagcactccggggccagccacaacatcctggtggaggtccaggacgacggcaccatgaagatcaaggacgaggagcgcgacgacaccctgacgatcctcctgaaggccaccctgctcgccatctccggggtgtacccgatgagcatccccgccaccctgttcgtgtggtacttctggcagaagaagaagcagcggtccggcgtcctgtgggacacccccagcccgcccgaggtggagcgcgcggtgctcgacgacggcatctaccggatcctgcagcgcgggctgctgggccggtcccaggtcggggtgggcgtgttccaggagggggtcttccacacgatgtggcacgtgacccgcggcgccgtgctcatgtaccagggcaagcggctggagcccagctgggcctccgtcaagaaggacctgatcagctacgggggcgggtggcgcttccagggctcctggaacaccggggaggaggtccaggtgatcgccgtcgagcccggcaagaaccccaagaacgtgcagaccacgcccggcaccttcaagaccagcgagggggaggtgggcgccatcgcgctcgacttcaagcccgggacctccggcagccccatcgtcaaccgggagggcaagatcgtggggctgtacggcaacggggtggtcacgaccagcggcacctacgtgtccgccatcgcccaggccaaggccagccaggaggggcccctgccggagatcgaggacgaggtgttccgcaagcggaacctcaccatcatggacctgcaccccggctccggcaagacgcgccggtacctgcccgcgatcctccgcgaggccatcaagcggaagctgcgcaccctggtcctcgccccgacccgcgtggtggccagcgagatggcggaggccctgaaggggatgcccatccggtaccagaccacggccgtcaagtccgagcacaccggcaaggagatcgtggacctgatgtgccacgccaccttcaccatgcgcctcctgagccccgtgcgggtccccaactacaacatgatcatcatggacgaggcccacttcacggacccggcgtccatcgccgcccgcgggtacatcagcacccgggtgggcatgggggaggccgccgcgatcttcatgaccgccacgccgcccggctccgtggaggccttcccccagagcaacgccgtcatccaggacgaggagcgcgacatcccggagcggtcctggaacagcggctacgactggatcacggacttccccgggaagaccgtgtggttcgtgccctccatcaagagcggcaacgacatcgccaactgcctgcgcaagaacgggaagcgggtcgtgcagctctcccgcaagaccttcgacaccgagtaccagaagacgaagaacaacgactgggactacgtggtcaccaccgacatcagcgagatgggcgcgaacttccgggccgaccgcgtgatcgacccccggcgctgcctgaagccggtcatcctgaaggacgggcccgagcgggtgatcctcgccggccccatgcccgtgaccgtcgcctccgcggcccagcgccggggccgcatcgggcggaacagcaacaaggagggcgaccagtacgtgtacatggggcagccgctgaacaacgacgaggaccacgcccactggacggaggccaagatgctgctcgacaacatcaacacccccgagggcatcatccccgccctgttcgagcccgagcgcgagaagtccgcggccatcgacggggagtaccgcctgcggggcgaggcccgcaagaccttcgtggagctcatgcggcgcggcgacctgccggtctggctgagctacaaggtggccagcgaggggttccagtactccgaccggcgctggtgcttcgacggcgagcggaacaaccaggtgctcgaggagaacatggacgtcgagatctggaccaaggagggggagcgcaagaagctgcggccccgctggctggacgcccggacgtacagcgaccccctcgcgctgcgcgagttcaaggagttcgccgccggccggcgctccgtgagcggcgacctgatcctcgagatcgggaagctgccccagcacctgacccagaaggcccagaacgccctcgacaacctggtgatgctgcacaactccgagcagggcgggaaggcgtaccggcacgccatggaggagctcccggacaccatcgagaccctgatgctgctcgccctgatcgccgtcctgaccggcggggtgaccctcttcttcctgagcggccgcggcctggggaagacctccatcggcctcctgtgcgtgatggcgagctccgccctgctctggatggccagcgtcgagccccactggatcgccgcctccatcatcctggagttcttcctgatggtgctcctgatccccgagcccgaccggcagcgcaccccgcaggacaaccagctggcgtacgtggtcatcgggctcctgttcatgatcctgaccgtggccgccaacgagatgggcctcctggagacgaccaagaaggacctggggatcggccacgccgccgcggagaaccaccaccacgccgccatgctcgacgtggacctgcaccccgccagcgcctggaccctgtacgcggtcgccaccacgatcatcacccccatgatgcggcacaccatcgagaacaccacggccaacatctccctcaccgccatcgccaaccaggcggccatcctgatgggcctggacaaggggtggccgatcagcaagatggacatcggcgtgcccctcctggccctggggtgctactcccaggtgaaccccctcaccctgaccgccgcggtcctgatgctcgtggcccactacgccatcatcggccccgggctgcaggccaaggccacgcgcgaggcgcagaagcggaccgccgccggcatcatgaagaacccgaccgtggacggcatcgtcgccatcgacctggaccccgtggtgtacgacgccaagttcgagaagcagctcgggcagatcatgctgctgatcctctgcaccagccagatcctgctgatgcgcacgacctgggcgctctgcgagtccatcaccctggccaccggccccctgacgaccctctgggaggggagccccggcaagttctggaacaccaccatcgccgtctccatggccaacatcttccgcggcagctacctggccggggcgggcctggccttcagcctcatgaagtccctcgggggcgggcggcgcgggacgggcgcccagggggagaccctgggcgagaagtggaagcggcagctcaaccagctgagcaagtccgagttcaacatctacaagcgcagcgggatcatggaggtggaccggtccgaggccaaggagggcctgaagcgcggggagaccaccaagcacgcggtgagccggggcacggccaagctccgctggttcgtcgagcggaacctggtgaagccggagggcaaggtgatcgacctggggtgcggccgcgggggctggtcctactactgcgccgggctgaagaaggtcaccgaggtgaagggctacaccaagggcgggcccggccacgaggagcccgtgcccatggccacctacgggtggaacctcgtcaagctgcacagcggcaaggacgtgttcttcacgccgcccgagaagtgcgacaccctgctctgcgacatcggggagtccagccccaaccccaccatcgaggagggccggaccctgcgcgtgctgaagatggtcgagccgtggctccggggcaaccagttctgcatcaagatcctgaacccctacatgccctccgtggtggagaccctggagcagatgcagcgcaagcacgggggcatgctcgtccggaaccccctgagccgcaactccacgcacgagatgtactgggtgagctgcgggaccggcaacatcgtgtccgccgtcaacatgaccagccggatgctgctcaaccgcttcaccatggcgcaccggaagccgacgtacgagaaggacgtggacctgggcgccgggacccgccacgtggccgtcgagcccgaggtggccaacctggacatcatcggccagcgcatcgagaacatcaagaacgagcacaagtccacctggcactacgacgaggacaacccctacaagacctgggcctaccacgggagctacgaggtcaagccctccggcagcgcgagctccatggtgaacggggtggtccggctcctgacgaagccgtgggacgtgatccccatggtgacccagatcgccatgaccgacaccacgcccttcggccagcagcgcgtcttcaaggagaaggtggacacccggacccccaaggccaagcgcggcaccgcccagatcatggaggtgacggccaagtggctgtgggggttcctcagccggaacaagaagccgcgcatctgcacccgggaggagttcacccgcaaggtccggtccaacgcggccatcggcgccgtgttcgtggacgagaaccagtggaacagcgccaaggaggcggtcgaggacgagcgcttctgggacctggtgcaccgggagcgcgagctgcacaagcaggggaagtgcgcgacctgcgtgtacaacatgatgggcaagcgggagaagaagctcggggagttcggcaaggccaagggctcccgcgccatctggtacatgtggctgggggcccggttcctggagttcgaggcgctcggcttcatgaacgaggaccactggttcagccgcgagaactccctgagcggggtcgagggcgaggggctgcacaagctcggctacatcctgcgggacatctccaagatccccggcgggaacctgtacgccgacgacacggccggctgggacacccgcatcaccgaggacgacctccagaacgaggccaagatcaccgacatcatggagcccgagcacgccctgctggcgacgagcatcttcaagctcacctaccagaacaaggtggtgcgggtccagcgcccggccaagaacgggaccgtgatggacgtgatctcccggcgcgaccagcgcggcagcggccaggtcgggacctacggcctgaacacgttcaccaacatggaggcccagctgatccggcagatggagtccgaggggatcttcagcccctccgagctcgagacccccaacctggccaagcgcgtgctggactggctcgagaagcacggcatcgagcggctgaagcgcatggccatcagcggggacgactgcgtggtcaagcccatcgacgaccggttcgcgaccgccctgacggccctcaacgacatgggcaaggtgcgcaaggacatcccgcagtgggagccctccaagggctggaacgactggcagcaggtccccttctgcagccaccacttccaccagctgatcatgaaggacgggcgggagatcgtcgtgccctgccgcaaccaggacgagctgatcggccgggcccgcgtgagccagggggccggctggtccctccgggagaccgcgtgcctgggcaagagctacgcccagatgtggcagctgatgtacttccaccgccgggacctccgcctggccgccaacgcgatctgctccgccgtcccggtggactgggtgcccaccagccggaccacgtggtccatccacgcccaccaccagtggatgaccaccgaggacatgctgagcgtctggaaccgcgtgtggatcgaggagaacccctggatggaggacaagacccacgtgtccagctgggaggacgtcccctacctcggcaagcgggaggaccagtggtgcggctccctgatcgggctgaccgcccgcgccacgtgggcgagcaacatccaggtggccatcaaccaggtgcggcgcctcatcggcaacgagaactacctggactacatgacctccatgaagcgcttcaagaacgagagcgacccggagggggccctgtggtga

SEQ ID NO: 8886 - RNA, 9879 nt, synthetic construct
  misc_feature 1..9879: note = derived and/or modified CDS sequence (opt1) from DENV-1__KC762631__SS-prME
  source 1..9879: mol_type = other RNA
agcgtgaccatgctgctcatgctgatgcccaccgccctggccttccacctcaccacccggggcggggagccccacatgaccgtgagcaagcaggagcggggcaagagcctgctgttcaagacctccgccggggtgaacatgtgcaccctcatcgccatggacctgggcgagctgtgcgaggacaccctcacctacaagtgcccccgcatcaccgaggccgagcccgacgacgtggactgctggtgcaacgccacggacacctgggtgacctacgggacctgcagccagacgggcgagcaccggcgcgacaagcggtccgtggccctggcgccccacgtgggcctggggctcgagacccgcaccgagacctggatgagctccgagggcgcctggaagcagatccagcgggtcgagacgtgggccctgcgccaccccgggttcaccgtgatcgccctgttcctcgcgcacgccatcggcaccagcatcacccagaaggggatcatcttcatcctgctgatgctcgtgacgccctccatggccatgcggtgcgtcggcatcggcagccgcgacttcgtggaggggctgtccggcgccacctgggtggacgtcgtgctggagcacgggagctgcgtgaccaccatggccaaggacaagcccacgctcgacatcgagctgctgaagaccgaggtcaccaaccccgcggtgctccggaagctgtgcatcgaggccaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctgatcacgtgcgccaagttcaagtgcgtgaccaagctggagggcaagatcgtccagtacgagaacctcaagtacagcgtgatcgtgaccgtccacacgggcgaccagcaccaggtggggaacgagtccaccgagcacggcaccaccgcgaccatcacgccccaggcccccaccaccgagatccagctgaccgactacggggccctgacgctcgactgcagcccccgcaccggcctggacttcaacgagatggtcctgctcaccatgaaggagaagtcctggctggtgcacaagcagtggttcctggacctccccctgccctggaccagcggggccagcacgtcccaggagacctggaaccggcaggacctgctcgtgaccttcaagaccgcccacgcgaagaagcaggaggtcgtggtgctgggcagccaggagggcgccatgcacacggccctgaccggggccaccgagatccagacctccggcacgaccaccatcttcgccgggcacctcaagtgccgcctgaagatggacaagctgaccctcaagggcatgagctacgtcatgtgcacggggtccttcaagctggagaaggaggtggcggagacccagcacggcaccgtgctggtccagatcaagtacgagggcaccgacgccccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccacggcccgcggggcccggcgcatggcgatcctgggcgacaccgcctgggacttcgggtccatcggcggcgtgttcaccagcgtcgggaagctcgtgcaccagatcttcggcaccgcctacggggtgctgttctccggcgtcagctggacgatgaagatcgggatcggcgtgctgctcacctggctgggcctgaactcccgcagcacctccctcagcatgacctgcatcgccgtggggctggtcacgctgtacctcggcgtgatggtgcaggccgactccgggtgcgtcatcaactggaagggccgggagctgaagtgcgggagcggcatcttcgtgaccaacgaggtgcacacctggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcacggtggtggtcggggacgtggcgggcatcctggcccaggggaagaagatgatccggccccagcccatggagcacaagtacagctggaagtcctggggcaaggccaagatcatcggcgccgacgtgcagaacaccaccttcatcatcgacgggcccaacaccccggagtgccccgacgaccagcgcgcgtggaacatctgggaggtcgaggactacggcttcgggatcttcacgaccaacatctggctgaagctccgggacagctacacccaggtgtgcgaccaccgcctgatgtccgccgccatcaaggacagcaaggccgtgcacgccgacatgggctactggatcgagtccgagaagaacgagacctggaagctggcgcgggccagcttcatcgaggtcaagacgtgcatctggcccaagtcccacaccctctggagcaacggcgtgctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtggtcgtggacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtcaaggagaaggaggagaacctcgtgaagtccatggtgagcgccggcagcggcgaggtcgactccttcagcctggggctgctctgcatctccatcatgatcgaggaggtgatgcggagccgctggtcccggaagatgctgatgaccggcacgctggccgtgttcttcctcctgatcatggggcagctgacctggaacgacctcatccgcctgtgcatcatggtcggcgcgaacgccagcgaccgcatggggatgggcaccacctacctggccctcatggccacgttcaagatgcggccgatgttcgccgtgggcctgctgttccgccggctcacctcccgcgaggtgctgctgctcaccatcgggctgagcctggtcgcgtccgtggagctccccaacagcctggaggagctgggcgacgggctcgccatgggcatcatgatcctgaagctgctcaccgacttccagtcccaccagctgtgggccacgctgctcagcctgaccttcatcaagaccaccttctccctgcactacgcctggaagacgatggcgatggtcctcagcatcgtgtccctgttccccctgtgcctcagcaccacctcccagaagaccacgtggctgcccgtgctgctcggcagcctggggtgcaagccgctgaccatgttcctcatcgccgagaacaagatctggggccggaagtcctggcccctgaacgaggggatcatggccgtcggcatcgtgagcatcctgctcagctccctgctgaagaacgacgtgcccctcgccgggcccctgatcgccggcggcatgctgatcgcgtgctacgtcatcagcgggtccagcgccgacctctccctggagaaggccgccgaggtgagctgggaggaggaggccgagcactccggcgcgagccacaacatcctggtggaggtccaggacgacgggaccatgaagatcaaggacgaggagcgcgacgacaccctcaccatcctgctgaaggccacgctcctggccgtgtccggcgtgtacccgctgagcatccccgccaccctcttcgtctggtacttctggcagaagaagaagcagcggtccggggtgctgtgggacacccccagcccgcccgaggtggagcgcgccgtcctggacgacggcatctaccggatcatgcagcgcggcctgctcgggcggtcccaggtgggcgtgggggtcttccaggagaacctgttccacaccatgtggcacgtgacgcgcggcgcggtgctgatgtaccaggggaagcggctcgagcccagctgggcctccgtcaagaaggacctgatcagctacggcggcgggtggcgcctgcagggctcctggaacaccggggaggaggtccaggtgatcgccgtcgagcccggcaagaaccccaagaacgtgcagaccgcccccgggaccttcaagacgcccgagggcgaggtgggcgccatcgcgctcgacttcaagcccgggaccagcggctcccccatcgtcaaccgggaggggaagatcgtgggcctgtacggcaacggggtggtcaccaccagcggcacgtacgtgagcgccatcgcccaggccaaggcgtcccaggaggggccgctgcccgagatcgaggacgaggtgttccgcaagcggaacctcaccatcatggacctgcaccccggcagcgggaagacccgccggtacctgccggccatcgtccgcgaggccatcaagcggaagctccgcaccctgatcctggcccccacgcgcgtggtggcctccgagatggcggaggccctcaagggcatgcccatccggtaccagaccaccgccgtcaagagcgagcacaccggcaaggagatcgtggacctgatgtgccacgccacgttcaccatgcgcctgctctcccccgtgcgggtcccgaactacaacatgatcatcatggacgaggcccacttcaccgaccccagctccatcgcggcccgcgggtacatcagcacccgggtgggcatgggggaggccgccgccatcttcatgacggcgacgccgcccggctccgtggaggccttcccgcagagcaacgccgtcatccaggacgaggagcgcgacatccccgagcggtcctggaacctggggtacgagtggatcaccgacttccccggcaagaccgtgtggttcgtgcccagcatcaagtccggcaacgacatcgccaactgcctgcgcaagaacgggaagcgggtcatccagctcagccgcaagacgttcgacaccgagtaccagaagaccaagaacaacgactgggactacgtggtgaccacggacatctccgagatgggcgcgaacttccgggccgaccgcgtcatcgacccgcggcgctgcctgaagcccgtgatcctgaaggacgggcccgagcgggtgatcctcgccggccccatgccggtcaccgtggccagcgccgcgcagcgccgggggcgcgtcggccggaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgcgagaagtccgccgcgatcgacggggagtaccgcctgcggggcgaggcccgcaagacgttcgtggagctcatgcggcgcggggacctgcccgtgtggctgagctacaaggtcgcctccgagggcttccagtacagcgaccggcgctggtgcttcgacggcgagcggaacaaccaggtgctcgaggagaacatggacgtggagatctggaccaaggagggggagcgcaagaagctgcggccccgctggctggacgcccggacctacagcgaccccctcgccctgcgcgagttcaaggagttcgcggccggccggcgctccgtcagcggggacctgatcctcgagatcggcaagctgccgcagcacctgacccagcgggcccagaacgccctcgacaacctggtgatgctgcacaactccgagcagggcgggcgcgcgtaccggcacgccatggaggagctccccgagacgatcgagaccctgatgctgctcgccctgatcgccgtgctgaccggcggggtcaccctcttcttcctgagcggccgcgggctgggcaagacctccatcggcctcctgtgcgtgatggccagctccgtgctgctctggatggcgagcgtcgagccccactggatcgccgcctccatcatcctggagttcttcctgatggtgctcctgatccccgagccggaccggcagcgcacgccccaggacaaccagctggcctacgtggtcatcgggctcctgttcatgatcctgaccgtggccgcgaacgagatgggcctcctggagaccaccaagaaggacctggggatcggccacgtggccgtcgagaaccaccaccacgccgccatgctcgacgtggacctgcaccccgccagcgcgtggacgctgtacgccgtggccaccaccatcatcaccccgatgatgcggcacacgatcgagaacaccaccgccaacatctccctcaccgccatcgcgaaccaggccgccatcctgatggggctggacaagggctggcccatcagcaagatggacatcggcgtccccctcctggccctggggtgctactcccaggtgaaccccctcacgctgaccgcggccgtgctgatgctcgtcgcccactacgccatcatcggcccggggctgcaggccaaggcgacccgcgaggcccagaagcgcaccgccgccggcatcatgaagaaccccacggtggacgggatcgtggccatcgacctggaccccgtcgtgtacgacgcgaagttcgagaagcagctcggccagatcatgctgctgatcctctgcaccagccagatcctgctgatgcggaccacctgggccctctgcgagtccatcacgctggccaccggccccctgaccaccctctgggaggggagcccgggcaagttctggaacacgaccatcgccgtgtccatggccaacatcttccgcgggagctacctggcgggcgccggcctggccttctccctcatgaagtccctcgggggcgggcggcgcgggaccggggcccagggcgagaccctgggcgagaagtggaagcggcagctcaaccagctgagcaagtccgagttcaacacgtacaagcgcagcgggatcatggaggtcgaccggtccgaggcgaaggagggcctgaagcgcggggagaccaccaagcacgccgtgagccggggcaccgccaagctgcgctggttcgtggagcggaacctcgtcaagcccgaggggaaggtgatcgacctgggctgcggccgcgggggctggtcctactactgcgccgggctgaagaaggtgacggaggtcaagggctacaccaagggcgggcccggccacgaggagcccatcccgatggccacctacgggtggaacctcgtgaagctgcacagcggcaaggacgtgttcttcatcccgcccgagaagtgcgacaccctgctctgcgacatcggggagtccagccccaacccgacgatcgaggagggccggaccctgcgcgtcctgaagatggtggagccctggctccgggggaaccagttctgcatcaagatcctgaacccctacatgccctccgtggtcgagaccctggagcagatgcagcgcaagcacggcggcatgctcgtgcggaacccgctgagccgcaactccacccacgagatgtactgggtgagctgcgggaccggcaacatcgtctccgcggtgaacatgacgagccggatgctgctcaaccgcttcaccatggcccaccgcaagcccacctacgagcgggacgtggacctgggggccggcacccgccacgtcgccgtggagcccgaggtggccaacctggacatcatcggccagcggatcgagaacatcaagcacgagcacaagtccacgtggcactacgacgaggacaacccctacaagacctgggcgtaccacgggagctacgaggtcaagccgtccggcagcgcctccagcatggtgaacggggtcgtgaagctcctgaccaagccctgggacgtgatccccatggtcacccagatcgccatgacggacaccacccccttcggccagcagcgcgtgttcaaggagaaggtggacacccggacgccgaaggccaagcgcgggaccacccagatcatggaggtcaccgcccggtggctgtggggcttcctcagccgcaacaagaagccccggatctgcacgcgcgaggagttcacccggaaggtgcgctccaacgcggccatcggcgccgtgttcgtcgacgagaaccagtggaacagcgccaaggaggcggtggaggacgagcggttctgggagctggtgcaccgcgagcgggagctgcacaagcaggggaagtgcgcgacctgcgtctacaacatgatgggcaagcgcgagaagaagctcggggagttcggcaaggccaaggggtcccgggccatctggtacatgtggctgggcgcccgcttcctggagttcgaggcgctcggcttcatgaacgaggaccactggttcagccgggagaactccctgagcggggtggagggcgaggggctgcacaagctcggctacatcctgcgcgacatctccaagatccccgggggcaacatgtacgccgacgacaccgccggctgggacacgcggatcaccgaggacgacctgcagaacgaggccaagatcaccgacatcatggagccggagcacgccctcctggcgaaggccatcttcaagctgacctaccagaacaaggtggtccgcgtgcagcgccccgccaagaacgggacggtgatggacgtcatcagccggcgcgaccagcggggctccggccaggtggggacctacggcctcaacaccttcaccaacatggaggcccagctgatccgccagatggagagcgaggggatcttctcccccagcgagctggagacgcccaacctcgccgagcgggtgctggactggctggagaagtacggcgtcgagcgcctcaagcggatggcgatctccggggacgactgcgtggtgaagccgatcgacgaccgcttcgccaccgccctgaccgccctgaacgacatgggcaaggtccggaaggacatcccccagtgggagcccagcaaggggtggaacgactggcagcaggtccccttctgctcccaccacttccaccagctcatcatgaaggacggccgcgagatcgtggtcccgtgccggaaccaggacgagctggtgggccgcgcccgggtgagccagggggcgggctggtccctgcgcgagaccgcctgcctcggcaagagctacgcccagatgtggcagctgatgtacttccaccggcgcgacctgcggctcgccgcgaacgccatctgcagcgccgtccccgtggactgggtgcccacgtcccgcaccacctggagcatccacgcccaccaccagtggatgaccacggaggacatgctgtccgtctggaaccgggtgtggatcgaggagaacccctggatggaggacaagacccacatcagctcctgggaggacgtgccgtacctgggcaagcgcgaggaccagtggtgcgggagcctcatcggcctgaccgcccgcgcgacctgggccaccaacatccaggtcgccatcaaccaggtgcggcgcctgatcggcaacgagaactacctcgactacatgacgtccatgaagcggttcaagaacgagagcgaccccgagggggccctgtggtga

SEQ ID NO: 8887 - RNA, 9879 nt, synthetic construct
  misc_feature 1..9879: note = derived and/or modified CDS sequence (opt1) from DENV-1__KC762621__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgctcacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcagccgcgacttcgtggaggggctgtccggcgccacgtgggtggacgtcgtgctggagcacgggagctgcgtgaccaccatggccaaggacaagcccaccctcgacatcgagctgctgaagacggaggtcaccaaccccgcggtgctccggaagctgtgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctgatcacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctcgtgcaccagatcttcggcaccgcctacggggtgctgttctccggcgtcagctggaccatgaagatcgggatcggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcaccgtggtggtcggggacgtggcgggcatcctggcccaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctccgggacagctacacccaggtgtgcgaccaccgcctgatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacacgctctggagcaacggcgtgctggagtccgagatgatcatccccaagatctacgggggcccgaccagccagcacaactaccgccccgggtacttcacccagaccgccggcccctggcacctggggaagctcgagctggacttcgacctgtgcgagggcacgaccgtggtcgtggacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtcaaggagaaggaggagaacctcgtgaagtccatggtgagcgccggcagcggcgaggtcgactccttcagcctggggctgctctgcatctccatcatgatcgaggaggtgatgcggagccgctggtcccggaagatgctgatgaccggcacgctggccgtgttcttcctcctgatcatggggcagctgacctggaacgacctcatccgcctgtgcatcatggtcggcgcgaacgccagcgaccgcatggggatgggcaccacctacctggccctcatggccacgttcaagatgcggccgatgttcgccgtgggcctgctgttccgccggctcacctcccgcgaggtgctgctgctcaccatcgggctgagcctggtcgcgtccgtggagctccccaacagcctggaggagctgggcgacgggctcgccatgggcatcatgatcctgaagctgctcaccgacttccagtcccaccagctgtgggccacgctgctcagcctgaccttcatcaagaccaccttctccctgcactacgcctggaagacgatggcgatggtcctcagcatcgtgtccctgttccccctgtgcctcagcaccacctcccagaagaccacgtggctgcccgtgctgctcggcagcctggggtgcaagccgctgaccatgttcctcatcgccgagaacaagatctggggccggaagtcctggcccctgaacgaggggatcatggccgtcggcatcgtgagcatcctgctcagctccctgctgaagaacgacgtgcccctcgccgggcccctgatcgccggcggcatgctgatcgcgtgctacgtcatcagcgggtccagcgccgacctctccctggagaaggccgccgaggtgagctgggaggaggaggccgagcactccggcgcgagccacaacatcctggtggaggtccaggacgacgggaccatgaagatcaaggacgaggagcgcgacgacaccctcaccatcctgctgaaggccacgctcctggccgtgtccggcgtgtacccgctgagcatccccgccaccctcttcgtctggtacttctggcagaagaagaagcagcggtccggggtgctgtgggacacccccagcccgcccgaggtggagcgcgccgtcctggacgacggcatctaccggatcatgcagcgcggcctgctcgggcggtcccaggtgggcgtgggggtcttccaggagaacgtgttccacaccatgtggcacgtgacgcgcggcgcggtcctgatgtaccaggggaagcggctggagcccagctgggcctccgtgaagaaggacctcatcagctacggcggcgggtggcgcctgcagggctcctggaacaccggggaggaggtgcaggtcatcgccgtggagcccggcaagaaccccaagaacgtgcagaccgcccccgggaccttcaagacgcccgagggcgaggtcggcgccatcgcgctggacttcaagcccgggaccagcggctcccccatcgtgaaccgggaggggaagatcgtgggcctctacggcaacggggtcgtgaccaccagcggcacgtacgtgagcgccatcgcccaggccaaggcgtcccaggaggggccgctgcccgagatcgaggacgaggtcttccgcaagcggaacctgaccatcatggacctccaccccggcagcgggaagacccgccggtacctgccggccatcgtgcgcgaggccatcaagcggaagctgcgcaccctcatcctggcccccacgcgcgtggtcgcctccgagatggcggaggccctgaagggcatgcccatccggtaccagaccaccgccgtcaagagcgagcacaccggcaaggagatcgtggacctcatgtgccacgccacgttcaccatgcgcctgctgtcccccgtccgggtgccgaactacaacatgatcatcatggacgaggcccacttcaccgaccccagctccatcgcggcccgcgggtacatcagcacccgggtgggcatgggggaggccgccgccatcttcatgacggcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctccgcaagaacgggaagcgggtgatccagctgtcccgcaagacgttcgacaccgagtaccagaagaccaagaacaacgactgggactacgtggtcaccacggacatcagcgagatgggcgcgaacttccgggccgaccgcgtgatcgacccgcggcgctgcctgaagcccgtgatcctcaaggacgggcccgagcgggtcatcctggccggccccatgccggtgaccgtcgcctccgccgcgcagcgccgggggcgcgtgggccggaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccgcctccggggcgaggcccgcaagacgttcgtggagctgatgcggcgcggggacctgcccgtctggctctcctacaaggtggccagcgagggcttccagtacagcgaccggcgctggtgcttcgacggcgagcggaacaaccaggtgctggaggagaacatggacgtcgagatctggaccaaggagggggagcgcaagaagctgcggccccgctggctcgacgcccggacctactccgaccccctggccctgcgcgagttcaaggagttcgcggccggccggcgcagcgtgtccggggacctcatcctggagatcggcaagctgccgcagcacctcacccagcgggcccagaacgccctggacaacctggtgatgctccacaacagcgagcagggcgggcgcgcgtaccggcacgccatggaggagctgcccgacacgatcgagaccctgatgctcctggccctgatcgccgtcctcaccggcggggtgaccctgttcttcctgtccggccgcgggctcggcaagaccagcatcggcctgctgtgcgtgatggcctccagcgtcctcctgtggatggcgtccgtggagccccactggatcgccgccagcatcatcctggagttcttcctcatggtgctgctgatccccgagccggaccggcagcgcacgccccaggacaaccagctcgcctacgtcgtgatcgggctgctgttcatgatcctcaccgtggccgcgaacgagatgggcctgctggagaccaccaagaaggacctcgggatcggctacgtcgccgtggagaaccaccaccacgccgccatgctggacgtggacctgcaccccgcctccgcgtggacgctctacgccgtcgccaccaccatcatcaccccgatgatgcggcacacgatcgagaacaccaccgccaacatcagcctgaccgccatcgcgaaccaggccgccatcctgatggggctcgacaagggctggcccatctccaagatggacatcggcgtgcccctgctggccctcgggtgctacagccaggtgaaccccctgacgctgaccgcggccgtcctcatgctggtggcccactacgccatcatcggcccggggctgcaggccaaggcgacccgcgaggcccagaagcgcaccgccgccggcatcatgaagaaccccacggtggacgggatcgtcgccatcgacctcgaccccgtggtgtacgacgcgaagttcgagaagcagctgggccagatcatgctgctcatcctgtgcacctcccagatcctgctcatgcggaccacctgggccctgtgcgagagcatcacgctggccaccggccccctcaccaccctgtgggaggggtccccgggcaagttctggaacacgaccatcgccgtcagcatggccaacatcttccgcgggtcctacctggcgggcgccggcctcgccttcagcctgatgaagtccctcgggggcgggcggcgcgggaccggggcccagggcgagaccctcggcgagaagtggaagcggcagctgaaccagctgtccaagagcgagttcaacacgtacaagcgctccgggatcatggaggtggaccggagcgaggcgaaggagggcctcaagcgcggggagaccaccaagcacgccgtgtcccggggcaccgccaagctgcgctggttcgtcgagcggaacctggtgaagcccgaggggaaggtgatcgacctgggctgcggccgcgggggctggagctactactgcgccgggctcaagaaggtcacggaggtgaagggctacaccaagggcgggcccggccacgaggagcccatcccgatggccacctacgggtggaacctggtgaagctgcactccggcaaggacgtcttcttcatcccgcccgagaagtgcgacaccctcctgtgcgacatcggggagagctcccccaacccgacgatcgaggagggccggaccctgcgcgtgctcaagatggtggagccctggctgcgggggaaccagttctgcatcaagatcctgaacccctacatgcccagcgtcgtggagaccctcgagcagatgcagcgcaagcacggcggcatgctggtgcggaacccgctgtcccgcaacagcacccacgagatgtactgggtctcctgcgggaccggcaacatcgtgagcgcggtgaacatgacgtcccggatgctcctgaaccgcttcaccatggcccaccgcaagcccacctacgagcgggacgtcgacctgggggccggcacccgccacgtggccgtggagcccgaggtcgccaacctcgacatcatcggccagcggatcgagaacatcaagcacgagcacaagagcacgtggcactacgacgaggacaacccctacaagacctgggcgtaccacgggtcctacgaggtgaagccgagcggctccgccagcagcatggtcaacggggtggtgaagctgctgaccaagccctgggacgtcatccccatggtgacccagatcgccatgacggacaccacccccttcggccagcagcgcgtgttcaaggagaaggtcgacacccggacgccgaaggccaagcgcgggaccacccagatcatggaggtgaccgcccggtggctctggggcttcctgtcccgcaacaagaagccccggatctgcacgcgcgaggagttcacccggaaggtgcgcagcaacgcggccatcggcgccgtcttcgtggacgagaaccagtggaactccgccaaggaggcggtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacgcggatcaccgaggacgacctccagaacgaggccaagatcaccgacatcatggagccggagcacgccctgctggcgaaggccatcttcaagctcacctaccagaacaaggtcgtgcgcgtgcagcgccccgccaagaacgggacggtcatggacgtgatctcccggcgcgaccagcggggcagcggccaggtggggacctacggcctgaacaccttcaccaacatggaggcccagctgatccgccagatggagtccgaggggatcttcagcccctccgagctcgagacgcccaacctggccgagcgggtcctggactggctcgagaagtacggcgtggagcgcctgaagcggatggcgatcagcggggacgactgcgtggtcaagccgatcgacgaccgcttcgccaccgccctgaccgccctcaacgacatgggcaaggtgcggaaggacatcccccagtgggagccctccaaggggtggaacgactggcagcaggtccccttctgcagccaccacttccaccagctgatcatgaaggacggccgcgagatcgtcgtgccgtgccggaaccaggacgagctggtgggccgcgcccgggtctcccagggggcgggctggagcctccgcgagaccgcctgcctgggcaagagctacgcccagatgtggcagctgatgtacttccaccggcgcgacctccggctggccgcgaacgccatctgctccgccgtgcccgtggactgggtccccacgagccgcaccacctggtccatccacgcccaccaccagtggatgaccacggaggacatgctgagcgtgtggaaccgggtgtggatcgaggagaacccctggatggaggacaagacccacgtctccagctgggaggacgtgccgtacctcggcaagcgcgaggaccagtggtgcgggtccctgatcggcctgaccgcccgcgcgacctgggccaccaacatccaggtggccatcaaccaggtccggcgcctcatcggcaacgagaactacctggactacatgacgagcatgaagcggttcaagaacgagtccgaccccgagggggccctgtggtga

SEQ ID NO: 8888 - RNA, 9879 nt, synthetic construct
  misc_feature 1..9879: note = derived and/or modified CDS sequence (opt1) from DENV-1__KC762643__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggggagctgtgcgaggacacgctcacctacaagtgcccccgcatcaccgaggccgagcccgacgacgtggactgctggtgcaacgccaccgacacctgggtgacctacgggacctgcagccagaccggggagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatggccctgttcctcgcgcacgccatcggcaccagcatcacccagaaggggatcatcttcatcctgctgatgctcgtgaccccctccatggccatgcggtgcgtcggcatcggcagccgcgacttcgtggaggggctgtccggcgccacgtgggtggacgtcgtgctggagcacgggagctgcgtgaccaccatggccaaggacaagcccaccctcgacatcgagctgctgaagacggaggtcaccaaccccgcggtgctccggaagctgtgcatcgaggccaagatctccaacaccaccacggacagccgctgcccgacccagggcgaggccaccctggtggaggagcaggacgccaacttcgtctgccggcgcaccttcgtggaccggggctgggggaacggctgcggcctgttcggcaaggggtccctgatcacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgctcaccagcgtcgggaagctggtgcaccagatcttcggcaccgcctacggggtgctgttctccggcgtcagctggaccatgaagatcgggatcggcgtgctcctgacgtggctgggcctcaactcccgcagcacctccctgagcatgacctgcatcgccgtggggctggtcaccctctacctgggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctctccgccgccatcggcaaggcctgggaggagggggtctgcggcatccggagcgccacccgcctggagaacatcatgtggaagcagatctccaacgagctgaaccacatcctcctggagaacgacatgaagttcaccgtggtggtcggggacgtggcgggcatcctggcccaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggacagctacacccaggtgtgcgaccaccgcctgatgtccgccgccatcaaggacagcaaggccgtgcacgccgacatgggctactggatcgagtccgagaagaacgagacctggaagctcgcgcgggccagcttcatcgaggtcaagacctgcatctggcccaagtcccacacgctgtggagcaacggcgtgctggagtccgagatgatcatccccaagatctacgggggcccgaccagccagcacaactaccgccccgggtacttcacccagaccgccggcccctggcacctcgggaagctggagctggacttcgacctctgcgagggcacgaccgtggtcgtggacgagcactgcggcaaccgggggccgtccctgcgcaccaccacggtgaccggcaagatcatccacgagtggtgctgccggagctgcaccctgccgcccctgcgcttccgcggggaggacggctgctggtacgggatggagatccgccccgtcaaggagaaggaggagaacctggtgaagtccatggtgagcgccggcagcggcgaggtcgactccttcagcctggggctcctgtgcatctccatcatgatcgaggaggtgatgcggagccgctggtcccggaagatgctgatgaccggcacgctcgccgtgttcttcctgctgatcatggggcagctcacctggaacgacctgatccgcctgtgcatcatggtcggcgcgaacgccagcgaccgcatggggatgggcaccacctacctcgccctgatggccacgttcaagatgcggccgatgttcgccgtgggcctcctcttccgccggctgacctcccgcgaggtgctgctcctgaccatcgggctgagcctcgtcgcgtccgtggagctgcccaacagcctggaggagctcggcgacgggctggccatgggcatcatgatcctgaagctcctgaccgacttccagtcccaccagctgtgggccacgctcctgagcctgaccttcatcaagaccaccttctccctccactacgcctggaagacgatggcgatggtcctgagcatcgtgtccctgttccccctctgcctgagcaccacctcccagaagaccacgtggctgcccgtgctcctgggcagcctggggtgcaagccgctcaccatgttcctgatcgccgagaacaagatctggggccggaagtcctggcccctgaacgaggggatcatggccgtcggcatcgtgagcatcctcctgagctccctgctcaagaacgacgtgcccctggccgggcccctgatcgccggcggcatgctcatcgcgtgctacgtcatcagcgggtccagcgccgacctgtccctggagaaggccgccgaggtgagctgggaggaggaggccgagcactccggcgcgagccacaacatcctcgtggaggtccaggacgacgggaccatgaagatcaaggacgaggagcgcgacgacaccctgaccatcctgctcaaggccacgctgctggccgtgtccggcgtgtacccgctcagcatccccgccaccctgttcgtctggtacttctggcagaagaagaagcagcggtccggggtgctgtgggacacccccagcccgcccgaggtggagcgcgccgtcctggacgacggcatctaccggatcatgcagcgcggcctcctggggcggtcccaggtgggcgtgggggtcttccaggagaacgtgttccacaccatgtggcacgtgacgcgcggcgcggtcctgatgtaccaggggaagcggctcgagcccagctgggcctccgtgaagaaggacctgatcagctacggcggcgggtggcgcctgcagggctcctggaacaccggggaggaggtgcaggtcatcgccgtggagcccggcaagaaccccaagaacgtgcagaccgcccccgggaccttcaagacgcccgagggcgaggtcggcgccatcgcgctcgacttcaagcccgggaccagcggctcccccatcgtgaaccgggaggggaagatcgtgggcctgtacggcaacggggtcgtgaccaccagcggcacgtacgtgagcgccatcgcccaggccaaggcgtcccaggaggggccgctgcccgagatcgaggacgaggtcttccgcaagcggaacctcaccatcatggacctgcaccccggcagcgggaagacccgccggtacctgccggccatcgtgcgcgaggccatcaagcggaagctccgcaccctgatcctggcccccacgcgcgtggtcgcctccgagatggcggaggccctcaagggcatgcccatccggtaccagaccaccgccgtcaagagcgagcacaccggcaaggagatcgtggacctgatgtgccacgccacgttcaccatgcgcctgctctcccccgtccgggtgccgaactacaacatgatcatcatggacgaggcccacttcaccgaccccagctccatcgcggcccgcgggtacatcagcacccgggtgggcatgggggaggccgccgccatcttcatgacggcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctgtcccgcaagacgttcgacaccgagtaccagaagaccaagaacaacgactgggactacgtggtcaccacggacatcagcgagatgggcgcgaacttccgggccgaccgcgtgatcgacccgcggcgctgcctcaagcccgtgatcctgaaggacgggcccgagcgggtcatcctggccggccccatgccggtgaccgtcgcctccgccgcgcagcgccgggggcgcgtgggccggaaccacaacaaggagggcgaccagtacatctacatggggcagcccctcaacaacgacgaggaccacgcccactggaccgaggccaagatgctgctggacaacatcaacacccccgagggcatcatccccgccctcttcgagccggagcgcgagaagtccgccgcgatcgacggggagtaccgcctgcggggcgaggcccgcaagacgttcgtggagctgatgcggcgcggggacctccccgtctggctgtcctacaaggtggccagcgagggcttccagtacagcgaccggcgctggtgcttcgacggcgagcggaacaaccaggtgctggaggagaacatggacgtcgagatctggaccaaggagggggagcgcaagaagctccggccccgctggctggacgcccggacctactccgaccccctggccctccgcgagttcaaggagttcgcggccggccggcgcagcgtgtccggggacctgatcctggagatcggcaagctcccgcagcacctgacccagcgggcccagaacgccctggacaacctcgtgatgctgcacaacagcgagcagggcgggcgcgcgtaccggcacgccatggaggagctgcccgacacgatcgagaccctcatgctgctggccctcatcgccgtcctgaccggcggggtgaccctgttcttcctctccggccgcgggctgggcaagaccagcatcggcctgctctgcgtgatggcctccagcgtcctgctgtggatggcgtccgtggagccccactggatcgccgccagcatcatcctcgagttcttcctgatggtgctgctcatccccgagccggaccggcagcgcacgccccaggacaaccagctggcctacgtcgtgatcgggctcctcttcatgatcctgaccgtggccgcgaacgagatgggcctgctcgagaccaccaagaaggacctggggatcggccacgtcgccgtggagaaccaccaccacgccgccatgctggacgtggacctccaccccgcctccgcgtggacgctgtacgccgtcgccaccaccatcatcaccccgatgatgcggcacacgatcgagaacaccaccgccaacatcagcctgaccgccatcgcgaaccaggccgccatcctcatggggctggacaagggctggcccatctccaagatggacatcggcgtgcccctgctcgccctggggtgctacagccaggtgaaccccctgacgctcaccgcggccgtcctgatgctggtggcccactacgccatcatcggcccggggctccaggccaaggcgacccgcgaggcccagaagcgcaccgccgccggcatcatgaagaaccccacggtggacgggatcgtcgccatcgacctggaccccgtggtgtacgacgcgaagttcgagaagcagctgggccagatcatgctcctgatcctgtgcacctcccagatcctcctgatgcggaccacctgggccctgtgcgagagcatcacgctcgccaccggccccctgaccaccctgtgggaggggtccccgggcaagttctggaacacgaccatcgccgtcagcatggccaacatcttccgcgggtcctacctcgcgggcgccggcctggccttcagcctgatgaagtccctcgggggcgggcggcgcggcaccggggcccagggcgagaccctgggcgagaagtggaagcggcagctgaaccagctctccaagagcgagttcaacacgtacaagcgctccgggatcatggaggtggaccggagcgaggcgaaggagggcctgaagcgcggggagaccaccaagcacgccgtgtcccggggcaccgccaagctgcgctggttcgtcgagcggaacctggtgaagcccgaggggaaggtgatcgacctcggctgcggccgcgggggctggagctactactgcgccgggctgaagaaggtcacggaggtgaagggctacaccaagggcgggcccggccacgaggagcccatcccgatggccacctacgggtggaacctggtgaagctccactccggcaaggacgtcttcttcatcccgcccgagaagtgcgacaccctgctgtgcgacatcggggagagctcccccaacccgacgatcgaggagggccggaccctccgcgtgctgaagatggtggagccctggctgcgggggaaccagttctgcatcaagatcctcaacccctacatgcccagcgtcgtggagaccctggagcagatgcagcgcaagcacggcggcatgctggtgcggaacccgctctcccgcaacagcacccacgagatgtactgggtctcctgcgggaccggcaacatcgtgagcgcggtgaacatgacgtcccggatgctgctgaaccgcttcaccatggcccaccgcaagcccacctacgagcgggacgtcgacctcggggccggcacccgccacgtggccgtggagcccgaggtcgccaacctggacatcatcggccagcggatcgagaacatcaagcacgagcacaagagcacgtggcactacgacgaggacaacccctacaagacctgggcgtaccacgggtcctacgaggtgaagccgagcggctccgccagcagcatggtcaacggggtggtgaagctgctcaccaagccctgggacgtcatccccatggtgacccagatcgccatgacggacaccacccccttcggccagcagcgcgtgttcaaggagaaggtcgacacccggacgccgaaggccaagcgcgggaccacccagatcatggaggtgaccgcccggtggctgtggggcttcctgtcccgcaacaagaagccccggatctgcacgcgcgaggagttcatccggaaggtgcgcagcaacgcggccatcggcgccgtcttcgtggacgagaaccagtggaactccgccaaggaggcggtggaggacgagcggttctgggacctcgtccaccgcgagcgggagctgcacaagcaggggaagtgcgcgacctgcgtgtacaacatgatgggcaagcgcgagaagaagctgggggagttcggcaaggccaaggggagccgggccatctggtacatgtggctcggcgcccgcttcctggagttcgaggcgctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcacggaggacgacctgcagaacgaggccaagatcaccgacatcatggagccggagcacgccctgctcgcgaaggccatcttcaagctgacctaccagaacaaggtcgtgcgcgtgcagcgccccgccaagaacgggaccgtcatggacgtgatctcccggcgcgaccagcggggcagcggccaggtggggacgtacggcctgaacaccttcaccaacatggaggcccagctcatccgccagatggagtccgaggggatcttcagcccctccgagctggagacccccaacctggccgagcgggtcctcgactggctggagaagtacggcgtggagcgcctgaagcggatggcgatcagcggggacgactgcgtggtcaagccgatcgacgaccgcttcgccacggccctcaccgccctgaacgacatgggcaaggtgcggaaggacatcccccagtgggagccctccaaggggtggaacgactggcagcaggtccccttctgcagccaccacttccaccagctgatcatgaaggacggccgcgagatcgtcgtgccgtgccggaaccaggacgagctcgtgggccgcgcccgggtctcccagggggcgggctggagcctgcgcgagaccgcctgcctgggcaagagctacgcccagatgtggcagctcatgtacttccaccggcgcgacctgcggctggccgcgaacgccatctgctccgccgtgcccgtggactgggtccccaccagccgcacgacctggtccatccacgcccaccaccagtggatgaccaccgaggacatgctcagcgtgtggaaccgggtgtggatcgaggagaacccctggatggaggacaaggcccacgtctccagctgggaggacgtgccgtacctgggcaagcgcgaggaccagtggtgcgggtccctgatcggcctcacggcgcgcgccacctgggccaccaacatccaggtggccatcaaccaggtccggcgcctgatcggcaacgagaactacctggactacatgaccagcatgaagcggttcaagaacgagtccgaccccgagggggccctctggtga

SEQ ID NO: 8889 - RNA, 9879 nt, synthetic construct
  misc_feature 1..9879: note = derived and/or modified CDS sequence (opt1) from DENV-1__KC762651__SS-prME
  source 1..9879: mol_type = other RNA
agcgtgaccatgctgttcatgctcctgcccaccgccctggccttccacctcaccacccgcggcggggagccccacatgatcgtgtccaagcaggagcggggcaagagcctgctgttcaagacctccgccggggtgaacatgtgcaccctcatcgccatggacctgggcgagctgtgcgaggacaccatgacctacaagtgcccccgcatcaccgagaccgagcccgacgacgtggactgctggtgcaacgccaccgagacctgggtgacctacgggacctgcagccagaccggcgagcaccggcgcgacaagcggtccgtggccctcgcgccccacgtgggcctggggctggagacccgcaccgagacctggatgagctccgagggcgcctggaagcagatccagaaggtggagacgtgggccctccggcaccccgggttcaccgtgatcgccctgttcctggcccacgcgatcggcaccagcatcacccagaaggggatcatcttcatcctcctgatgctggtgacgccctccatggccatgcgctgcgtcggcatcggcaaccgggacttcgtggaggggctcagcggcgccacctgggtggacgtcgtgctggagcacgggtcctgcgtgaccaccatggccaaggacaagcccacgctggacatcgagctcctgaagaccgaggtcaccaaccccgccgtgctgcgcaagctctgcatcgaggcgaagatcagcaacaccacgaccgactcccggtgccccacccagggcgaggccaccctggtggaggagcaggacacgaacttcgtctgccgccggaccttcgtggaccgcggctgggggaacggctgcgggctgttcggcaaggggagcctcatcacgtgcgccaagttcaagtgcgtgaccaagctggagggcaagatcgtccagtacgagaacctgaagtactccgtgatcgtgacggtccacaccggcgaccagcaccaggtggggaacgagaccaccgagcacggcaccacggccaccatcacgccccaggcccccaccagcgagatccagctcacggactacggggcgctgaccctggactgcagcccccggaccggcctcgacttcaacgagatggtcctgctgaccatgaaggagaagtcctggctcgtgcacaagcagtggttcctggacctgccgctcccctggacgtccggggccagcaccagccaggagacctggaaccgccaggacctgctggtgaccttcaagacggcccacgccaagaagcaggaggtcgtggtgctcggctcccaggagggcgccatgcacaccgcgctgaccggggccaccgagatccagacgagcggcaccaccaccatcttcgccgggcacctgaagtgccggctcaagatggacaagctgacgctgaagggcgtctcctacgtgatgtgcaccgggagcttcaagctcgagaaggaggtggccgagacccagcacggcaccgtcctggtccaggtgaagtacgagggcacggacgccccctgcaagatccccttctccagccaggacgagcgcggggtcatccagaacggccggctgatcaccgcgaacccgatcgtgaccgacaaggagaagcccgtgaacatcgaggccgagccgcccttcggggagtcctacatcgtcgtgggcgccggcgagaaggccctgaagctcagctggttcaagaaggggtccagcatcggcaagatgttcgaggcgaccgcccgcggggcccggcgcatggccatcctgggcgacacggcctgggacttcgggtccatcggcggcgtgttcaccagcgtcgggaagctggtgcaccagatcttcggcaccgcgtacggggtgctgttctccggcgtcagctggaccatgaagatcgggatcggcatcctgctgacgtggctcggcctgaactcccgcagcacctccctgagcatgacctgcatcgccgtggggatggtgaccctctacctgggcgtcatggtgcaggccgactccgggtgcgtgatcaactggaagggccgggagctgaagtgcgggagcggcatcttcgtcacgaacgaggtgcacacctggaccgagcagtacaagttccaggccgacagcccgaagcgcctctccgccgcgatcggcaaggcctgggaggagggggtgtgcggcatccggagcgccacccgcctggagaacatcatgtggaagcagatctccaacgagctgaaccacatcctcctggagaacgacatgaagttcaccgtcgtggtgggggacgtcagcggcatcctggcccaggggaagaagatgatccggccccagcccatggagcacaagtactcctggaagtcctggggcaaggccaagatcatcggcgcggacgtgcagaacacgaccttcatcatcgacgggcccaacaccccggagtgccccgacaaccagcgcgcctggaacatctgggaggtggaggactacggcttcggggtcttcaccacgaacatctggctcaagctgcgggactcctacacccaggtgtgcgaccaccgcctgatgagcgccgccatcaaggactccaaggcggtgcacgccgacatgggctactggatcgagagcgagaagaacgagacctggaagctcgagcgggcctccttcatcgaggtcaagacctgcatctggccccgcagccacacgctgtggtccaacggcgtgctggagagcgagatgatcatccccaagacctacgggggcccggtgtcccagcacaactaccggcccgggtacttcacccagaccgccggcccctggcacctcgggaagctggagctggacttcaacctctgcgagggcacgaccgtcgtggtggacgagaactgcggcaaccgcgggccgagcctgcggaccaccacggtcaccggcaagatcatccacgagtggtgctgccgctcctgcaccctgccgcccctccggttcaagggggaggacggctgctggtacgggatggagatccgccccgtgaaggagaaggaggagaacctggtcaagagcatggtcagcgccggctccggcgaggtggacagcttctccctggggctcctgtgcatcagcatcatgatcgaggaggtgatgcggtcccgctggagcggcaagatgctgatgaccgggacgctcgcggtcttcctgctgctcaccatgggccagctgacctggaacgacctgatccggctctgcatcatggtgggggccaacgcctccgacatgatgggcatgggcaccacgtacctggccctgatggccaccttccgcatgcgcccgatgttcgcggtcgggctcctgttccggcgcctgaccagccgggaggtgctcctgctgaccgtgggcctctccctggtcgccagcgtggagctgcccaactccctcgaggagctgggggacggcctggccatgggcatcatgatgctcaagctgctgacggacttccagagccaccagctctgggccaccctgctgtccctcaccttcgtgaagaccgccttcagcctgcactacgcgtggaagacgatggccatgatcctgtccatcgtcagcctcttccccctgtgcctgtccaccaccagccagaagaccacgtggctccccgtgctgctggggtccctcggctgcaagccgctgaccatgctgctcatcaccgagaacaagatctgggggcgccggagctggcccctgaacgagggcatcatggccatcgggatcgtgagcatcctgctctccagcctgctgaagaacgacgtccccctcgccggccccctgatcgcgggcgggatgctgatcgcctgctacgtgatctccggcagctccgccgacctcagcctggagaaggccgccgaggtgtcctgggaggacgaggcggagcacagcggggcctcccacaacatcctggtcgaggtgcaggacgacggcaccatgaagatcaaggacgaggagcgcgacgacaccctcacgatcctgctgaaggccaccctcctggccatcagcggggtgtacccgatgtccatccccgccaccctgttcgtctggtacttctggcagaagaagaagcagcggagcggcgtgctctgggacacccccagcccgcccgaggtggagcgcgcggtcctggacgacggcatctaccggatcctgcagcgcgggctgctcggccggagccaggtgggggtgggcgtcttccaggagggggtgttccacacgatgtggcacgtgacccgcggcgccgtcctgatgtaccagggcaagcggctggagccctcctgggccagcgtgaagaaggacctcatctcctacgggggcgggtggcgcttccagggcagctggaacaccggggaggaggtgcaggtcatcgccgtggagcccggcaagaaccccaagaacgtgcagaccacgcccggcaccttcaagacctccgagggggaggtcggcgccatcgcgctggacttcaagcccgggaccagcggcagccccatcgtgaaccgggagggcaagatcgtggggctgtacggcaacggggtcgtgacgacctccggcacctacgtgagcgccatcgcccaggccaaggcctcccaggaggggcccctcccggagatcgaggacgaggtcttccgcaagcggaacctgaccatcatggacctgcaccccggcagcggcaagacgcgccggtacctccccgcgatcctgcgcgaggccatcaagcggaagctgcgcaccctcgtgctggccccgacccgcgtggtcgcctccgagatggcggaggccctgaaggggatgcccatccggtaccagaccacggccgtcaagagcgagcacaccggcaaggagatcgtggacctcatgtgccacgccaccttcaccatgcgcctgctgtcccccgtccgggtgcccaactacaacatgatcatcatggacgaggcccacttcacggacccggcgagcatcgccgcccgcgggtacatctccacccgggtgggcatgggggaggccgccgcgatcttcatgaccgccacgccgcccggcagcgtcgaggccttcccccagtccaacgccgtgatccaggacgaggagcgcgacatcccggagcggagctggaactccggctacgactggatcacggacttccccgggaagaccgtgtggttcgtccccagcatcaagtccggcaacgacatcgccaactgcctccgcaagaacgggaagcgggtggtgcagctgagccgcaagaccttcgacaccgagtaccagaagacgaagaacaacgactgggactacgtcgtgaccaccgacatctccgagatgggcgcgaacttccgggccgaccgcgtcatcgacccccggcgctgcctgaagccggtgatcctcaaggacgggcccgagcgggtgatcctggccggccccatgcccgtcaccgtggccagcgcggcccagcgccggggccgcatcgggcggaacccgaacaaggagggcgaccagtacgtgtacatggggcagcccctgaacaacgacgaggaccacgcccactggacggaggccaagatgctcctggacaacatcaacacccccgagggcatcatccccgccctgttcgagccggagcgcgagaagtccgcggccatcgacggggagtaccgcctccggggcgaggcccgcaagaccttcgtcgagctgatgcggcgcggcgacctgcccgtgtggctcagctacaaggtggccagcgaggggttccagtactccgaccggcgctggtgcttcgacggcgagcggaacaaccaggtcctggaggagaacatggacgtggagatctggaccaaggagggggagcgcaagaagctgcggccccgctggctcgacgcccggacgtacagcgaccccctggcgctgcgcgagttcaaggagttcgccgccggccggcgctccgtgagcggcgacctcatcctggagatcgggaagctgccgcagcacctcacccagaaggcccagaacgccctggacaacctggtcatgctccacaactccgagcagggcgggaaggcgtaccggcacgccatggaggagctgcccgacaccatcgagaccctgatgctcctggccctgatcgccgtgctcaccggcggggtgacgctgttcttcctgagcggccgcggcctcgggaagacctccatcggcctgctgtgcgtcatggcgagctccgccctcctgtggatggccagcgtggagccccactggatcgccgcctccatcatcctggagttcttcctcatggtgctgctgatccccgagccggaccggcagcgcacgccccaggacaaccagctcgcgtacgtcgtgatcgggctgctgttcatgatcctcaccgtggccgccaacgagatgggcctgctggagacgaccaagaaggacctcgggatcggccacgccgccgcggagaaccaccaccacgccgccatgctggacgtcgacctgcaccccgccagcgcctggaccctctacgcggtggccaccacgatcatcaccccgatgatgcggcacaccatcgagaacaccacggccaacatctccctgaccgccatcgccaaccaggcggccatcctgatgggcctcgacaaggggtggcccatcagcaagatggacatcggcgtgcccctgctggccctcgggtgctactcccaggtcaaccccctgaccctgaccgccgcggtgctcatgctggtggcccactacgccatcatcggcccggggctgcaggccaaggccacgcgcgaggcgcagaagcggaccgccgccggcatcatgaagaaccccaccgtcgacggcatcgtggccatcgacctcgaccccgtggtctacgacgccaagttcgagaagcagctggggcagatcatgctgctcatcctgtgcaccagccagatcctgctcatgcgcacgacctgggcgctgtgcgagtccatcaccctggccaccggccccctcacgaccctgtgggaggggagcccgggcaagttctggaacaccaccatcgccgtgtccatggccaacatcttccgcggcagctacctggccggggcgggcctcgccttcagcctgatgaagtccctcgggggcgggcggcgcgggacgggcgcccagggggagaccctcggcgagaagtggaagcggcagctgaaccagctgagcaagtccgagttcaacatctacaagcgcagcgggatcatggaggtggaccggtccgaggccaaggagggcctcaagcgcggggagaccaccaagcacgcggtcagccggggcacggccaagctgcgctggttcgtggagcggaacctggtgaagcccgagggcaaggtcatcgacctggggtgcggccgcgggggctggtcctactactgcgccgggctcaagaaggtgaccgaggtgaagggctacaccaagggcgggcccggccacgaggagcccgtcccgatggccacctacgggtggaacctggtgaagctgcacagcggcaaggacgtgttcttcacgccgcccgagaagtgcgacaccctcctgtgcgacatcggggagtccagccccaacccgaccatcgaggagggccggaccctgcgcgtcctcaagatggtggagccctggctgcggggcaaccagttctgcatcaagatcctgaacccctacatgccctccgtggtcgagaccctcgagcagatgcagcgcaagcacgggggcatgctggtgcggaacccgctgagccgcaactccacgcacgagatgtactgggtgagctgcgggaccggcaacatcgtctccgccgtgaacatgaccagccggatgctcctgaaccgcttcaccatggcgcaccggaagcccacgtacgagcgcgacgtggacctgggcgccgggacccgccacgtcgccgtggagcccgaggtcgccaacctcgacatcatcggccagcggatcgagaacatcaagaacgagcacaagtccacctggcactacgacgaggacaacccctacaagacctgggcctaccacgggagctacgaggtgaagccgtccggcagcgcgagctccatggtgaacggggtcgtgcgcctgctgacgaagccctgggacgtgatccccatggtcacccagatcgccatgaccgacaccacgcccttcggccagcagcgggtgttcaaggagaaggtggacacccgcaccccgaaggccaagcggggcaccgcccagatcatggaggtcacggccaagtggctctgggggttcctgagccgcaacaagaagccccggatctgcacccgcgaggagttcacccggaaggtgcgctccaacgcggccatcggcgccgtgttcgtcgacgagaaccagtggaacagcgccaaggaggcggtggaggacgagcggttctgggacctggtgcaccgcgagcgggagctccacaagcaggggaagtgcgcgacctgcgtctacaacatgatgggcaagcgcgagaagaagctgggggagttcggcaaggccaagggctcccgggccatctggtacatgtggctgggggcccgcttcctcgagttcgaggcgctgggcttcatgaacgaggaccactggttcagccgggagaactccctgagcggggtggagggcgaggggctccacaagctgggctacatcctgcgcgacatctccaagatccccggcgggaacctctacgccgacgacacggccggctgggacacccggatcaccgaggacgacctgcagaacgaggccaagatcaccgacatcatggagccggagcacgccctgctcgcgacgagcatcttcaagctgacctaccagaacaaggtggtccgcgtgcagcggcccgccaagaacgggaccgtgatggacgtcatctcccgccgcgaccagcggggcagcggccaggtggggacctacggcctgaacacgttcaccaacatggaggcccagctcatccgccagatggagtccgaggggatcttcagcccctccgagctggagacccccaacctggccaagcgggtgctcgactggctggagaagcacggcatcgagcgcctgaagcggatggccatcagcggggacgactgcgtcgtgaagccgatcgacgaccgcttcgcgaccgccctcacggccctgaacgacatgggcaaggtgcggaaggacatcccccagtgggagccctccaagggctggaacgactggcagcaggtccccttctgcagccaccacttccaccagctgatcatgaaggacgggcgcgagatcgtggtgccgtgccggaaccaggacgagctcatcggccgcgcccgggtcagccagggggccggctggtccctgcgcgagaccgcgtgcctgggcaagagctacgcccagatgtggcagctcatgtacttccaccggcgcgacctgcggctggccgccaacgcgatctgctccgccgtgcccgtggactgggtccccaccagccgcaccacgtggtccatccacgcccaccaccagtggatgaccaccgaggacatgctcagcgtgtggaaccgggtgtggatcgaggagaacccctggatggaggacaagacccacgtctccagctgggaggacgtgccgtacctgggcaagcgcgaggaccagtggtgcggctccctgatcgggctcaccgcccgggccacgtgggcgagcaacatccaggtggccatcaaccaggtccgccgcctgatcggcaacgagaactacctggactacatgacctccatgaagcggttcaagaacgagagcgaccccgagggggccctctggtga

SEQ ID NO: 8890 - RNA, 9879 nt, synthetic construct
  misc_feature 1..9879: note = derived and/or modified CDS sequence (opt1) from DENV-1__KC762653__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgccggggtgaacatgtgcaccctgatcgccatggacctgggggagctctgcgaggacaccatgacctacaagtgcccccggatcaccgagaccgagcccgacgacgtggactgctggtgcaacgccaccgagacctgggtgacctacgggacctgctaccagaccggggagcaccggcgcgacaagcggagcgtggccctggcgccccacgtgggcctggggctcgagacccgcaccgagacctggatgtccagcgagggcgcctggcggcagatccagaaggtcgagacgtgggccctgcgccaccccgggttcaccgtgatcgccctgttcctcgcccacgcgatcggcacctccatcacccagaaggggatcatcttcatcctgctgatgctcgtgacgcccagcatggccatgcggtgcgtcggcatcggcaaccgcgacttcgtggaggggctgtccggcgccacctgggtggacgtcgtgctggagcacgggagctgcgtgaccaccatggccaaggacaagcccacgctcgacatcgagctgctgaagaccgaggtcaccaaccccgccgtgctccggaagctgtgcatcgaggcgaagatctccaacaccacgaccgacagccgctgccccacccagggcgaggccaccctggtggaggagcaggacacgaacttcgtctgccggcgcaccttcgtggaccggggctgggggaacggctgcggcctcttcggcaaggggtccctgatcacgtgcgccaagttcaagtgcgtgaccaagctggagggcaagatcgtccagtacgagaacctcaagtacagcgtgatcgtgacggtccacaccggcgaccagcaccaggtggggaacgagaccaccgagcacggcaccacggccaccatcacgccccaggcccccacctccgagatccagctgacggactacggggcgctgaccctcgactgcagcccccgcaccggcctggacttcaacgagatggtcctgctcaccatgaaggagaagtcctggctggtgcacaagcagtggttcctggacctcccgctgccctggacgagcggggcctccaccagccaggagacctggaaccggcaggacctgctcgtgaccttcaagacggcccacgccaagaagcaggaggtcgtggtgctgggcagccaggagggcgccatgcacaccgcgctgaccggggccaccgagatccagacgtccggcaccaccaccatcttcgccgggcacctcaagtgccgcctgaagatggacaagctgacgctcaagggcatgagctacgtcatgtgcaccgggtccttcaagctggagaaggaggtggccgagacccagcacggcaccgtgctggtccaggtgaagtacgagggcacggacgccccctgcaagatccccttcagctcccaggacgagaagggggtgacccagaacggccggctgatcaccgcgaacccgatcgtcaccgacaaggagaagcccgtgaacatcgaggccgagccgcccttcggggagagctacctcgtggtcggcgccggcgagaaggccctgaagctgtcctggttcaagaaggggagctccatcggcaagatgttcgaggcgacggcccgcggggcccggcgcatggccatcctcggcgacaccgcctgggacttcgggagcatcggcggcgtgttcacctccgtggggaagctgatccaccagatcttcggcaccgcgtacggggtcctgttcagcggcgtgtcctggacgatgaagatcgggatcggcatcctcctgacctggctgggcctcaacagccgctccaccagcctgtccatgacctgcatcgccgtggggatgatcacgctgtacctcggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctgagcgccgcgatcggcaaggcctgggaggagggggtgtgcggcatccggtccgccacccgcctcgagaacatcatgtggaagcagatcagcaacgagctgaaccacatcctgctcgagaacgacatgaagttcacggtcgtggtgggggaggtcaacggcatcctggcccaggggaagaagatgatccggccccagcccatggagcacaagtactcctggaagtcctggggcaaggccaaggtgatcggcgcggacgtgcagaacaccaccttcatcatcgacgggcccaacaccccggagtgccccgacaaccagcgcgcctggaacatctgggaggtcgaggactacggcttcgggatcttcacgaccaacatctggctgaagctccgggactcctacacccaggtgtgcgaccaccgcctgatgagcgccgccatcaaggactccaaggcggtgcacgccgacatgggctactggatcgagagcgagaagaacgagacctggaagctggcccgggcctccttcatcgaggtcaagacgtgcatctggcccaagagccacaccctctggtccaacggcgtgctggagagcgagatgatcatccccaagatctacgggggcccgatctcccagcacaactaccgccccgggtacttcacccagaccgccggcccctggcacctggggaagctcgagctggacttcgagctgtgcgagggcacgaccgtggtcgtggacgagcactgcggcaaccgggggccgagcctccgcaccaccacggtgaccggcaagatcatccacgagtggtgctgccggtcctgcaccctgccgcccctgcgcttcaagggggaggacggctgctggtacgggatggagatccggcccgtcaaggagaaggaggagaacctcgtcaagagcatggtgtccgcgggcagcggcgaggtcgacagcttctccctggggctgctctgcatcagcatcatgatcgaggaggtgatgcgctcccggtggagccgcaagatgctgatgaccggcacgctggccgtgttcctcctgctgaccatggggcagctcacctggaacgacctgatccggctgtgcatcatggtcggcgccaacgcctccgacaagatggggatgggcaccacgtacctcgccctgatggcgaccttccgcatgcgcccgatgctggccgtgggcctcctgttccggcgcctgaccagccgggaggtgctcctgctgaccgtcgggctctccctggtggccagcgtcgagctgcccaactccctcgaggagctgggcgacgggctggccatgggcatcatgatgctcaagctgctgacggacttccagagccaccagctctgggccgcgctgctgtccctcaccttcgtgaagaccaccctgagcctgcactacgcctggaagacgatggccatgatcctctccatcgtgagcctgttccccctgtgcctctccaccaccagccagaagaccacgtggctgcccgtcctgctcggctccctggggtgcaagccgctgaccatgttcctcatcaccgagaacaagatctggggccgcaagagctggcccctgaacgaggggatcatggccgtgggcatcgtgtccatcctgctcagcagcctgctgaagaacgacgtccccctcgcggggcccctgatcgccggcggcatgctgatcgcctgctacgtgatctccgggagctccgccgacctcagcctggagaaggccgcggaggtgtcctgggaggaggaggccgagcacagcggcgcctcccacaacatcctggtcgaggtgcaggacgacgggaccatgaagatcaaggacgaggagcgggacgacaccctcacgatcctgctgaaggccaccctcctggccatcagcggcgtgtacccgatgtccatccccgcgaccctgttcgtctggtacttctggcagaagaagaagcagcgcagcggggtgctgtgggacacccccagcccgcccgaggtggagaaggccgtcctcgacgacggcatctaccggatcctgcagcgcggcctgctcggcaagagccaggtgggcgtgggggtcttccaggagggcgtgttccacacgatgtggcacgtgacccgcggggccgtcctgatgtaccagggcaagcgcctggagccctcctgggccagcgtgaagaaggacctcatctcctacggcgggggctggcggttccaggggagctggaacaccggcgaggaggtgcaggtcatcgccgtggagcccgggaagaaccccaagaacgtgcagaccgcgcccggcacgttcaagacccccgagggcgaggtcggggccatcgccctggacttcaagcccggcacctccgggagccccatcgtgaaccgcgagggcaagatcgtgggcctgtacgggaacggcgtcgtgaccacgtccgggacctacgtgagcgccatcgcccaggcgaaggccagccaggagggcccgctccccgagatcgaggacgaggtcttccggaagcgcaacctgaccatcatggacctgcaccccgggtccggcaagacccggcgctacctcccggccatcgtgcgggaggccatcaagcgcaagctgcggacgctggtgctcgcgcccacccgcgtcgtggccagcgagatggccgaggccctgaagggcatgcccatccggtaccagaccaccgccgtgaagtccgagcacacggggaaggagatcgtcgacctgatgtgccacgcgaccttcaccatgcgcctcctgagccccgtgcgcgtgccgaactacaacatgatcatcatggacgaggcccacttcaccgaccccgcctccatcgccgcccggggctacatcagcacgcgcgtcgggatgggcgaggcggccgccatcttcatgaccgccacgccgcccgggtccatggaggccttcccgcagagcaacgcggccatccaggacgaggagcgggacatccccgagcgctcctggaacagcggctacgactggatcaccgacttccccggcaagacggtgtggttcgtgccctccatcaagagcgggaacgacatcgccaactgcctgcggaagaacggcaagcgcgtcatccagctctcccggaagaccttcgacaccgagtaccagaagaccaagaacaacgactgggactacgtggtgacgaccgacatcagcgagatgggggccaacttccgcgcggaccgggtcatcgacccgcgccggtgcctgaagcccgtgatcctgaaggacggccccgagcgcgtgatcctcgccgggcccatgccggtcaccgtggcctccgccgcccagcggcgcggccggatcggccgcaaccagaacaaggagggggaccagtacatctacatgggccagcccctgaacaacgacgaggaccacgcgcactggaccgaggccaagatgctgctcgacaacatcaacacgcccgaggggatcatccccgccctgttcgagccggagcgggagaagtccgccgccatcgacggcgagtaccgcctgcgcggggaggcgcgcaagaccttcgtcgagctcatgcgccggggcgacctgcccgtgtggctgtcctacaaggtggccagcgagggcttccagtactccgaccgccggtggtgcttcgacggggagcgcaacaaccaggtcctcgaggagaacatggacgtggagatctggaccaaggagggcgagcggaagaagctgcgcccccggtggctggacgcccgcacctacagcgaccccctcgccctgcgggagttcaaggagttcgccgcggggcgccggagcgtgtccggcgacctgatcctcgagatcggcaagctgccgcagcacctgacgcagcgcgcccagaacgccctcgacaacctggtcatgctgcacaacagcgagcagggcgggaaggcctaccggcacgcgatggaggagctccccgacaccatcgagaccctgatgctgctcgccctgatcgccgtgctgaccgggggcgtgaccctcttcttcctgtccgggcgcggcctgggcaagacgagcatcgggctcctgtgcgtcatggcctccagcgccctgctctggatggcgtccgtggagccccactggatcgccgccagcatcatcctggagttcttcctgatggtgctcctgatccccgagccggaccggcagcgcacgccccaggacaaccagctggcctacgtcgtgatcggcctcctgttcatgatcctgaccgtggccgcgaacgagatggggctcctggagaccacgaagaaggacctgggcatcgggcacgccgccgccgagaaccaccaccacgccgcgatgctcgacgtcgacctgcaccccgcctccgcctggaccctgtacgccgtggccaccaccatcatcacgccgatgatgcggcacaccatcgagaacaccaccgcgaacatcagcctcacggccatcgccaaccaggccgcgatcctgatgggcctggacaagggctggcccatctccaagatggacatcggggtgcccctcctggccctgggctgctacagccaggtcaaccccctcaccctgaccgccgccgtgctgatgctcgtggcccactacgcgatcatcgggccgggcctgcaggccaaggccacccgcgaggcccagaagcggacggccgcggggatcatgaagaaccccaccgtcgacggcatcgtggccatcgacctggaccccgtggtctacgacgccaagttcgagaagcagctcggccagatcatgctgctgatcctctgcacctcccagatcctgctgatgcgcaccacgtgggccctctgcgagagcatcaccctggccaccgggcccctgaccacgctctgggagggctccccggggaagttctggaacaccaccatcgcggtgagcatggccaacatcttccggggctcctacctggccggcgccgggctggcgttcagcctcatgaagtccctgggcgggggccgccgcgggaccggcgcccagggcgagacgctgggggagaagtggaagcggcagctcaaccagctgagcaagagcgagttcaacacctacaagcgctccggcatcatggaggtggaccggagcgaggccaaggaggggctgaagcgcggcgagaccaccaagcacgccgtctcccgggggacggccaagctgcgctggttcgtggagcggaacctcgtgaagcccgagggcaaggtcatcgacctgggctgcgggcgcggcgggtggagctactactgcgcgggcctgaagaaggtgaccgaggtgaaggggtacaccaagggcggccccgggcacgaggagcccatcccgatggccacctacggctggaacctcgtcaagctgcactccgggaaggacgtgttcttcacgccgcccgagaagtgcgacaccctgctctgcgacatcggcgagagctcccccaacccgaccatcgaggaggggcggaccctgcgcgtgctgaagatggtcgagccctggctccggggcaaccagttctgcatcaaggtgctgaacccctacatgcccagcgtgatcgagaccctggagcagatgcagcgcaagcacggcgggatgctcgtccggaacccgctgtcccgcaacagcacgcacgagatgtactgggtgtcctgcggcaccgggaacatcgtgagcgccgtcaacatgacctcccggatgctgctcaaccgcttcaccatggcccaccggaagcccacgtacgagcgcgacgtggacctgggcgccggcacccggcacgtggcggtcgagcccgaggtggccaacctggacatcatcgggcagcgcatcgagaacatcaagaacgagcacaagagcacctggcactacgacgaggacaacccctacaagacctgggcctaccacggctcctacgaggtgaagccgagcgggtccgccagctccatggtcaacggcgtggtgcgcctcctgacgaagccctgggacgtcatccccatggtgacccagatcgccatgaccgacaccacgcccttcgggcagcagcgggtcttcaaggagaaggtggacacccgcaccccgaaggcgaagcggggcaccgcccagatcatggaggtgacggcccgctggctgtggggcttcctcagccggaacaagaagccccgcatctgcacccgggaggagttcacccgcaaggtccggagcaacgccgcgatcggggccgtgttcgtggacgagaaccagtggaactccgccaaggaggccgtcgaggacgagcgcttctgggacctggtgcaccgggagcgcgagctgcacaagcagggcaagtgcgcgacctgcgtgtacaacatgatggggaagcgggagaagaagctcggcgagttcgggaaggcgaagggcagccgcgccatctggtacatgtggctgggcgcccggttcctggagttcgaggccctcgggttcatgaacgaggaccactggttctcccgcgagaacagcctgtccggcgtcgagggggagggcctgcacaagctcgggtacatcctgcgggacatcagcaagatccccggcggcaacatgtacgccgacgacacggcggggtgggacacccgcatcaccgaggacgacctgcagaacgaggccaagatcaccgacatcatggagccggagcacgccctcctggccacgtccatcttcaagctgacctaccagaacaaggtggtgcgggtccagcgccccgccaagaacggcaccgtgatggacgtgatcagccggcgcgaccagcgcgggtccggccaggtcggcacctacgggctcaacacgttcaccaacatggaggcgcagctgatccggcagatggagagcgagggcatcttcaccccctccgagctggagacccccaacctcgccgagcgcgtgctggactggctggagaagcacgggatcgagcggctcaagcgcatggccatcagcggcgacgactgcgtggtcaagccgatcgacgaccggttcgccacggccctgaccgcgctgaacgacatggggaaggtgcgcaaggacatcccccagtgggagccctccaagggctggaacgactggcagcaggtccccttctgcagccaccacttccaccagctcatcatgaaggacggccgggagatcgtcgtgccgtgccgcaaccaggacgagctggtggggcgggcccgcgtctcccagggcgccgggtggagcctgcgggagaccgcctgcctcggcaagtcctacgcgcagatgtggcagctgatgtacttccaccgccgggacctgcgcctcgccgccaacgccatctgcagcgccgtgcccgtggactgggtccccaccagccggacgacctggtccatccacgcgcaccaccagtggatgaccaccgaggacatgctgagcgtgtggaaccgcgtgtggatcgaggagaacccctggatggaggacaagacccacgtctccagctgggaggacgtgccgtacctggggaagcgggaggaccagtggtgcggctccctcatcggcctgacggcccgcgccacctgggccaccaacatccaggtggccatcaaccaggtccggcgcctgatcgggaacgagaactacctcgactacatgaccagcatgaagcgcttcaagaacgagtccgaccccgagggcgcgctgtggtga

SEQ ID NO: 8891 - RNA, 9879 nt, synthetic construct
  misc_feature 1..9879: note = derived and/or modified CDS sequence (opt1) from DENV-1__KC762640__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgccggggtgaacatgtgcaccctgatcgccatggacctgggcgagctctgcgaggacaccatgacctacaagtgcccccgcatcaccgagaccgagcccgacgacgtggactgctggtgcaacgccaccgagacctgggtgacctacgggacctgcagccagaccggcgagcaccggcgcgacaagcggtccgtggccctggcgccccacgtgggcctggggctcgagacccgcaccgagacctggatgagctccgagggcgcgtggcggcagatccagaaggtggagacgtgggccctgcgccaccccgggttcaccgtgatcgccctgttcctcgcccacgcgatcggcaccagcatcacccagaaggggatcatcttcatcctgctgatgctcgtgacgccctccatggccatgcggtgcgtgggcatcggcaaccgcgacttcgtggaggggctgagcggcgccacctgggtggacgtcgtgctggagcacgggtcctgcgtgaccaccatggccaaggacaagcccacgctcgacatcgagctgctgaagaccgaggtcaccaaccccgccgtgctccggaagctgtgcatcgaggcgaagatcagcaacaccacgaccgactcccgctgccccacccagggcgaggccaccctggtggaggagcaggacacgaacttcgtctgccggcgcaccttcgtggaccggggctgggggaacggctgcggcctgttcggcaaggggagcctgatcacgtgcgccaagttcaagtgcgtgaccaagctggagggcaagatcgtccagtacgagaacctcaagtactccgtgatcgtgacggtccacaccggcgaccagcaccaggtggggaacgagaccaccgagcacggcaccacggccaccatcacgccccaggcccccaccagcgagatccagctgacggactacggggcgctgaccctcgactgcagcccccggaccggcctggacttcaacgagatggtcctgctcaccatgaaggagaagtcctggctggtgcacaagcagtggttcctggacctcccgctgccctggacgtccggggccagcaccagccaggagacctggaaccggcaggacctgctcgtgaccttcaagacggcccacgccaagaagcaggaggtcgtggtgctgggctcccaggagggcgccatgcacaccgcgctgaccggggccaccgagatccagacgagcggcaccaccaccatcttcgccgggcacctcaagtgccgcctgaagatggacaagctgacgctcaagggcgtctcctacgtgatgtgcaccgggagcttcaagctggagaaggaggtggccgagacccagcacggcaccgtcctggtccaggtgaagtacgagggcacggacgccccctgcaagatccccttctccagccaggacgagaagggggtcacccagaacggccggctgatcaccgcgaacccgatcgtgaccgacaaggagaagcccgtgaacatcgaggccgagccgcccttcggggagtcctacctcgtcgtgggcgccggcgagaaggccctgaagctgagctggttcaagaaggggtccagcatcggcaagatgttcgaggcgacggcccgcggggcccggcgcatggccatcctcggcgacaccgcctgggacttcgggtccatcggcggcgtgttcaccagcgtcgggaagctgatccaccagatcttcggcaccgcgtacggggtgctgttctccggcgtgagctggacgatgaagatcgggatcggcatcctcctgacctggctgggcctcaactcccgcagcacctccctgagcatgacctgcatcgccgtcgggatggtgacgctgtacctcggcgtgatggtccaggccgactccgggtgcgtgatcaactggaagggccgggagctgaagtgcgggagcggcatcttcgtgaccaacgaggtccacacctggaccgagcagtacaagttccaggccgacagcccgaagcgcctgtccgccgcgatcggcaaggcctgggaggagggggtgtgcggcatccggagcgccacccgcctcgagaacatcatgtggaagcagatctccaacgagctgaaccacatcctgctcgagaacgacatgaagttcacggtggtcgtgggggaggtgaacggcatcctggcccaggggaagaagatgatccggccccagcccatggagcacaagtacagctggaagtcctggggcaaggccaaggtcatcggcgcggacgtgcagaacaccaccttcatcatcgacgggcccaacaccccggagtgccccgacaaccagcgcgcctggaacatctgggaggtggaggactacggcttcgggatcttcacgaccaacatctggctgaagctccgggacagctacacccaggtctgcgaccaccgcctgatgtccgccgccatcaaggacagcaaggcggtgcacgccgacatgggctactggatcgagtccgagaagaacgagacctggaagctggcccgggccagcttcatcgaggtgaagacgtgcatctggcccaagtcccacaccctctggagcaacggcgtcctggagtccgagatgatcatccccaagatctacgggggcccgatcagccagcacaactaccgccccgggtacttcacccagaccgccggcccctggcacctggggaagctcgagctggacttcgagctgtgcgagggcacgaccgtggtggtcgacgagcactgcggcaaccgggggccgtccctccgcaccaccacggtgaccggcaagatcatccacgagtggtgctgccggagctgcaccctgccgcccctgcgcttcaagggggaggacggctgctggtacgggatggagatccggcccgtgaaggagaaggaggagaacctcgtcaagtccatggtgagcgcgggcagcggcgaggtggactccttcagcctggggctgctctgcatctccatcatgatcgaggaggtcatgcgcagccggtggtcccgcaagatgctgatgaccggcacgctggccgtgttcctcctgctgaccatggggcagctcacctggaacgacctgatccggctgtgcatcatggtgggcgccaacgccagcgacaagatggggatgggcaccacgtacctcgccctgatggccaccttccgcatgcgcccgatgttcgccgtcgggctcctgttccggcgcctgacctcccgggaggtgctgctcctgaccgtcgggctgagcctcgtggcctccgtggagctgcccaacagcctggaggagctcggcgacgggctggccatgggcatcatgatgctgaagctcctgacggacttccagtcccaccagctgtgggccgcgctcctgagcctgaccttcgtcaagaccaccctctccctgcactacgcctggaagacgatggccatgatcctgagcatcgtgtccctcttccccctgtgcctgagcaccacctcccagaagaccacgtggctccccgtgctgctgggcagcctcgggtgcaagccgctgaccatgttcctgatcaccgagaacaagatctggggccgcaagtcctggcccctcaacgaggggatcatggccgtcggcatcgtgagcatcctgctgagctccctcctgaagaacgacgtgcccctggcggggcccctcatcgccggcggcatgctgatcgcctgctacgtcatcagcgggtccagcgccgacctgtccctcgagaaggccgcggaggtgagctgggaggaggaggccgagcactccggcgccagccacaacatcctggtggaggtccaggacgacgggaccatgaagatcaaggacgaggagcgggacgacaccctgacgatcctcctgaaggccaccctgctcgccatctccggcgtgtacccgatgagcatccccgcgaccctgttcgtgtggtacttctggcagaagaagaagcagcgctccggggtcctgtgggacacccccagcccgcccgaggtggagaaggccgtgctggacgacggcatctaccggatcctccagcgcggcctgctggggaagtcccaggtcggcgtgggggtgttccaggagggcgtcttccacacgatgtggcacgtgacccgcggggccgtgctcatgtaccagggcaagcgcctggagcccagctgggcctccgtcaagaaggacctgatcagctacggcgggggctggcggttccaggggtcctggaacaccggcgaggaggtccaggtgatcgccgtcgagcccgggaagaaccccaagaacgtgcagaccgcgcccggcacgttcaagacccccgagggcgaggtgggggccatcgccctcgacttcaagcccggcaccagcgggtcccccatcgtcaaccgcgagggcaagatcgtgggcctgtacgggaacggcgtggtcaccacgagcgggacctacgtgagcgccatcgcccaggcgaaggcctcccaggagggcccgctgcccgagatcgaggacgaggtgttccggaagcgcaacctcaccatcatggacctgcaccccgggagcggcaagacccggcgctacctgccggccatcgtccgggaggccatcaagcgcaagctccggacgctggtgctggcgcccacccgcgtggtcgcctccgagatggccgaggccctcaagggcatgcccatccggtaccagaccaccgccgtcaagagcgagcacacggggaaggagatcgtggacctgatgtgccacgcgaccttcaccatgcgcctgctctcccccgtccgcgtgccgaactacaacatgatcatcatggacgaggcccacttcaccgaccccgccagcatcgccgcccggggctacatctccacgcgcgtggggatgggcgaggcggccgccatcttcatgaccgccacgccgcccgggagcatggaggccttcccgcagtccaacgcggccatccaggacgaggagcgggacatccccgagcgcagctggaactccggctacgactggatcaccgacttccccggcaagacggtctggttcgtgcccagcatcaagtccgggaacgacatcgccaactgcctgcggaagaacggcaagcgcgtgatccagctgagccggaagaccttcgacaccgagtaccagaagaccaagaacaacgactgggactacgtcgtgacgaccgacatctccgagatgggggccaacttccgcgcggaccgggtgatcgacccgcgccggtgcctcaagcccgtcatcctgaaggacggccccgagcgcgtgatcctggccgggcccatgccggtcaccgtggccagcgccgcccagcggcgcggccggatcggccgcaaccagaacaaggagggggaccagtacatctacatgggccagcccctcaacaacgacgaggaccacgcgcactggaccgaggccaagatgctgctggacaacatcaacacgcccgaggggatcatccccgccctcttcgagccggagcgggagaagtccgccgccatcgacggcgagtaccgcctgcgcggggaggcgcgcaagaccttcgtggagctgatgcgccggggcgacctccccgtctggctgagctacaaggtggcctccgagggcttccagtacagcgaccgccggtggtgcttcgacggggagcgcaacaaccaggtgctggaggagaacatggacgtcgagatctggaccaaggagggcgagcggaagaagctccgcccccggtggctggacgcccgcacctacagcgaccccctggccctccgggagttcaaggagttcgccgcggggcgccggtccgtgagcggcgacctgatcctggagatcggcaagctcccgcagcacctgacgcagcgcgcccagaacgccctggacaacctcgtgatgctgcacaactccgagcagggcgggaaggcctaccggcacgcgatggaggagctgcccgacaccatcgagaccctcatgctgctggccctcatcgccgtcctgaccgggggcgtgaccctgttcttcctcagcgggcgcggcctgggcaagacgtccatcgggctgctctgcgtgatggccagctccgccctgctgtggatggcgagcgtcgagccccactggatcgccgcctccatcatcctcgagttcttcctgatggtgctgctcatccccgagccggaccggcagcgcacgccccaggacaaccagctggcctacgtggtcatcggcctcctcttcatgatcctgaccgtggccgcgaacgagatggggctgctcgagaccacgaagaaggacctgggcatcgggcacgccgccgccgagaaccaccaccacgccgcgatgctggacgtggacctccaccccgccagcgcctggaccctgtacgccgtcgccaccaccatcatcacgccgatgatgcggcacaccatcgagaacaccaccgcgaacatctccctgacggccatcgccaaccaggccgcgatcctcatgggcctggacaagggctggcccatcagcaagatggacatcggggtgcccctgctcgccctgggctgctactcccaggtgaaccccctgaccctcaccgccgccgtcctgatgctggtggcccactacgcgatcatcgggccgggcctccaggccaaggccacccgcgaggcccagaagcggacggccgcggggatcatgaagaaccccaccgtggacggcatcgtcgccatcgacctggaccccgtggtgtacgacgccaagttcgagaagcagctgggccagatcatgctcctgatcctgtgcaccagccagatcctcctgatgcgcaccacgtgggccctgtgcgagtccatcaccctcgccaccgggcccctgaccacgctgtgggagggcagcccggggaagttctggaacaccaccatcgcggtctccatggccaacatcttccggggcagctacctcgccggcgccgggctggcgttctccctgatgaagtccctcggcgggggccgccgcgggaccggcgcccagggcgagacgctgggggagaagtggaagcggcagctgaaccagctcagcaagtccgagttcaacacctacaagcgcagcggcatcatggaggtggaccggtccgaggccaaggaggggctgaagcgcggcgagaccaccaagcacgccgtgagccgggggacggccaagctgcgctggttcgtcgagcggaacctggtgaagcccgagggcaaggtgatcgacctcggctgcgggcgcggcgggtggtcctactactgcgcgggcctgaagaaggtcaccgaggtgaaggggtacaccaagggcggccccgggcacgaggagcccatcccgatggccacctacggctggaacctggtgaagctctacagcgggaaggacgtcttcttcacgccgcccgagaagtgcgacaccctgctgtgcgacatcggcgagtccagccccaacccgaccatcgaggaggggcggaccctccgcgtgctgcggatggtggagccctggctgcgcggcaaccagttctgcatcaaggtcctcaacccctacatgccctccgtgatcgagaccctggagcagatgcagcggaagcacggcgggatgctggtgcgcaacccgctcagccggaactccacgcacgagatgtactgggtcagctgcggcaccgggaacatcgtgtccgccgtgaacatgaccagccgcatgctgctgaaccggttcaccatggcccaccgcaagcccacgtacgagcgggacgtcgacctcggcgccggcacccgccacgtggcggtggagcccgaggtcgccaacctggagatcatcgggcagcgcatcgagaacatcaagaacgagcacaagtccacctggcactacgacgaggacaacccctacaagacctgggcctaccacggcagctacgaggtgaagccgtccgggagcgcctccagcatggtgaacggcgtcgtgcggctgctcacgaagccctgggacgtcatccccatggtgacccagatcgccatgaccgacaccacgcccttcgggcagcagcgcgtgttcaaggagaaggtcgacacccggaccccgaaggcgaagcgcggcaccgcccagatcatggaggtgacggcccggtggctgtggggcttcctgagccgcaacaagaagccccggatctgcacccgcgaggagttcacccggaaggtgcgctccaacgccgcgatcggggccgtcttcgtggacgagaaccagtggaacagcgccaaggaggccgtggaggacgagcggttctgggacctcgtccaccgcgagcgggagctgcacaagcagggcaagtgcgcgacctgcgtgtacaacatgatggggaagcgcgagaagaagctgggcgagttcgggaaggcgaagggctcccgggccatctggtacatgtggctcggcgcccgcttcctggagttcgaggccctggggttcatgaacgaggaccactggttcagccgggagaactccctcagcggcgtggagggggagggcctgcacaagctggggtacatcctccgcgacatctccaagatccccggcggcaacatgtacgccgacgacacggcggggtgggacacccggatcaccgaggacgacctgcagaacgaggccaagatcaccgacatcatggagccggagcacgccctgctcgccacgagcatcttcaagctgacctaccagaacaaggtcgtgcgcgtgcagcggcccgccaagaacggcaccgtcatggacgtgatctcccgccgcgaccagcgggggagcggccaggtgggcacctacgggctgaacacgttcaccaacatggaggcgcagctcatccgccagatggagtccgagggcatcttcacccccagcgagctggagacccccaacctggccgagcgggtcctcgactggctggagaagcacgggatcgagcgcctgaagcggatggccatctccggcgacgactgcgtggtgaagccgatcgacgaccgcttcgccacggccctcaccgcgctgaacgacatggggaaggtccggaaggacatcccccagtgggagcccagcaagggctggaacgactggcagcaggtccccttctgctcccaccacttccaccagctgatcatgaaggacggccgcgagatcgtggtcccgtgccggaaccaggacgagctcgtggggcgcgcccgggtgagccagggcgccgggtggtccctgcgcgagaccgcctgcctgggcaagagctacgcgcagatgtggcagctcatgtacttccaccggcgcgacctgcggctggccgccaacgccatctgcagcgccgtccccgtggactgggtgcccacctcccgcacgacctggagcatccacgcgcaccaccagtggatgaccaccgaggacatgctctccgtctggaaccgggtgtggatcgaggagaacccctggatggaggacaagacccacgtgagctcctgggaggacgtcccgtacctggggaagcgcgaggaccagtggtgcggcagcctgatcggcctcacggcccgggccacctgggccaccaacatccaggtggccatcaaccaggtgcgccgcctgatcgggaacgagaactacctggactacatgacctccatgaagcggttcaagaacgagagcgaccccgagggcgcgctctggtga

SEQ ID NO: 8892 - RNA, 9879 nt, synthetic construct
  misc_feature 1..9879: note = derived and/or modified CDS sequence (opt1) from DENV-1__KC762645__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgctcacctacaagtgcccccggatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctggggctcgagacgcgcaccgagacctggatgagctccgagggcgcctggcggcagatccagcgggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcagccgggacttcgtggaggggctgtccggcgccacgtgggtggacgtcgtgctggagcacgggagctgcgtgaccaccatggccaaggacaagcccaccctcgacatcgagctgctgaagacggaggtcaccaaccccgcggtgctccgcaagctgtgcatcgaggccaagatctccaacaccaccacggacagccggtgcccgacccagggcgaggccaccctggtggaggagcaggacgccaacttcgtctgccgccggaccttcgtggaccgcggctgggggaacggctgcgggctgttcggcaaggggtccctgatcacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccggacgggcctggacttcaacgagatggtcctgctcaccatgaaggagaagtcctggctggtgcacaagcagtggttcctggacctccccctgccctggaccagcggggccagcacctcccaggagacgtggaaccgccaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccggctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccgcctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccgccgcatggcgatcctgggcgacacggcctgggacttcgggtccatcggcggcgtgttcaccagcgtcgggaagctcgtgcaccagatcttcggcaccgcctacggggtgctgttctccggcgtcagctggaccatgaagatcgggatcggcgtgctgctcacgtggctgggcctgaactcccggagcacctccctcagcatgacctgcatcgccgtggggctggtcaccctgtacctcggcgtgatggtgcaggccgactccgggtgcgtcatcaactggaagggccgcgagctgaagtgcgggagcggcatcttcgtgacgaacgaggtgcacacctggaccgagcagtacaagttccaggcggacagcccgaagcggctgtccgccgccatcggcaaggcctgggaggagggggtctgcggcatccgcagcgccacccggctcgagaacatcatgtggaagcagatctccaacgagctgaaccacatcctgctcgagaacgacatgaagttcaccgtggtggtcggggacgtggcgggcatcctggcccaggggaagaagatgatccgcccccagcccatggagcacaagtacagctggaagtcctggggcaaggccaagatcatcggcgccgacgtgcagaacacgaccttcatcatcgacgggcccaacaccccggagtgccccgacgaccagcgggcgtggaacatctgggaggtcgaggactacggcttcgggatcttcaccacgaacatctggctgaagctccgcgacagctacacccaggtgtgcgaccaccggctgatgtccgccgccatcaaggacagcaaggccgtgcacgccgacatgggctactggatcgagtccgagaagaacgagacctggaagctggcgcgcgccagcttcatcgaggtcaagacctgcatctggcccaagtcccacacgctctggagcaacggcgtgctggagtccgagatgatcatccccaagatctacgggggcccgatcagccagcacaactaccggcccgggtacttcacccagaccgccggcccctggcacctggggaagctcgagctggacttcaacctgtgcgagggcaccacggtggtcgtggacgagcactgcggcaaccgcgggccgtccctccggaccaccaccgtgacgggcaagatcatccacgagtggtgctgccgcagctgcaccctgccgcccctgcggttccgcggggaggacggctgctggtacgggatggagatccggcccgtcaaggagaaggaggagaacctcgtgaagtccatggtgagcgccggcagcggcgaggtcgactccttcagcctggggctgctctgcatctccatcatgatcgaggaggtgatgcgcagccggtggtcccgcaagatgctgatgaccggcaccctggccgtgttcttcctcctgatcatggggcagctgacgtggaacgacctcatccgcctgtgcatcatggtcggcgcgaacgccagcgaccggatggggatgggcaccacctacctggccctcatggccaccttcaagatgcgcccgatgttcgccgtgggcctgctgttccggcgcctcacgtcccgggaggtgctgctgctcaccatcgggctgagcctggtcgcgtccgtggagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcctggaagaccatggcgatggtcctcagcatcgtgtccctgttccccctgtgcctcagcacgacctcccagaagaccacctggctgcccgtgctgctcggcagcctggggtgcaagccgctgacgatgttcctcatcgccgagaacaagatctggggccgcaagtcctggcccctgaacgaggggatcatggccgtcggcatcgtgagcatcctgctcagctccctgctgaagaacgacgtgcccctcgccgggcccctgatcgccggcggcatgctgatcgcgtgctacgtcatcagcgggtccagcgccgacctctccctggagaaggccgccgaggtgagctgggaggaggaggccgagcactccggcgcgagccacaacatcctggtggaggtccaggacgacgggaccatgaagatcaaggacgaggagcgggacgacaccctcaccatcctgctgaaggccaccctcctggccgtgtccggcgtgtacccgctgagcatccccgccaccctcttcgtctggtacttctggcagaagaagaagcagcgctccggggtgctgtgggacacccccagcccgcccgaggtggagcgggccgtcctggacgacggcatctaccgcatcatgcagcggggcctgctcgggcgctcccaggtgggcgtgggggtcttccaggagaacgtgttccacaccatgtggcacgtgacccggggcgcggtcctgatgtaccaggggaagcgcctggagcccagctgggcctccgtgaagaaggacctcatcagctacggcggcgggtggcggctgcagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgcgaggggaagatcgtgggcctctacggcaacggggtcgtgaccaccagcggcacctacgtgagcgccatcgcccaggccaaggcgtcccaggaggggccgctgcccgagatcgaggacgaggtcttccggaagcgcaacctgacgatcatggacctccaccccggcagcgggaagacccggcgctacctgccggccatcgtgcgggaggccatcaagcgcaagctgcgcaccctcatcctggcccccacccgggtggtcgcctccgagatggcggaggccctgaagggcatgcccatccgctaccagacgaccgccgtcaagagcgagcacaccggcaaggagatcgtggacctcatgtgccacgccaccttcacgatgcggctgctgtcccccgtccgcgtgccgaactacaacatgatcatcatggacgaggcccacttcaccgaccccagctccatcgcggcccgggggtacatcagcacccgcgtgggcatgggggaggccgccgccatcttcatgaccgcgacgccgcccggctccgtcgaggccttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctccggaagaacgggaagcgcgtgatccagctgtcccggaagaccttcgacacggagtaccagaagaccaagaacaacgactgggactacgtggtcaccaccgacatcagcgagatgggcgcgaacttccgcgccgaccgggtgatcgacccgcgccggtgcctgaagcccgtgatcctcaaggacgggcccgagcgcgtcatcctggccggccccatgccggtgacggtcgcctccgccgcgcagcggcgcgggcgggtgggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccggctccgcggcgaggcccggaagaccttcgtggagctgatgcgccgcggggacctgcccgtctggctctcctacaaggtggccagcgagggcttccagtacagcgaccgccggtggtgcttcgacggcgagcgcaacaaccaggtgctggaggagaacatggacgtcgagatctggacgaaggagggggagcggaagaagctgcgcccccggtggctcgacgcccgcacctactccgaccccctggccctgcgggagttcaaggagttcgcggccggccgccggagcgtgtccggggacctcatcctggagatcggcaagctgccgcagcacctcacccagcgcgcccagaacgccctggacaacctggtgatgctccacaacagcgagcagggcgggcgggcgtaccgccacgccatggaggagctgcccgacaccatcgagacgctgatgctcctggccctgatcgccgtcctcaccggcggggtgaccctgttcttcctgtccggccgggggctcggcaagaccagcatcggcctgctgtgcgtgatggcctccagcgtcctcctgtggatggcgtccgtgcagccccactggatcgccgccagcatcatcctggagttcttcctcatggtgctgctgatccccgagccggaccgccagcggacgccccaggacaaccagctcgcctacgtcgtgatcgggctgctgttcatgatcctcacggtggccgcgaacgagatgggcctgctggagaccaccaagaaggacctcgggatcggccacgtcgccgtggagaaccaccaccacgccgccatgctggacgtggacctgcaccccgcctccgcgtggaccctctacgccgtcgccacgaccatcatcaccccgatgatgcgccacaccatcgagaacacgaccgccaacatcagcctgaccgccatcgcgaaccaggccgccatcctgatggggctcgacaagggctggcccatctccaagatggacatcggcgtgcccctgctggccctcgggtgctacagccaggtgaaccccctgaccctgacggcggccgtcctcatgctggtggcccactacgccatcatcggcccggggctgcaggccaaggcgacccgcgaggcccagaagcggaccgccgccggcatcatgaagaaccccaccgtggacgggatcgtcgccatcgacctcgaccccgtggtgtacgacgcgaagttcgagaagcagctgggccagatcatgctgctcatcctgtgcacgtcccagatcctgctcatgcgcaccacctgggccctgtgcgagagcatcaccctggccacgggccccctcaccaccctgtgggaggggtccccgggcaagttctggaacaccacgatcgccgtcagcatggccaacatcttccgggggtcctacctggcgggcgccggcctcgccttcagcctgatgaagtccctcgggggcgggcgccgggggaccggggcccagggcgagaccctcggcgagaagtggaagcgccagctgaaccagctgtccaagagcgagttcaacacctacaagcggtccgggatcatggaggtggaccgcagcgaggcgaaggagggcctcaagcgcggggagacgaccaagcacgccgtgtcccgcggcaccgccaagctgcggtggttcgtcgagcgcaacctggtgaagcccgaggggaaggtgatcgacctgggctgcggccgcggcgggtggagctactactgcgccgggctcaagaaggtcaccgaggtgaaggggtacacgaagggcgggcccggccacgaggagcccatcccgatggccacctacgggtggaacctggtgaagctgcactccggcaaggacgtcttcttcatcccgcccgagaagtgcgacaccctcctgtgcgacatcggggagagctcccccaacccgaccatcgaggagggccgcacgctgcgggtgctcaagatggtggagccctggctgcgcgggaaccagttctgcatcaagatcctgaacccctacatgcccagcgtcgtggagaccctcgagcagatgcagcggaagcacggcggcatgctggtgcgcaacccgctgtcccggaacagcacccacgagatgtactgggtctcctgcgggaccggcaacatcgtgagcgcggtgaacatgacctcccgcatgctcctgaaccgcttcacgatggcccaccggaagcccacctacgagcgcgacgtcgacctgggggccggcacccggcacgtggccgtggagcccgaggtcgccaacctcgacatcatcggccagcgcatcgagaacatcaagcacgagcacaagagcacctggcactacgacgaggacaacccctacaagacgtgggcgtaccacgggtcctacgaggtgaagccgagcggctccgccagcagcatggtcaacggggtggtgaagctgctgaccaagccctgggacgtcatccccatggtgacccagatcgccatgaccgacacgacccccttcggccagcagcgggtgttcaaggagaaggtcgacacccgcaccccgaaggccaagcgggggacgacccagatcatggaggtgaccgcccgctggctctggggcttcctgtcccggaacaagaagccccgcatctgcacccgggaggagttcacgcgcaaggtgcggagcaacgcggccatcggcgccgtcttcgtggacgagaaccagtggaactccgccaaggaggcggtggaggacgagcgcttctgggacctggtccaccgggagcgcgagctccacaagcaggggaagtgcgcgacctgcgtgtacaacatgatgggcaagcgggagaagaagctgggggagttcggcaaggccaaggggagccgcgccatctggtacatgtggctgggcgcccggttcctcgagttcgaggcgctgggcttcatgaacgaggaccactggttctcccgcgagaacagcctgtccggggtggagggcgaggggctccacaagctgggctacatcctgcgggacatcagcaagatccccgggggcaacatgtacgccgacgacaccgccggctgggacacccgcatcacggaggacgacctccagaacgaggccaagatcaccgacatcatggagccggagcacgccctgctggcgaaggccatcttcaagctcacctaccagaacaaggtcgtgcgcgtgcagcggcccgccaagaacgggaccgtcatggacgtgatctcccgccgggaccagcgcggcagcggccaggtgggcacgtacggcctgaacaccttcaccaacatggaggcccagctgatccggcagatggagtccgaggggatcttcagcccctccgagctcgagacccccaacctggccgagcgcgtcctggactggctcgagaagtacggcgtggagcggctgaagcgcatggcgatcagcggggacgactgcgtggtcaagccgatcgacgaccggttcgccacggccctgaccgccctcaacgacatgggcaaggtgcgcaaggacatcccccagtgggagccctccaaggggtggaacgactggcagcaggtccccttctgcagccaccacttccaccagctgatcatgaaggacggccgggagatcgtcgtgccgtgccgcaaccaggacgagctggtgggccgggcccgcgtctcccagggggcgggctggagcctccgggagaccgcctgcctgggcaagagctacgcccagatgtggcagctgatgtacttccaccgccgggacctccgcctggccgcgaacgccatctgctccgccgtgcccgtggactgggtccccaccagccggacgacctggtccatccacgcccaccaccagtggatgaccaccgaggacatgctgagcgtgtggaaccgcgtgtggatcgaggagaacccctggatggaggacaagacgcacatctccagctgggaggacgtcccgtacctcggcaagcgcgaggaccagtggtgcgggtccctgatcggcctgaccgcccgggcgacctgggccaccaacatccaggtggccatcaaccaggtgcgccggctcatcggcaacgagaactacctggactacatgaccagcatgaagcgcttcaagaacgagtccgaccccgagggggccctgtggtga

SEQ ID NO: 8893 - RNA, 9879 nt, synthetic construct
  misc_feature 1..9879: note = derived and/or modified CDS sequence (opt1) from DENV-1__KC762628__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccgcatcaccgagaccgagcccgacgacgtggactgctggtgcaacgccaccgagacctgggtgacctacgggacctgcagccagaccggcgagcaccggcgcgacaagcggtccgtggccctggcgccccacgtgggcctggggctcgagacccgcaccgagacctggatgagctccgagggcgcgtggcggcagatccagaaggtggagacgtgggccctgcgccaccccgggttcaccgtgatcgccctgttcctcgcccacgcgatcggcaccagcatcacccagaaggggatcatcttcatcctgctgatgctcgtgacgccctccatggccatgcggtgcgtcggcatcggcaaccgcgacttcgtggaggggctgagcggcgccacctgggtggacgtcgtgctggagcacgggtcctgcgtgaccaccatggccaaggacaagcccacgctcgacatcgagctgctgaagaccgaggtcaccaaccccgccgtgctccggaagctgtgcatcgaggcgaagatcagcaacaccacgaccgactcccgctgccccacccagggcgaggccaccctggtggaggagcaggacacgaacttcgtctgccggcgcaccttcgtggaccggggctgggggaacggctgcggcctgttcggcaaggggagcctgatcacgtgcgccaagttcaagtgcgtgaccaagctggagggcaagatcgtccagtacgagaacctcaagtactccgtgatcgtgacggtccacaccggcgaccagcaccaggtggggaacgagaccaccgagcacggcaccacggccaccatcacgccccaggcccccaccagcgagatccagctgacggactacggggcgctgaccctcgactgcagcccccgcaccggcctggacttcaacgagatggtcctgctcaccatgaaggagaagtcctggctggtgcacaagcagtggttcctggacctcccgctgccctggacgtccggggccagcaccagccaggagacctggaaccggcaggacctgctcgtgaccttcaagacggcccacgccaagaagcaggaggtcgtggtgctgggctcccaggagggcgccatgcacaccgcgctgaccggggccaccgagatccagacgagcggcaccaccaccatcttcgccgggcacctcaagtgccgcctgaagatggacaagctgacgctcaagggcgtctcctacgtgatgtgcaccgggagcttcaagctggagaaggaggtggccgagacccagcacggcaccgtcctggtccaggtgaagtacgagggcacggacgccccctgcaagatccccttctccagccaggacgagaagggggtcacccagaacggccggctgatcaccgcgaacccgatcgtgaccgacaaggagaagcccgtgaacatcgaggccgagccgcccttcggggagtcctacctcgtcgtgggcgccggcgagaaggccctgaagctgagctggttcaagaaggggtccagcatcggcaagatgttcgaggcgacggcccgcggggcccggcgcatggccatcctcggcgacaccgcctgggacttcgggtccatcggcggcgtgttcaccagcgtcgggaagctgatccaccagatcttcggcaccgcgtacggggtgctgttctccggcgtgagctggacgatgaagatcgggatcggcatcctcctgacctggctgggcctcaactcccgcagcacctccctgagcatgacctgcatcgccgtcgggatggtgacgctgtacctcggcgtgatggtccaggccgactccgggtgcgtgatcaactggaagggccgggagctgaagtgcgggagcggcatcttcgtgaccaacgaggtccacacctggaccgagcagtacaagttccaggccgacagcccgaagcgcctgtccgccgcgatcggcaaggcctgggaggagggggtgtgcggcatccggagcgccacccgcctcgagaacatcatgtggaagcagatctccaacgagctgaaccacatcctgctcgagaacgacatgaagttcacggtggtcgtgggggaggtgaacggcatcctggcccaggggaagaagatgatccggccccagcccatggagcacaagtacagctggaagtcctggggcaaggccaaggtcatcggcgcggacgtgcagaacaccaccttcatcatcgacgggcccaacaccccggagtgccccgacaaccagcgcgcctggaacatctgggaggtggaggactacggcttcgggatcttcacgaccaacatctggctgaagctccgggacagctacacccaggtctgcgaccaccgcctgatgtccgccgccatcaaggacagcaaggcggtgcacgccgacatgggctactggatcgagtccgagaagaacgagacctggaagctggcccgggccagcttcatcgaggtgaagacgtgcatctggcccaagtcccacaccctctggagcaacggcgtcctggagtccgagatgatcatccccaagatctacgggggcccgatcagccagcacaactaccgccccgggtacttcacccagaccgccggcccctggcacctggggaagctcgagctggacttcgagctgtgcgagggcacgaccgtggtggtcgacgagcactgcggctcccgggggccgagcctccgcaccaccacggtgaccggcaagatcatccacgagtggtgctgccggtcctgcaccctgccgcccctgcgcttcaagggggaggacggctgctggtacgggatggagatccggcccgtgaaggagaaggaggagaacctcgtcaagagcatggtgagcgcgggctccggcgaggtggacagcttctccctggggctgctctgcatgagcatcatgatcgaggaggtcatgcgctcccggtggagccgcaagatgctgatgaccggcacgctggccgtgttcctcctgctgaccatggggcagctcacctggaacgacctgatccggctgtgcatcatggtgggcgccaacgcctccgacaagatggggatgggcaccacgcacctcgccctgatggccaccttccgcatgcgcccgatgttcgccgtcgggctcctgttccggcgcctgaccagccgggaggtgctgctcctgaccgtcgggctgtccctcgtggccagcgtggagctgcccaactccctggaggagctcggcgacgggctggccatgggcatcatgatgctgaagctcctgacggacttccagagccaccagctgtgggccgcgctcctgtccctgaccttcgtcaagaccaccctcagcctgcactacgcctggaagacgatggccatgatcctgtccatcgtgagcctcttccccctgtgcctgtccaccaccagccagaagaccacgtggctccccgtgctgctgggctccctcgggtgcaagccgctgaccatgttcctgatcaccgagaacaagatctggggccgcaagagctggcccctcaacgaggggatcatggccgtcggcatcgtgagcatcctgctgtccagcctcctgaagaacgacgtgcccctggcggggcccctcatcgccggcggcatgctgatcgcctgctacgtcatctccgggagctccgccgacctgagcctcgagaaggccgcggaggtgtcctgggaggaggaggccgagcacagcggcgcctcccacaacatcctggtggaggtccaggacgacgggaccatgaagatcaaggacgaggagcgggacgacaccctgacgatcctcctgaaggccaccctgctcgccatcagcggcgtgtacccgatgtccatccccgcgaccctgttcgtgtggtacttctggcagaagaagaagcagcgcagcggggtcctgtgggacacccccagcccgcccgaggtggagcgggccgtgctggacgacggcatctaccgcatcctccagcggggcctgctggggaagtcccaggtcggcgtgggggtgttccaggagggcgtcttccacacgatgtggcacgtgacccgcggggccgtgctcatgtaccagggcaagcggctggagccctcctgggccagcgtcaagaaggacctgatctcctacggcgggggctggcgcttccaggggagctggaacaccggcgaggaggtccaggtgatcgccgtcgagcccgggaagaaccccaagaacgtgcagaccgcgcccggcacgttcaagacccccgagggcgaggtgggggccatcgccctcgacttcaagcccggcacctccgggagccccatcgtcaaccgggagggcaagatcgtgggcctgtacgggaacggcgtggtcaccacgagcgggacctacgtgtccgccatcgcccaggcgaaggccagccaggagggcccgctgcccgagatcgaggacgaggtgttccgcaagcggaacctcaccatcatggacctgcaccccgggtccggcaagacccgccggtacctgccggccatcgtccgcgaggccatcaagcggaagctccgcacgctggtgctggcgcccacccgggtggtcgccagcgagatggccgaggccctcaagggcatgcccatccgctaccagaccaccgccgtgaagtccgagcacacggggaaggagatcgtggacctgatgtgccacgcgaccttcaccatgcgcctgctcagccccgtccgggtgccgaactacaacatgatcatcatggacgaggcccacttcaccgaccccgcctccatcgccgcccgcggctacatcagcacgcgggtggggatgggcgaggcggccgccatcttcatgaccgccacgccgcccgggtccatcgaggccttcccgcagagcaacgcggccatccaggacgaggagcgcgacatccccgagcggtcctggaacagcggctacgactggatcaccgacttccccggcaagacggtctggttcgtgccctccatcaagagcgggaacgacatcgccaactgcctgcgcaagaacggcaagcgggtgatccagctgtcccgcaagaccttcgacaccgagtaccagaagaccaagaacaacgactgggactacgtcgtgacgaccgacatcagcgagatgggggccaacttccgggcggaccgcgtgatcgacccgcggcgctgcctcaagcccgtcatcctgaaggacggccccgagcgggtgatcctggccgggcccatgccggtcaccgtggcctccgccgcccagcgccggggccgcatcggccggaaccagaacaaggagggggaccagtacatctacatgggccagcccctcaacaacgacgaggaccacgcgcactggaccgaggccaagatgctgctggacaacatcaacacgcccgaggggatcatccccgccctcttcgagccggagcgcgagaagtccgccgccatcgacggcgagtaccggctgcgcggggaggcgcgcaagaccttcgtggagctgatgcggcgcggcgacctccccgtctggctgtcctacaaggtggccagcgagggcttccagtacagcgaccggcgctggtgcttcgacggggagcggaacaaccaggtgctggaggagaacatggacgtcgagatctggaccaaggagggcgagcgcaagaagctccggccccgctggctggacgcccggacctactccgaccccctggccctccgcgagttcaaggagttcgccgcggggcggcgcagcgtgtccggcgacctgatcctggagatcggcaagctcccgcagcacctgacgcagcgggcccagaacgccctggacaacctcgtgatgctgcacaacagcgagcagggcgggaaggcctaccgccacgcgatggaggagctgcccgacaccatcgagaccctcatgctgctggccctcatcgccgtcctgaccgggggcgtgaccctgttcttcctctccgggcggggcctgggcaagacgagcatcgggctgctctgcgtgatggcctccagcgccctgctgtggatggcgtccgtcgagccccactggatcgccgccagcatcatcctcgagttcttcctgatggtgctgctcatccccgagccggaccgccagcggacgccccaggacaaccagctggcctacgtggtcatcggcctcctcttcatgatcctgaccgtggccgcgaacgagatggggctgctcgagaccacgaagaaggacctgggcatcgggcacgccgccgccgagaaccaccaccacgccgcgatgctggacgtggacctccaccccgcctccgcctggaccctgtacgccgtcgccaccaccatcatcacgccgatgatgcgccacaccatcgagaacaccaccgcgaacatcagcctgacggccatcgccaaccaggccgcgatcctcatgggcctggacaagggctggcccatctccaagatggacatcggggtgcccctgctcgccctgggctgctacagccaggtgaaccccctgaccctcaccgccgccgtcctgatgctggtggcccactacgcgatcatcgggccgggcctccaggccaaggccacccgggaggcccagaagcgcacggccgcggggatcatgaagaaccccaccgtggacggcatcgtcgccatcgacctggaccccgtggtgtacgacgccaagttcgagaagcagctgggccagatcatgctcctgatcctgtgcacctcccagatcctcctgatgcggaccacgtgggccctgtgcgagagcatcaccctcgccaccgggcccctgaccacgctgtgggagggctccccggggaagttctggaacaccaccatcgcggtcagcatggccaacatcttccgcggctcctacctcgccggcgccgggctggcgttcagcctgatgaagtccctcggcgggggccgccgggggaccggcgcccagggcgagacgctgggggagaagtggaagcgccagctgaaccagctctccaagagcgagttcaacacctacaagcggtccggcatcatggaggtggaccgcagcgaggccaaggaggggctgaagcggggcgagaccaccaagcacgccgtgtcccgcgggacggccaagctgcggtggttcgtcgagcgcaacctggtgaagcccgagggcaaggtgatcgacctcggctgcgggcggggcgggtggagctactactgcgcgggcctgaagaaggtcaccgaggtgaaggggtacaccaagggcggccccgggcacgaggagcccatcccgatggccacctacggctggaacctggtgaagctccactccgggaaggacgtcttcttcacgccgcccgagaagtgcgacaccctgctgtgcgacatcggcgagagctcccccaacccgaccatcgaggaggggcgcaccctccgggtgctgcgcatggtggagccctggctgcggggcaaccagttctgcatcaaggtcctcaacccctacatgcccagcgtgatcgagaccctggagcagatgcagcgcaagcacggcgggatgctggtgcggaacccgctctcccgcaacagcacgcacgagatgtactgggtctcctgcggcaccgggaacatcgtgagcgccgtgaacatgacctcccggatgctgctgaaccgcttcaccatggcccaccggaagcccacgtacgagcgcgacgtcgacctcggcgccggcacccgccacgtggcggtggagcccgaggtcgccaacctggacatcatcgggcagcggatcgagaacatcaagaacgagcacaagagcacctggcactacgacgaggacaacccctacaagacctgggcctaccacggctcctacgaggtgaagccgagcgggtccgccagcagcatggtgaacggcgtcgtgcgcctgctcacgaagccctgggacgtcatccccatggtgacccagatcgccatgaccgacaccacgcccttcgggcagcagcgggtgttcaaggagaaggtcgacacccgcaccccgaaggcgaagcggggcaccgcccagatcatggaggtgacggcccgctggctgtggggcttcctgtcccggaacaagaagccccgcatctgcacccgggaggagttcacccgcaaggtgcggagcaacgccgcgatcggggccgtcttcgtggacgagaaccagtggaactccgccaaggaggccgtggaggacgagcgcttctgggacctcgtccaccgggagcgcgagctgcacaagcagggcaagtgcgcgacctgcgtgtacaacatgatggggaagcgggagaagaagctgggcgagttcgggaaggcgaagggcagccgcgccatctggtacatgtggctcggcgcccggttcctggagttcgaggccctggggttcatgaacgaggaccactggttctcccgcgagaacagcctctccggcgtggagggggagggcctgcacaagctggggtacatcctccgggacatcagcaagatccccggcggcaacatgtacgccgacgacacggcggggtgggacacccgcatcaccgaggacgacctgcagaacgaggccaagatcaccgacatcatggagccggagcacgccctgctcgccacgtccatcttcaagctgacctaccagaacaaggtcgtgcgggtgcagcgccccgccaagaacggcaccgtcatggacgtgatcagccgccgggaccagcgcgggtccggccaggtgggcacctacgggctgaacacgttcaccaacatggaggcgcagctcatccggcagatggagagcgagggcatcttcaccccctccgagctggagacccccaacctggccgagcgcgtcctcgactggctggagaagcacgggatcgagcggctgaagcgcatggccatcagcggcgacgactgcgtggtgaagccgatcgacgaccggttcgccacggccctcaccgcgctgaacgacatggggaaggtccgcaaggacatcccccagtgggagccctccaagggctggaacgactggcagcaggtccccttctgcagccaccacttccaccagctgatcatgaaggacggccgggagatcgtggtcccgtgccgcaaccaggacgagctcgtggggcgggcccgcgtgtcccagggcgccgggtggagcctgcgggagaccgcctgcctgggcaagagctacgcgcagatgtggcagctcatgtacttccaccgccgggacctgcgcctggccgccaacgccatctgctccgccgtccccgtggactgggtgcccaccagccggacgacctggtccatccacgcgcaccaccagtggatgaccaccgaggacatgctcagcgtctggaaccgcgtgtggatcgaggagaacccctggatggaggacaagacccacgtgtccagctgggaggacgtcccgtacctggggaagcgggaggaccagtggtgcggctccctgatcggcctcacggcccgcgccacctgggccaccaacatccaggtggccatcaaccaggtgcgccggctgatcgggaacgagaactacctggactacatgaccagcatgaagcgcttcaagaacgagtccgaccccgagggcgcgctctggtga

SEQ ID NO: 8894 - RNA, 9879 nt, synthetic construct
  misc_feature 1..9879: note = derived and/or modified CDS sequence (opt1) from DENV-1__KC762624__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgctcacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcagccgcgacttcgtggaggggctgtccggcgccacgtgggtggacgtcgtgctggagcacgggagctgcgtgaccaccatggccaaggacaagcccaccctcgacatcgagctgctgaagacggaggtcaccaaccccgcggtgctccggaagctgtgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctgatcacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctcgtgcaccagatcttcggcaccgcctacggggtgctgttctccggcgtcagctggaccatgaagatcgggatcggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcaccgtggtggtcggggacgtggcgggcatcctggcccaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctccgggacagctacacccaggtgtgcgaccaccgcctgatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacacgctctggagcaacggcgtgctggagtccgagatgatcatccccaagatctacgggggcccgaccagccagcacaactaccgccccgggtacttcacccagaccgccggcccctggcacctggggaagctcgagctggacttcgacctgtgcgagggcacgaccgtggtcgtggacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtcaaggagaaggaggagaacctcgtgaagtccatggtgagcgccggcagcggcgaggtcgactccttcagcctggggctgctctgcatctccatcatgatcgaggaggtgatgcggagccgctggtcccggaagatgctgatgaccggcacgctggccgtgttcttcctcctgatcatggggcagctgacctggaacgacctcatccgcctgtgcatcatggtcggcgcgaacgccagcgaccgcatggggatgggcaccacctacctggccctcatggccacgttcaagatgcggccgatgttcgccgtgggcctgctgttccgccggctcacctcccgcgaggtgctgctgctcaccatcgggctgagcctggtcgcgtccgtggagctccccaacagcctggaggagctgggcgacgggctcgccatgggcatcatgatcctgaagctgctcaccgacttccagtcccaccagctgtgggccacgctgctcagcctgaccttcatcaagaccaccttctccctgcactacgcctggaagacgatggcgatggtcctcagcatcgtgtccctgttccccctgtgcctcagcaccacctcccagaagaccacgtggctgcccgtgctgctcggcagcctggggtgcaagccgctgaccatgttcctcatcgccgagaacaagatctggggccggaagtcctggcccctgaacgaggggatcatggccgtcggcatcgtgagcatcctgctcagctccctgctgaagaacgacgtgcccctcgccgggcccctgatcgccggcggcatgctgatcgcgtgctacgtcatcagcgggtccagcgccgacctctccctggagaaggccgccgaggtgagctgggaggaggaggccgagcactccggcgcgagccacaacatcctggtggaggtccaggacgacgggaccatgaagatcaaggacgaggagcgcgacgacaccctcaccatcctgctgaaggccacgctcctggccgtgtccggcgtgtacccgctgagcatccccgccaccctcttcgtctggtacttctggcagaagaagaagcagcggtccggggtgctgtgggacacccccagcccgcccgaggtggagcgcgccgtcctggacgacggcatctaccggatcatgcagcgcggcctgctcgggcggtcccaggtgggcgtgggggtcttccaggagaacgtgttccacaccatgtggcacgtgacgcgcggcgcggtcctgatgtaccaggggaagcggctggagcccagctgggcctccgtgaagaaggacctcatcagctacggcggcgggtggcgcctgcagggctcctggaacaccggggaggaggtgcaggtcatcgccgtggagcccggcaagaaccccaagaacgtgcagaccgcccccgggaccttcaagacgcccgagggcgaggtcggcgccatcgcgctggacttcaagcccgggaccagcggctcccccatcgtgaaccgggaggggaagatcgtgggcctctacggcaacggggtcgtgaccaccagcggcacgtacgtgagcgccatcgcccaggccaaggcgtcccaggaggggccgctgcccgagatcgaggacgaggtcttccgcaagcggaacctgaccatcatggacctccaccccggcagcgggaagacccgccggtacctgccggccatcgtgcgcgaggccatcaagcggaagctgcgcaccctcatcctggcccccacgcgcgtggtcgcctccgagatggcggaggccctgaagggcatgcccatccggtaccagaccaccgccgtcaagagcgagcacaccggcaaggagatcgtggacctcatgtgccacgccacgttcaccatgcgcctgctgtcccccgtccgggtgccgaactacaacatgatcatcatggacgaggcccacttcaccgaccccagctccatcgcggcccgcgggtacatcagcacccgggtgggcatgggggaggccgccgccatcttcatgacggcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctccgcaagaacgggaagcgggtgatccagctgtcccgcaagacgttcgacaccgagtaccagaagaccaagaacaacgactgggactacgtggtcaccacggacatcagcgagatgggcgcgaacttccgggccgaccgcgtgatcgacccgcggcgctgcctgaagcccgtgatcctcaaggacgggcccgagcgggtcatcctggccggccccatgccggtgaccgtcgcctccgccgcgcagcgccgggggcgcgtgggccggaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccgcctccggggcgaggcccgcaagacgttcgtggagctgatgcggcgcggggacctgcccgtctggctctcctacaaggtggccagcgagggcttccagtacagcgaccggcgctggtgcttcgacggcgagcggaacaaccaggtgctggaggagaacatggacgtcgagatctggaccaaggagggggagcgcaagaagctgcggccccgctggctcgacgcccggacctactccgaccccctggccctgcgcgagttcaaggagttcgcggccggccggcgcagcgtgtccggggacctcatcctggagatcggcaagctgccgcagcacctcacccagcgggcccagaacgccctggacaacctggtgatgctccacaacagcgagcagggcgggcgcgcgtaccggcacgccatggaggagctgcccgacacgatcgagaccctgatgctcctggccctgatcgccgtcctcaccggcggggtgaccctgttcttcctgtccggccgcgggctcggcaagaccagcatcggcctgctgtgcgtgatggcctccagcgtcctcctgtggatggcgtccgtggagccccactggatcgccgccagcatcatcctggagttcttcctcatggtgctgctgatccccgagccggaccggcagcgcacgccccaggacaaccagctcgcctacgtcgtgatcgggctgctgttcatgatcctcaccgtggccgcgaacgagatgggcctgctggagaccaccaagaaggacctcgggatcggccacgtcgccgtggagaaccaccaccacgccgccatgctggacgtggacctgcaccccgcctccgcgtggacgctctacgccgtcgccaccaccatcatcaccccgatgatgcggcacacgatcgagaacaccaccgccaacatcagcctgaccgccatcgcgaaccaggccgccatcctgatggggctcgacaagggctggcccatctccaagatggacatcggcgtgcccctgctggccctcgggtgctacagccaggtgaaccccctgacgctgaccgcggccgtcctcatgctggtggcccactacgccatcatcggcccggggctgcaggccaaggcgacccgcgaggcccagaagcgcaccgccgccggcatcatgaagaaccccacggtggacgggatcgtcgccatcgacctcgaccccgtggtgtacgacgcgaagttcgagaagcagctgggccagatcatgctgctcatcctgtgcacctcccagatcctgctcatgcggaccacctgggccctgtgcgagagcatcacgctggccaccggccccctcaccaccctgtgggaggggtccccgggcaagttctggaacacgaccatcgccgtcagcatggccaacatcttccgcgggtcctacctggcgggcgccggcctcgccttcagcctgatgaagtccctcgggggcgggcggcgcgggaccggggcccagggcgagaccctcggcgagaagtggaagcggcagctgaaccagctgtccaagagcgagttcaacacgtacaagcgctccgggatcatggaggtggaccggagcgaggcgaaggagggcctcaagcgcggggagaccaccaagcacgccgtgtcccggggcaccgccaagctgcgctggttcgtcgagcggaacctggtgaagcccgaggggaaggtgatcgacctgggctgcggccgcgggggctggagctactactgcgccgggctcaagaaggtcacggaggtgaagggctacaccaagggcgggcccggccacgaggagcccatcccgatggccacctacgggtggaacctggtgaagctgcactccggcaaggacgtcttcttcatcccgcccgagaagtgcgacaccctcctgtgcgacatcggggagagctcccccaacccgacgatcgaggagggccggaccctgcgcgtgctcaagatggtggagccctggctgcgggggaaccagttctgcatcaagatcctgaacccctacatgcccagcgtcgtggagaccctcgagcagatgcagcgcaagcacggcggcatgctggtgcggaacccgctgtcccgcaacagcacccacgagatgtactgggtctcctgcgggaccggcaacatcgtgagcgcggtgaacatgacgtcccggatgctcctgaaccgcttcaccatggcccaccgcaagcccacctacgagcgggacgtcgacctgggggccggcacccgccacgtggccgtggagcccgaggtcgccaacctcgacatcatcggccagcggatcgagaacatcaagcacgagcacaagagcacgtggcactacgacgaggacaacccctacaagacctgggcgtaccacgggtcctacgaggtgaagccgagcggctccgccagcagcatggtcaacggggtggtgaagctgctgaccaagccctgggacgtcatccccatggtgacccagatcgccatgacggacaccacccccttcggccagcagcgcgtgttcaaggagaaggtcgacacccggacgccgaaggccaagcgcgggaccacccagatcatggaggtgaccgcccggtggctctggggcttcctgtcccgcaacaagaagccccggatctgcacgcgcgaggagttcacccggaaggtgcgcagcaacgcggccatcggcgccgtcttcgtggacgagaaccagtggaactccgccaaggaggcggtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacgcggatcaccgaggacgacctccagaacgaggccaagatcaccgacatcatggagccggagcacgccctgctggcgaaggccatcttcaagctcacctaccagaacaaggtcgtgcgcgtgcagcgccccgccaagaacgggacggtcatggacgtgatctcccggcgcgaccagcggggcagcggccaggtggggacctacggcctgaacaccttcaccaacatggaggcccagctgatccgccagatggagtccgaggggatcttcagcccctccgagctcgagacgcccaacctggccgagcgggtcctggactggctcgagaagtacggcgtggagcgcctgaagcggatggcgatcagcggggacgactgcgtggtcaagccgatcgacgaccgcttcgccaccgccctgaccgccctcaacgacatgggcaaggtgcggaaggacatcccccagtgggagccctccaaggggtggaacgactggcagcaggtccccttctgcagccaccacttccaccagctgatcatgaaggacggccgcgagatcgtcgtgccgtgccggaaccaggacgagctggtgggccgcgcccgggtctcccagggggcgggctggagcctccgcgagaccgcctgcctgggcaagagctacgcccagatgtggcagctgatgtacttccaccggcgcgacctccggctggccgcgaacgccatctgctccgccgtgcccgtggactgggtccccacgagccgcaccacctggtccatccacgcccaccaccagtggatgaccacggaggacatgctgagcgtgtggaaccgggtgtggatcgaggagaacccctggatggaggacaagacccacgtctccagctgggaggacgtgccgtacctcggcaagcgcgaggaccagtggtgcgggtccctgatcggcctgaccgcccgcgcgacctgggccaccaacatccaggtggccatcaaccaggtccggcgcctcatcggcaacgagaactacctggactacatgacgagcatgaagcggttcaagaacgagtccgaccccgagggggccctgtggtga

SEQ ID NO: 8895 - RNA, 9879 nt, synthetic construct
  misc_feature 1..9879: note = derived and/or modified CDS sequence (opt1) from DENV-1__KC762644__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgctcacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcagccgcgacttcgtggaggggctgtccggcgccacgtgggtggacgtcgtgctggagcacgggagctgcgtgaccaccatggccaaggacaagcccaccctcgacatcgagctgctgaagacggaggtcaccaaccccgcggtgctccggaagctgtgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctgatcacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctcgtgcaccagatcttcggcaccgcctacggggtgctgttctccggcgtcagctggaccatgaagatcgggatcggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcaccgtggtggtcggggacgtggcgggcatcctggcccaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctccgggacagctacacccaggtgtgcgaccaccgcctgatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacacgctctggagcaacggcgtgctggagtccgagatgatcatccccaagatctacgggggcccgatcagccagcacaactaccgccccgggtacttcacccagaccgccggcccctggcacctggggaagctcgagctggacttcgacctgtgcgagggcaccacggtggtcgtggacgagcactgcggcaaccgggggccgtccctccgcaccaccaccgtgacgggcaagatcatccacgagtggtgctgccggagctgcaccctgccgcccctgcgcttccgcggggaggacggctgctggtacgggatggagatccgccccgtcaaggagaaggaggagaacctcgtgaagtccatggtgagcgccggcagcggcgaggtcgactccttcagcctggggctgctctgcatctccatcatgatcgaggaggtgatgcggagccgctggtcccggaagatgctgatgaccggcaccctggccgtgttcttcctcctgatcatggggcagctgacgtggaacgacctcatccgcctgtgcatcatggtcggcgcgaacgccagcgaccgcatggggatgggcaccacctacctggccctcatggccaccttcaagatgcggccgatgttcgccgtgggcctgctgttccgccggctcacgtcccgcgaggtgctgctgctcaccatcgggctgagcctggtcgcgtccgtggagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcctggaagaccatggcgatggtcctcagcatcgtgtccctgttccccctgtgcctcagcacgacctcccagaagaccacctggctgcccgtgctgctcggcagcctggggtgcaagccgctgacgatgttcctcatcgccgagaacaagatctggggccggaagtcctggcccctgaacgaggggatcatggccgtcggcatcgtgagcatcctgctcagctccctgctgaagaacgacgtgcccctcgccgggcccctgatcgccggcggcatgctgatcgcgtgctacgtcatcagcgggtccagcgccgacctctccctggagaaggccgccgaggtgagctgggaggaggaggccgagcactccggcgcgagccacaacatcctggtggaggtccaggacgacgggaccatgaagatcaaggacgaggagcgcgacgacaccctcaccatcctgctgaaggccaccctcctggccgtgtccggcgtgtacccgctgagcatccccgccaccctcttcgtctggtacttctggcagaagaagaagcagcggtccggggtgctgtgggacacccccagcccgcccgaggtggagcgcgccgtcctggacgacggcatctaccggatcatgcagcgcggcctgctcgggcggtcccaggtgggcgtgggggtcttccaggagaacgtgttccacaccatgtggcacgtgacccgcggcgcggtcctgatgtaccaggggaagcggctggagcccagctgggcctccgtgaagaaggacctcatcagctacggcggcgggtggcgcctgcagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgggaggggaagatcgtgggcctctacggcaacggggtcgtgaccaccagcggcacctacgtgagcgccatcgcccaggccaaggcgtcccaggaggggccgctgcccgagatcgaggacgaggtcttccgcaagcggaacctgacgatcatggacctccaccccggcagcgggaagacccgccggtacctgccggccatcgtgcgcgaggccatcaagcggaagctgcgcaccctcatcctggcccccacccgcgtggtcgcctccgagatggcggaggccctgaagggcatgcccatccggtaccagacgaccgccgtcaagagcgagcacaccggcaaggagatcgtggacctcatgtgccacgccaccttcacgatgcgcctgctgtcccccgtccgggtgccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctccgcaagaacgggaagcgggtgatccagctgtcccgcaagaccttcgacacggagtaccagaagaccaagaacaacgactgggactacgtggtcaccaccgacatcagcgagatgggcgcgaacttccgggccgaccgcgtgatcgacccgcggcgctgcctgaagcccgtgatcctcaaggacgggcccgagcgggtcatcctggccggccccatgccggtgacggtcgcctccgccgcgcagcgccgggggcgcgtgggccggaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccgcctccggggcgaggcccgcaagaccttcgtggagctgatgcggcgcggggacctgcccgtctggctctcctacaaggtggccagcgagggcttccagtacagcgaccggcgctggtgcttcgacggcgagcggaacaaccaggtgctggaggagaacatggacgtcgagatctggacgaaggagggggagcgcaagaagctgcggccccgctggctcgacgcccggacctactccgaccccctggccctgcgcgagttcaaggagttcgcggccggccggcgcagcgtgtccggggacctcatcctggagatcggcaagctgccgcagcacctcacccagcgggcccagaacgccctggacaacctggtgatgctccacaacagcgagcagggcgggcgcgcgtaccggcacgccatggaggagctgcccgacaccatcgagacgctgatgctcctggccctgatcgccgtcctcaccggcggggtgaccctgttcttcctgtccggccgcgggctcggcaagaccagcatcggcctgctgtgcgtgatggcctccagcgtcctcctgtggatggcgtccgtggagccccactggatcgccgccagcatcatcctggagttcttcctcatggtgctgctgatccccgagccggaccggcagcgcacgccccaggacaaccagctcgcctacgtcgtgatcgggctgctgttcatgatcctcacggtggccgcgaacgagatgggcctgctggagaccaccaagaaggacctcgggatcggccacgtcgccgtggagaaccaccaccacgccgccatgctggacgtggacctgcaccccgcctccgcgtggaccctctacgccgtcgccacgaccatcatcaccccgatgatgcggcacaccatcgagaacacgaccgccaacatcagcctgaccgccatcgcgaaccaggccgccatcctgatggggctcgacaagggctggcccatctccaagatggacatcggcgtgcccctgctggccctcgggtgctacagccaggtgaaccccctgaccctgacggcggccgtcctcatgctggtggcccactacgccatcatcggcccggggctgcaggccaaggcgacccgcgaggcccagaagcgcaccgccgccggcatcatgaagaaccccaccgtggacgggatcgtcgccatcgacctcgaccccgtggtgtacgacgcgaagttcgagaagcagctgggccagatcatgctgctcatcctgtgcacgtcccagatcctgctcatgcggaccacctgggccctgtgcgagagcatcaccctggccacgggccccctcaccaccctgtgggaggggtccccgggcaagttctggaacaccacgatcgccgtcagcatggccaacatcttccgcgggtcctacctggcgggcgccggcctcgccttcagcctgatgaagtccctcgggggcgggcggcgcgggaccggggcccagggcgagaccctcggcgagaagtggaagcggcagctgaaccagctgtccaagagcgagttcaacacctacaagcgctccgggatcatggaggtggaccggagcgaggcgaaggagggcctcaagcgcggggagacgaccaagcacgccgtgtcccggggcaccgccaagctgcgctggttcgtcgagcggaacctggtgaagcccgaggggaaggtgatcgacctgggctgcggccgcgggggctggagctactactgcgccgggctcaagaaggtcaccgaggtgaagggctacacgaagggcgggcccggccacgaggagcccatcccgatggccacctacgggtggaacctggtgaagctgcactccggcaaggacgtcttcttcatcccgcccgagaagtgcgacaccctcctgtgcgacatcggggagagctcccccaacccgaccatcgaggagggccggacgctgcgcgtgctcaagatggtggagccctggctgcgggggaaccagttctgcatcaagatcctgaacccctacatgcccagcgtcgtggagaccctcgagcagatgcagcgcaagcacggcggcatgctggtgcggaacccgctgtcccgcaacagcacccacgagatgtactgggtctcctgcgggaccggcaacatcgtgagcgcggtgaacatgacctcccggatgctcctgaaccgcttcacgatggcccaccgcaagcccacctacgagcgggacgtcgacctgggggccggcacccgccacgtggccgtggagcccgaggtcgccaacctcgacatcatcggccagcggatcgagaacatcaagcacgagcacaagagcacctggcactacgacgaggacaacccctacaagacgtgggcgtaccacgggtcctacgaggtgaagccgagcggctccgccagcagcatggtcaacggggtggtgaagctgctgaccaagccctgggacgtcatccccatggtgacccagatcgccatgaccgacacgacccccttcggccagcagcgcgtgttcaaggagaaggtcgacacccggaccccgaaggccaagcgcgggacgacccagatcatggaggtgaccgcccggtggctctggggcttcctgtcccgcaacaagaagccccggatctgcacccgcgaggagttcacgcggaaggtgcgcagcaacgcggccatcggcgccgtcttcgtggacgagaaccagtggaactccgccaaggaggcggtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggccaagatcaccgacatcatggagccggagcacgccctgctggcgaaggccatcttcgagctcacctaccagaacaaggtcgtgcgcgtgcagcgccccgccaagaacgggaccgtcatggacgtgatctcccggcgcgaccagcggggcagcggccaggtggggacgtacggcctgaacaccttcaccaacatggaggcccagctgatccgccagatggagtccgaggggatcttcagcccctccgagctcgagacccccaacctggccgagcgggtcctggactggctcgagaagtacggcgtggagcgcctgaagcggatggcgatcagcggggacgactgcgtggtcaagccgatcgacgaccgcttcgccacggccctgaccgccctcaacgacatgggcaaggtgcggaaggacatcccccagtgggagccctccaaggggtggaacgactggcagcaggtccccttctgcagccaccacttccaccagctgatcatgaaggacggccgcgagatcgtcgtgccgtgccggaaccaggacgagctggtgggccgcgcccgggtctcccagggggcgggctggagcctccgcgagaccgcctgcctgggcaagagctacgcccagatgtggcagctgatgtacttccaccggcgcgacctccggctggccgcgaacgccatctgctccgccgtgcccgtggactgggtccccaccagccgcacgacctggtccatccacgcccaccaccagtggatgaccaccgaggacatgctgagcgtgtggaaccgggtgtggatcgaggagaacccctggatggaggacaagacgcacatctccagctgggaggacgtcccgtacctcggcaagcgcgaggaccagtggtgcgggtccctgatcggcctgaccgcccgcgcgacctgggccaccaacatccaggtggccatcaaccaggtgcggcgcctcatcggcaacgagaactacctggactacatgaccagcatgaagcggttcaagaacgagtccgaccccgagggggccctgtggtga

SEQ ID NO: 8896 - RNA, 9879 nt, synthetic construct
  misc_feature 1..9879: note = derived and/or modified CDS sequence (opt1) from DENV-1__KC762630__SS-prME
  source 1..9879: mol_type = other RNA
agcgtgaccgtgctgttcatgctcctgcccaccgccctggccttccacctcaccacccggggcggggagccgcacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccaccgagacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagaaggtggagacgtgggccctccggcaccccgggttcaccgtgatcgccctgttcctggcccacgcgatcggcaccagcatcacccagaaggggatcatcttcatcctcctgatgctggtgacgccctccatggccatgcgctgcgtgggcatcggcaaccgggacttcgtggaggggctcagcggcgccacctgggtggacgtggtgctggagcacgggtcctgcgtcaccaccatggccaagaacaagcccacgctggacatcgagctcctgaagaccgaggtgaccaaccccgccatcctgcgcaagctctgcatcgaggcgaagatcagcaacaccacgaccgactcccggtgcccgacccagggcgaggccaccctggtggaggagcaggacacgaacttcgtctgccgccggaccttcgtggaccgcggctgggggaacggctgcgggctgttcggcaaggggagcctcatcacgtgcgccaagttcaagtgcgtgaccaagctggagggcaagatcgtccagtacgagaacctgaagtactccgtgatcgtgacggtccacaccggcgaccagcaccaggtggggaacgagaccaccgagcacggcaccacggccatcatcacgccccaggcccccaccagcgagatccagctcaccgactacggggcgctgacgctggactgcagcccccggaccggcctcgacttcaacgagatggtcctgctgaccatgaaggagaagtcctggctcgtgcacaagcagtggttcctggacctgccgctcccctggacctccggggccagcacgagccaggagacctggaaccgccaggacctgctggtgaccttcaagaccgcccacgccaagaagcaggaggtcgtggtgctcggctcccaggagggcgccatgcacacggcgctgaccggggccaccgagatccagaccagcggcacgaccaccatcttcgccgggcacctgaagtgccggctcaagatggacaagctgaccctgaagggcgtctcctacgtgatgtgcacggggagcttcaagctcgagaaggaggtggccgagacccagcacggcaccgtcctggtccaggtgaagtacgagggcaccgacgccccctgcaagatccccttctccagccaggacgagaagggggtcatccagaacggccgcctgatcacggcgaacccgatcgtgaccgacaaggagaagcccgtgaacatcgaggccgagccgcccttcggggagtcctacatcgtcgtgggcgccggcgagaaggccctgaagctcagctggttcaagaaggggtccagcatcggcaagatgttcgaggcgaccgcccgcggggcccgccggatggccatcctgggcgacaccgcctgggacttcgggtccatcggcggcgtgttcacgagcgtcgggaagctggtgcaccagatcttcggcaccgcgtacggggtcctgttctccggcgtcagctggaccatgaagatcgggatcggcatcctgctgacctggctcggcctgaactcccgcagcacgtccctgagcatgacctgcatcgccgtggggatggtgaccctctacctgggcgtcatggtgcaggccgactccgggtgcgtgatcaactggaagggccgcgagctgaagtgcgggagcggcatcttcgtcaccaacgaggtgcacacgtggaccgagcagtacaagttccaggccgacagcccgaagcggctctccgccgcgatcggcaaggcctgggaggagggggtgtgcggcatccgcagcgccacccggctggagaacatcatgtggaagcagatctccaacgagctgaaccacatcctcctggagaacgacatgaagttcaccgtcgtggtgggggacgtcagcggcatcctggcccaggggaagaagatgatccgcccccagcccatggagcacaagtactcctggaagtcctggggcaaggccaagatcatcggcgcggacgtgcagaacaccacgttcatcatcgacgggcccaacaccccggagtgccccgacaaccagcgggcctggaacatctgggaggtggaggactacggcttcgggatcttcaccaccaacatctggctcaagctgcgcgactcctacacgcaggtctgcgaccaccggctgatgagcgccgccatcaaggactccaaggcggtgcacgccgacatgggctactggatcgagagcgagaagaacgagacctggaagctcgcccgcgcctccttcatcgaggtgaagacctgcatctggcccaagagccacaccctgtggtccaacggcgtcctggagagcgagatgatcatccccaagatctacgggggcccggtgtcccagcacaactaccggcccgggtacttcacgcagaccgccggcccctggcacctcgggaagctggagctggacttcgacctctgcgagggcaccaccgtggtcgtggacgagaactgcggcaaccgcgggccgagcctgcggacgaccaccgtgaccggcaagacgatccacgagtggtgctgccgctcctgcaccctgccgcccctccggttcaagggggaggacggctgctggtacgggatggagatccgccccgtcaaggagaaggaggagaacctggtcaagagcatggtgagcgcgggctccggcgaggtcgacagcttctccctggggctcctgtgcatcagcatcatgatcgaggaggtgatgcggtcccgctggagccggaagatgctgatgaccggcaccctcgccgtgttcctgctgctcacgatggggcagctgacctggaacgacctgatccgcctctgcatcatggtcggcgccaacgcctccgacatgatggggatgggcaccacctacctggccctgatggcgacgttccggatgcgcccgatgttcgccgtggggctcctgttccgccggctgaccagccgcgagatcctcctgctgaccgtcgggctctccctggtggccagcgtggagctgcccaactccctcgaggagctgggcgacgggctggccatgggcatcatgatgctcaagctgctgaccgacttccagccccaccagctctgggccacgctgctgagcctcaccttcgtcaagaccaccctgtccctgcactacgcgtggaagacgatggccatgatcctcagcatcgtgtccctgctgcccctctgcctgagcaccacctcccagaagaccacgtggctgccggtgctcctgggcagcctggggtgcaagcccctcaccatgttcctgatcaccgagaacaagatctggggccggcgctcctggcccctgaacgaggggatcatggccatcggcatcgtcagcatcctcctgagctccctgctcaagaacgacgtgcccctggccgggccgctgatcgcgggcggcatgctcatcgcctgctacgtgatcagcgggtccagcgccgacctgtccctggagaaggccgccgaggtcagctgggaggacgaggcggagcactccggcgccagccacaacatcctcgtggaggtgcaggacgacgggaccatgaagatcaaggacgaggagcgggacgacaccctgacgatcctgctcaaggccaccctgctggtcatctccggcgtgtaccccatgagcgtgcccgccaccctcttcgtctggtacttctggcagaagaagaagcagcgctccggggtgctgtgggacacccccagcccgcccgaggtggagcgggccgtcctggacaacggcatctaccgcatcctgcagcggggcctcctggggcgctcccaggtgggcgtgggggtcttccaggagggcgtgttccacacgatgtggcacgtgacccgcggggccgtcctgatgtaccagggcaagcggctcgagcccagctgggcctccgtgaagaaggacctgatcagctacggcgggggctggcggttccaggggtcctggaacaccggcgaggaggtgcaggtcatcgccgtggagcccgggaagaacccgaagaacgtgcagaccacgcccggcaccttcaagacccccgagggcgagatcggggccatcgccctggacttcaagcccggcaccagcgggtccccgatcgtcaaccgcgagggcaagatcgtgggcctctacgggaacggcgtggtcacgaccagcgggacctacgtgagcgcgatcgcccaggccaaggtgtcccaggagggccccctgcccgagatcgaggacgaggtcttccggaagcgcaacctgaccatcatggacctccacccggggagcggcaagacgcggcgctacctgcccgccatcgtgcgggaggccatcaagcgcaagctgcggaccctcgtgctggcgcccacccgcgtcgtggcctccgagatggccgaggccctgaagggcatgcccatccgctaccagaccacggcggtcaagagcgagcacaccgggaaggagatcgtcgacctcatgtgccacgccaccttcaccatgcggctgctgtccccggtgcgcgtgcccaactacaacatgatcatcatggacgaggcccacttcacggaccccgccagcatcgccgcgcggggctacatctccacccgcgtcgggatgggcgaggccgccgccatcttcatgaccgccacgccgcccgggagcgtggaggcgttcccccagtccaacgccgtgatccaggacgaggagcgggacatccccgagcgcagctggaactccggctacgagtggatcacggacttccccggcaagaccgtctggttcgtgcccagcatcaagtccgggaacgacatcgccaactgcctccggaagaacggcaagcgcgtggtccagctgagccggaagaccttcgacaccgagtaccagaagacgaagaacaacgactgggactacgtggtcaccaccgacatctccgagatgggggccaacttccgcgccgaccgggtgatcgacccccgccggtgcctgaagcccgtgatcctcaaggacggccccgagcgcgtcatcctggcggggccgatgcccgtgaccgtggccagcgccgcccagcggcgcggccggatcggccgcaaccccaacaaggagggggaccagtacgtctacatgggccagcccctgaacaacgacgaggaccacgcgcactggacggaggccaagatgctcctggacaacatcaacaccccggaggggatcatccccgccctgttcgagcccgagcgggagaagtccgccgccatcgacggcgagtaccgcctccgcggggaggcgcggaagaccttcgtggagctgatgcgccggggcgacctgcccgtgtggctcagctacaaggtcgcctccgagggcttccagtacagcgaccgccggtggtgcttcgacggggagcgcaacaaccaggtgctggaggagaacatggacgtggagatctggaccaaggagggcgagcggaagaagctgcgcccgcggtggctcgacgcccgcacgtacagcgaccccctggccctgcgggagttcaaggagttcgccgcggggcgccggtccgtcagcggcgacctcatcctggagatcggcaagctgccccagcacctcaccctgaaggcccagaacgccctggacaacctcgtgatgctgcacaactccgagcagggcgggaaggcctaccgccacgccatggaggagctgcccgacaccatcgagaccctcatgctgctggcgctcatcgccgtgctgaccgggggcgtcacgctgttcttcctcagcgggcggggcctgggcaagacctccatcgggctgctctgcgtgatggccagctccgccctgctgtggatggcgagcgtggagccgcactggatcgccgcctccatcatcctcgagttcttcctgatggtcctgctcatccccgagcccgaccgccagcggaccccgcaggacaaccagctggcctacgtggtgatcggcctcctcttcatgatcctgaccgtcgccgcgaacgagatggggctgctcgagacgaccaagaaggacctgggcatcgggcacgccgccgccgagaaccaccaccacgccgcgatgctggacgtggacctccaccccgccagcgcctggaccctgtacgccgtggccaccacgatcatcacccccatgatgcgccacaccatcgagaacaccacggcgaacatctccctgaccgccatcgccaaccaggccgccatcctcatgggcctggacaagggctggcccatcagcaagatggacatcggggtcccgctgctcgcgctgggctgctactcccaggtgaaccccctgaccctcaccgccgccgtgctgatgctggtcgcccactacgcgatcatcgggcccggcctccaggccaaggccacgcgggaggcccagaagcgcaccgccgcggggatcatgaagaaccccaccgtggacggcatcgtggccatcgacctggacccggtcatctacgacgccaagttcgagaagcagctgggccagatcatgctcctgatcctgtgcaccagccagatcctcctgatgcggacgacctgggccctgtgcgagtccatcaccctcgccaccgggcccctgacgaccctgtgggagggcagccccgggaagttctggaacaccaccatcgcggtgtccatggccaacatcttccgcggcagctacctcgccggcgccgggctggccttctccctgatgaagtccctcggcgggggccgccgggggacgggcgcgcagggcgagaccctgggggagaagtggaagcgccagctgaaccagctcagcaagtccgagttcaacatctacaagcggagcggcatcatcgaggtggaccgctccgaggccaaggaggggctgaagcggggcgagaccaccaagcacgccgtcagccgcgggacggccaagctgcggtggttcgtggagcgcaacctggtgaagcccgagggcaaggtcatcgacctcggctgcgggcggggcgggtggtcctactactgcgcgggcctgaagaaggtgaccgaggtgaaggggtacaccaagggcggcccggggcacgaggagcccatccccatggccacctacggctggaacctggtcaagctccacagcgggaaggacgtgttcttcacgcccccggagaagtgcgacaccctgctgtgcgacatcggcgagtccagccccaaccccaccatcgaggaggggcgcaccctccgggtgctgaagatggtcgagccctggctgcgcggcaaccagttctgcatcaagatcctcaacccgtacatgccctccgtggtggagaccctggagcagatgcagcggaagcacggcgggatgctggtccgcaaccccctcagccggaactccacgcacgagatgtactgggtgagctgcggcaccgggaacatcgtgtccgccgtcaacatgaccagccgcatgctgctgaaccggttcaccatggcccaccgcaagcccacgtacgagcgggacgtggacctcggcgccggcacccgccacgtggcggtcgagccggaggtggccaacctggacatcatcgggcagcgcatcgagaacatcaagaacgagcacaagtccacctggcactacgacgaggacaacccctacaagacctgggcctaccacggcagctacgaggtcaagccctccgggagcgcctccagcatggtgaacggcgtggtccggctgctcacgaagccctgggacgtgatcccgatggtgacccagatcgccatgaccgacaccacgcccttcgggcagcagcgcgtcttcaaggagaaggtggacacccggacccccaaggcgaagcgcggcaccgcccagatcatggaggtgacggcccggtggctgtggggcttcctgagccgcaacaagaagccgcggatctgcacccgcgaggagttcacccggaaggtccgctccaacgccgccatcggggcggtgttcgtggacgagaaccagtggaacagcgccaaggaggccgtcgaggacgagcggttctgggacctcgtgcaccgcgagcgggagctgcacaagcagggcaagtgcgcgacctgcgtgtacaacatgatggggaagcgcgagaagaagctgggcgagttcgggaaggcgaagggctcccgggccatctggtacatgtggctcggcgcccgcttcctggagttcgaggccctggggttcatgaacgaggaccactggttcagccgggagaactccctcagcggcgtcgagggggagggcctgcacaagctggggtacatcctccgcgacatctccaagatccccggcggcaacatgtacgccgacgacacggcggggtgggacacccggatcaccgaggacgacctgcagaacgaggccaagatcaccgacatcatggagcccgagcacgccctgctcgccacgagcatcttcaagctgacctaccagaacaaggtggtgcgcgtccagcggcccggcaagaacgggaccgtgatggacgtgatctcccgccgcgaccagcggggcagcggccaggtcgggacctacggcctgaacacgttcaccaacatggaggcccagctcatccgccagatggagtccgaggggatcttcagcccgtccgagctggagacccccaacctggcggagcgggtgttcgactggctcgagaagcacggcatcgagcgcctgaagcggatggccatcagcggggacgactgcgtggtcaagcccatcgacgaccgcttcgccaccgccctgacggccctcaacgacatgggcaaggtgcggaaggacatcccccagtgggagccgtccaagggctggaacgactggcagcaggtccccttctgcagccaccacttccaccagctgatcatgaaggacgggcgcgagatcgtcgtgccctgccggaaccaggacgagctggtgggccgcgcgcgggtctcccagggggccggctggagcctccgcgagaccgcctgcctgggcaagagctacgcccagatgtggcagctgatgtacttccaccggcgcgacctccggctggccgcgaacgccatctgctccgccgtgcccgtggactgggtcccgaccagccgcaccacgtggtccatccacgcccaccaccagtggatgaccaccgaggacatgctgagcgtgtggaaccgggtgtggatcgaggagaacccctggatggaggacaagacccacgtctccagctgggaggacgtgccctacctcggcaagcgcgaggaccagtggtgcggctccctgatcgggctgaccgcgcgggccacgtgggccaccaacatccaggtggccatcaaccaggtccgccgcctcatcggcaacgagaactacctggactacatgaccagcatgaagcggttcaagaacgagtccgaccccgagggggccctgtggtga

SEQ ID NO: 8897 - RNA, 9879 nt, synthetic construct
  misc_feature 1..9879: note = derived and/or modified CDS sequence (opt1) from DENV-1__KC762641__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacacgctcacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcagccgcgacttcgtggaggggctgtccggcgccacgtgggtggacgtcgtgctggagcacgggagctgcgtgaccaccatggccaaggacaagcccaccctcgacatcgagctgctgaagacggaggtcaccaaccccgcggtgctccggaagctgtgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctgatcacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctcgtgcaccagatcttcggcaccgcctacggggtgctgttctccggcgtcagctggaccatgaagatcgggatcggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcaccgtggtggtcggggacgtggcgggcatcctggcccaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctccgggacagctacacccaggtgtgcgaccaccgcctgatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacacgctctggagcaacggcgtgctggagtccgagatgatcatccccaagatctacgggggcccgatcagccagcacaactaccgccccgggtacttcacccagaccgccggcccctggcacctggggaagctcgagctggacttcgacctgtgcgagggcaccacggtggtcgtggacgagcactgcggcaaccgggggccgtccctccgcaccaccaccgtgacgggcaagatcatccacgagtggtgctgccggagctgcaccctgccgcccctgcgcttccgcggggaggacggctgctggtacgggatggagatccgccccgtcaaggagaaggaggagaacctcgtgaagtccatggtgagcgccggcagcggcgaggtcgactccttcagcctggggctgctctgcatctccatcatgatcgaggaggtgatgcggagccgctggtcccggaagatgctgatgaccggcaccctggccgtgttcttcctcctgatcatggggcagctgacgtggaacgacctcatccgcctgtgcatcatggtcggcgcgaacgccagcgaccgcatggggatgggcaccacctacctggccctcatggccaccttcaagatgcggccgatgttcgccgtgggcctgctgttccgccggctcacgtcccgcgaggtgctgctgctcaccatcgggctgagcctggtcgcgtccgtggagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcctggaagaccatggcgatggtcctcagcatcgtgtccctgttccccctgtgcctcagcacgacctcccagaagaccacctggctgcccgtgctgctcggcagcctggggtgcaagccgctgacgatgttcctcatcgccgagaacaagatctggggccggaagtcctggcccctgaacgaggggatcatggccgtcggcatcgtgagcatcctgctcagctccctgctgaagaacgacgtgcccctcgccgggcccctgatcgccggcggcatgctgatcgcgtgctacgtcatcagcgggtccagcgccgacctctccctggagaaggccgccgaggtgagctgggaggaggaggccgagcactccggcgcgagccacaacatcctggtggaggtccaggacgacgggaccatgaagatcaaggacgaggagcgcgacgacaccctcaccatcctgctgaaggccaccctcctggccgtgtccggcgtgtacccgctgagcatccccgccaccctcttcgtctggtacttctggcagaagaagaagcagcggtccggggtgctgtgggacacccccagcccgcccgaggtggagcgcgccgtcctggacgacggcatctaccggatcatgcagcgcggcctgctcgggcggtcccaggtgggcgtgggggtcttccaggagaacgtgttccacaccatgtggcacgtgacccgcggcgcggtcctgatgtaccaggggaagcggctggagcccagctgggcctccgtgaagaaggacctcatcagctacggcggcgggtggcgcctgcagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgggaggggaagatcgtgggcctctacggcaacggggtcgtgaccaccagcggcacctacgtgagcgccatcgcccaggccaaggcgtcccaggaggggccgctgcccgagatcgaggacgaggtcttccgcaagcggaacctgacgatcatggacctccaccccggcagcgggaagacccgccggtacctgccggccatcgtgcgcgaggccatcaagcggaagctgcgcaccctcatcctggcccccacccgcgtggtcgcctccgagatggcggaggccctgaagggcatgcccatccggtaccagacgaccgccgtcaagagcgagcacaccggcaaggagatcgtggacctcatgtgccacgccaccttcacgatgcgcctgctgtcccccgtccgggtgccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctccgcaagaacgggaagcgggtgatccagctgtcccgcaagaccttcgacacggagtaccagaagaccaagaacaacgactgggactacgtggtcaccaccgacatcagcgagatgggcgcgaacttccgggccgaccgcgtgatcgacccgcggcgctgcctgaagcccgtgatcctcaaggacgggcccgagcgggtcatcctggccggccccatgccggtgacggtcgcctccgccgcgcagcgccgggggcgcgtgggccggaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccgcctccggggcgaggcccgcaagaccttcgtggagctgatgcggcgcggggacctgcccgtctggctctcctacaaggtggccagcgagggcttccagtacagcgaccggcgctggtgcttcgacggcgagcggaacaaccaggtgctggaggagaacatggacgtcgagatctggacgaaggagggggagcgcaagaagctgcggccccgctggctcgacgcccggacctactccgaccccctggccctgcgcgagttcaaggagttcgcggccggccggcgcagcgtgtccggggacctcatcctggagatcggcaagctgccgcagcacctcacccagcgggcccagaacgccctggacaacctggtgatgctccacaacagcgagcagggcgggcgcgcgtaccggcacgccatggaggagctgcccgacaccatcgagacgctgatgctcctggccctgatcgccgtcctcaccggcggggtgaccctgttcttcctgtccggccgcgggctcggcaagaccagcatcggcctgctgtgcgtgatggcctccagcgtcctcctgtggatggcgtccgtggagccccactggatcgccgccagcatcatcctggagttcttcctcatggtgctgctgatccccgagccggaccggcagcgcacgccccaggacaaccagctcgcctacgtcgtgatcgggctgctgttcatgatcctcacggtgaccgccaacgagatgggcctgctggagaccaccaagaaggacctcgggatcggccacgtcgcggtggagaaccaccaccacgccgccatgctggacgtggacctgcaccccgcctccgcctggacgctctacgcggtcgccaccaccatcatcaccccgatgatgcggcacacgatcgagaacaccaccgccaacatcagcctgaccgccatcgccaaccaggcggccatcctgatggggctcgacaagggctggcccatctccaagatggacatcggcgtgcccctgctggccctcgggtgctacagccaggtgaaccccctgacgctgaccgccgcggtcctcatgctggtggcccactacgccatcatcggcccggggctgcaggccaaggccacccgcgaggcgcagaagcgcaccgccgccggcatcatgaagaaccccacggtggacgggatcgtcgccatcgacctcgaccccgtggtgtacgacgccaagttcgagaagcagctgggccagatcatgctgctcatcctgtgcacctcccagatcctgctcatgcggaccacctgggcgctgtgcgagagcatcacgctggccaccggccccctcaccaccctgtgggaggggtccccgggcaagttctggaacacgaccatcgccgtcagcatggccaacatcttccgcgggtcctacctggccggcgcgggcctcgccttcagcctgatgaagtccctcgggggcgggcggcgcgggaccggggcccagggcgagaccctcggcgagaagtggaagcggcagctgaaccagctgtccaagagcgagttcaacacgtacaagcgctccgggatcatggaggtggaccggagcgaggccaaggagggcctcaagcgcggggagaccaccaagcacgcggtgtcccggggcaccgccaagctgcgctggttcgtcgagcggaacctggtgaagcccgaggggaaggtgatcgacctgggctgcggccgcgggggctggagctactactgcgccgggctcaagaaggtcacggaggtgaagggctacaccaagggcgggcccggccacgaggagcccatcccgatggccacctacgggtggaacctggtgaagctgcactccggcaaggacgtcttcttcatcccgcccgagaagtgcgacaccctcctgtgcgacatcggggagagctcccccaacccgacgatcgaggagggccggaccctgcgcgtgctcaagatggtggagccctggctgcgggggaaccagttctgcatcaagatcctgaacccctacatgcccagcgtcgtggagaccctcgagcagatgcagcgcaagcacggcggcatgctggtgcggaacccgctgtcccgcaacagcacccacgagatgtactgggtctcctgcgggaccggcaacatcgtgagcgccgtgaacatgacgtcccggatgctcctgaaccgcttcaccatggcgcaccgcaagcccacctacgagcgggacgtcgacctgggggccggcacccgccacgtggccgtggagcccgaggtcgccaacctcgacatcatcggccagcggatcgagaacatcaagcacgagcacaagagcacgtggcactacgacgaggacaacccctacaagacctgggcctaccacgggtcctacgaggtgaagccgagcggctccgcgagcagcatggtcaacggggtggtgaagctgctgaccaagccctgggacgtcatccccatggtgacccagatcgccatgacggacaccacccccttcggccagcagcgcgtgttcaaggagaaggtcgacacccggacgccgaaggccaagcgcgggaccacccagatcatggaggtgaccgcccggtggctctggggcttcctgtcccgcaacaagaagccccggatctgcacgcgcgaggagttcacccggaaggtgcgcagcaacgccgcgatcggcgccgtcttcgtggacgagaaccagtggaactccgccaaggaggccgtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcccgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgcggacgacaccgccggctgggacacgcggatcaccgaggacgacctccagaacgaggccaagatcaccgacatcatggagccggagcacgccctgctggccaaggcgatcttcaagctcacctaccagaacaaggtcgtgcgcgtgcagcgccccgccaagaacgggacggtcatggacgtgatctcccggcgcgaccagcggggcagcggccaggtggggacctacggcctgaacaccttcaccaacatggaggcccagctgatccgccagatggagtccgaggggatcttcagcccctccgagctcgagacgcccaacctggccgagcgggtcctggactggctcgagaagtacggcgtggagcgcctgaagcggatggccatcagcggggacgactgcgtggtcaagccgatcgacgaccgcttcgcgaccgccctgaccgccctcaacgacatgggcaaggtgcggaaggacatcccccagtgggagccctccaaggggtggaacgactggcagcaggtccccttctgcagccaccacttccaccagctgatcatgaaggacggccgcgagatcgtcgtgccgtgccggaaccaggacgagctggtgggccgcgcccgggtctcccagggggccggctggagcctccgcgagaccgcgtgcctgggcaagagctacgcccagatgtggcagctgatgtacttccaccggcgcgacctccggctggccgccaacgcgatctgctccgccgtgcccgtggactgggtccccacgagccgcaccacctggtccatccacgcccaccaccagtggatgaccacggaggacatgctgagcgtgtggaaccgggtgtggatcgaggagaacccctggatggaggacaagacccacatctccagctgggaggacgtcccgtacctcggcaagcgcgaggaccagtggtgcgggtccctgatcggcctgaccgcccgcgccacctgggcgaccaacatccaggtggccatcaaccaggtgcggcgcctcatcggcaacgagaactacctggactacatgacgagcatgaagcggttcaagaacgagtccgaccccgagggggccctgtggtga

SEQ ID NO: 8898 - RNA, 9879 nt, synthetic construct
  misc_feature 1..9879: note = derived and/or modified CDS sequence (opt1) from DENV-1__KC762648__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgctcacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcagccgcgacttcgtggaggggctgtccggcgccacgtgggtggacgtcgtgctggagcacgggagctgcgtgaccaccatggccaaggacaagcccaccctcgacatcgagctgctgaagacggaggtcaccaaccccgcggtgctccggaagctgtgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctgatcacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctcgtgcaccagatcttcggcaccgcctacggggtgctgttctccggcgtcagctggaccatgaagatcgggatcggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcaccgtggtggtcggggacgtggcgggcatcctggcccaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctccgggacagctacacccaggtgtgcgaccaccgcctgatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacacgctctggagcaacggcgtgctggagtccgagatgatcatccccaagatctacgggggcccgatcagccagcacaactaccgccccgggtacttcacccagaccgccggcccctggcacctggggaagctcgagctggacttcgacctgtgcgagggcaccacggtggtcgtggacgagcactgcggcaaccgggggccgtccctccgcaccaccaccgtgacgggcaagatcatccacgagtggtgctgccggagctgcaccctgccgcccctgcgcttccgcggggaggacggctgctggtacgggatggagatccgccccgtcaaggagaaggaggagaacctcgtgaagtccatggtgagcgccggcagcggcgaggtcgactccttcagcctggggctgctctgcatctccatcatgatcgaggaggtgatgcggagccgctggtcccggaagatgctgatgaccggcaccctggccgtgttcttcctcctgatcatggggcagctgacgtggaacgacctcatccgcctgtgcatcatggtcggcgcgaacgccagcgaccgcatggggatgggcaccacctacctggccctcatggccaccttcaagatgcggccgatgttcgccgtgggcctgctgttccgccggctcacgtcccgcgaggtgctgctgctcaccatcgggctgagcctggtcgcgtccgtggagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcctggaagaccatggcgatggtcctcagcatcgtgtccctgttccccctgtgcctcagcacgacctcccagaagaccacctggctgcccgtgctgctcggcagcctggggtgcaagccgctgacgatgttcctcatcgccgagaacaagatctggggccggaagtcctggcccctgaacgaggggatcatggccgtcggcatcgtgagcatcctgctcagctccctgctgaagaacgacgtgcccctcgccgggcccctgatcgccggcggcatgctgatcgcgtgctacgtcatcagcgggtccagcgccgacctctccctggagaaggccgccgaggtgagctgggaggaggaggccgagcactccggcgcgagccacaacatcctggtggaggtccaggacgacgggaccatgaagatcaaggacgaggagcgcgacgacaccctcaccatcctgctgaaggccaccctcctggccgtgtccggcgtgtacccgctgagcatccccgccaccctcttcgtctggtacttctggcagaagaagaagcagcggtccggggtgctgtgggacacccccagcccgcccgaggtggagcgcgccgtcctggacgacggcatctaccggatcatgcagcgcggcctgctcgggcggtcccaggtgggcgtgggggtcttccaggagaacgtgttccacaccatgtggcacgtgacccgcggcgcggtcctgatgtaccaggggaagcggctggagcccagctgggcctccgtgaagaaggacctcatcagctacggcggcgggtggcgcctgcagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgggaggggaagatcgtgggcctctacggcaacggggtcgtgaccaccagcggcacctacgtgagcgccatcgcccaggccaaggcgtcccaggaggggccgctgcccgagatcgaggacgaggtcttccgcaagcggaacctgacgatcatggacctccaccccggcagcgggaagacccgccggtacctgccggccatcgtgcgcgaggccatcaagcggaagctgcgcaccctcatcctggcccccacccgcgtggtcgcctccgagatggcggaggccctgaagggcatgcccatccggtaccagacgaccgccgtcaagagcgagcacaccggcaaggagatcgtggacctcatgtgccacgccaccttcacgatgcgcctgctgtcccccgtccgggtgccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctccgcaagaacgggaagcgggtgatccagctgtcccgcaagaccttcgacacggagtaccagaagaccaagaacaacgactgggactacgtggtcaccaccgacatcagcgagatgggcgcgaacttccgggccgaccgcgtgatcgacccgcggcgctgcctgaagcccgtgatcctcaaggacgggcccgagcgggtcatcctggccggccccatgccggtgacggtcgcctccgccgcgcagcgccgggggcgcgtgggccggaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccgcctccggggcgaggcccgcaagaccttcgtggagctgatgcggcgcggggacctgcccgtctggctctcctacaaggtggccagcgagggcttccagtacagcgaccggcgctggtgcttcgacggcgagcggaacaaccaggtgctggaggagaacatggacgtcgagatctggacgaaggagggggagcgcaagaagctgcggccccgctggctcgacgcccggacctactccgaccccctggccctgcgcgagttcaaggagttcgcggccggccggcgcagcgtgtccggggacctcatcctggagatcggcaagctgccgcagcacctcacccagcgggcccagaacgccctggacaacctggtgatgctccacaacagcgagcagggcgggcgcgcgtaccggcacgccatggaggagctgcccgacaccatcgagacgctgatgctcctggccctgatcgccgtcctcaccggcggggtgaccctgttcttcctgtccggccgcgggctcggcaagaccagcatcggcctgctgtgcgtgatggcctccagcgcgctcctgtggatggcctccgtcgagccccactggatcgccgccagcatcatcctggagttcttcctcatggtgctgctgatccccgagccggaccggcagcgcacgccccaggacaaccagctcgcctacgtggtcatcgggctgctgttcatgatcctcacggtggcggccaacgagatgggcctgctggagaccaccaagaaggacctcgggatcggccacgtggccgtcgagaaccaccaccacgccgccatgctggacgtggacctgcaccccgcgtccgcctggaccctctacgccgtggccacgaccatcatcaccccgatgatgcggcacaccatcgagaacacgaccgccaacatcagcctgaccgcgatcgccaaccaggccgccatcctgatggggctcgacaagggctggcccatctccaagatggacatcggcgtccccctgctggcgctcgggtgctacagccaggtgaaccccctgaccctgacggccgccgtgctcatgctggtcgcccactacgccatcatcggcccggggctgcaggcgaaggccacccgcgaggcccagaagcgcaccgccgccggcatcatgaagaaccccaccgtggacgggatcgtggcgatcgacctcgaccccgtcgtgtacgacgccaagttcgagaagcagctgggccagatcatgctgctcatcctgtgcacgtcccagatcctgctcatgcggaccacctgggccctgtgcgagagcatcaccctggccacgggccccctcaccaccctgtgggaggggtccccgggcaagttctggaacaccacgatcgccgtgagcatggcgaacatcttccgcgggtcctacctggccggcgccggcctcgccttcagcctgatgaagtccctcgggggcgggcggcgcgggaccggggcgcagggcgagaccctcggcgagaagtggaagcggcagctgaaccagctgtccaagagcgagttcaacacctacaagcgctccgggatcatggaggtcgaccggagcgaggccaaggagggcctcaagcgcggggagacgaccaagcacgccgtgtcccggggcaccgccaagctgcgctggttcgtggagcggaacctggtcaagcccgaggggaaggtgatcgacctgggctgcggccgcgggggctggagctactactgcgccgggctcaagaaggtgaccgaggtcaagggctacacgaagggcggccccggccacgaggagcccatcccgatggcgacctacgggtggaacctggtgaagctgcactccggcaaggacgtgttcttcatcccgcccgagaagtgcgacaccctcctgtgcgacatcggggagagctcccccaacccgaccatcgaggagggccggacgctgcgcgtcctcaagatggtggagccctggctgcgggggaaccagttctgcatcaagatcctgaacccctacatgcccagcgtggtcgagaccctcgagcagatgcagcgcaagcacggcggcatgctggtgcggaacccgctgtcccgcaacagcacccacgagatgtactgggtgtcctgcgggaccggcaacatcgtcagcgccgtgaacatgacctcccggatgctcctgaaccgcttcacgatggcccaccgcaagcccacctacgagcgggacgtggacctgggggccggcacccgccacgtcgccgtggagcccgaggtggcgaacctcgacatcatcggccagcggatcgagaacatcaagcacgagcacaagagcacctggcactacgacgaggacaacccctacaagacgtgggcctaccacgggtcctacgaggtcaagccgagcggctccgccagcagcatggtgaacggggtcgtgaagctgctgaccaagccctgggacgtgatccccatggtcacccagatcgccatgaccgacacgacccccttcggccagcagcgcgtgttcaaggagaaggtggacacccggaccccgaaggccaagcgcgggacgacccagatcatggaggtcaccgcgcggtggctctggggcttcctgtcccgcaacaagaagccccggatctgcacccgcgaggagttcacgcggaaggtgcgcagcaacgccgccatcggcgccgtgttcgtcgacgagaaccagtggaactccgcgaaggaggccgtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggagccgggccatctggtacatgtggctgggcgcgcgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggccaagatcaccgacatcatggagccggagcacgcgctgctggccaaggccatcttcaagctcacctaccagaacaaggtggtccgcgtgcagcgccccgccaagaacgggaccgtgatggacgtcatctcccggcgcgaccagcggggcagcggccaggtggggacgtacggcctgaacaccttcaccaacatggaggcccagctgatccgccagatggagtccgaggagatcttcagcccctccgagctcgagacccccaacctggcggagcgggtgctggactggctcgagaagtacggggtcgagcgcctgaagcggatggccatcagcggcgacgactgcgtggtgaagccgatcgacgaccgcttcgccacggccctgaccgccctcaacgacatggggaaggtccggaaggacatcccccagtgggagccctccaagggctggaacgactggcagcaggtccccttctgcagccaccacttccaccagctgatcatgaaggacgggcgcgagatcgtggtcccgtgccggaaccaggacgagctggtgggccgcgcgcgggtgtcccagggcgccgggtggagcctccgcgagaccgcctgcctgggcaagagctacgcccagatgtggcagctgatgtacttccaccggcgcgacctccggctggcggccaacgccatctgctccgccgtccccgtggactgggtgcccaccagccgcacgacctggtccatccacgcccaccaccagtggatgaccaccgaggacatgctgagcgtctggaaccgggtgtggatcgaggagaacccctggatggaggacaagacgcacatctccagctgggaggacgtgccgtacctcgggaagcgcgaggaccagtggtgcggctccctgatcgggctgaccgcgcgcgccacctgggccaccaacatccaggtcgccatcaaccaggtgcggcgcctcatcggcaacgagaactacctggactacatgaccagcatgaagcggttcaagaacgagtccgaccccgagggcgccctgtggtga

SEQ ID NO: 8899 - RNA, 9879 nt, synthetic construct
  misc_feature 1..9879: note = derived and/or modified CDS sequence (opt1) from DENV-1__KC762622__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgctcacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatggccctgttcctcgcgcacgccatcggcaccagcatcacccagaaggggatcatcttcatcctgctgatgctcgtgaccccctccatggccatgcggtgcgtcggcatcggcagccgcgacttcgtggaggggctgtccggcgccacgtgggtggacgtcgtgctggagcacgggagctgcgtgaccaccatggccaaggacaagcccaccctcgacatcgagctgctgaagacggaggtcaccaaccccgcggtgctccggaagctgtgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctgatcacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctcgtgcaccagatcttcggcaccgcctacggggtgctgttctccggcgtcagctggaccatgaagatcgggatcggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcaccgtggtggtcggggacgtggcgggcatcctggcccaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctccgggacagctacacccaggtgtgcgaccaccgcctgatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacacgctctggagcaacggcgtgctggagtccgagatgatcatccccaagatctacgggggcccgaccagccagcacaactaccgccccgggtacttcacccagaccgccggcccctggcacctggggaagctcgagctggacttcgacctgtgcgagggcacgaccgtggtcgtggacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtcaaggagaaggaggagaacctcgtgaagtccatggtgagcgccggcagcggcgaggtcgactccttcagcctggggctgctctgcatctccatcatgatcgaggaggtgatgcggagccgctggtcccggaagatgctgatgaccggcacgctggccgtgttcttcctcctgatcatggggcagctgacctggaacgacctcatccgcctgtgcatcatggtcggcgcgaacgccagcgaccgcatggggatgggcaccacctacctggccctcatggccacgttcaagatgcggccgatgttcgccgtgggcctgctgttccgccggctcacctcccgcgaggtgctgctgctcaccatcgggctgagcctggtcgcgtccgtggagctccccaacagcctggaggagctgggcgacgggctcgccatgggcatcatgatcctgaagctgctcaccgacttccagtcccaccagctgtgggccacgctgctcagcctgaccttcatcaagaccaccttctccctgcactacgcctggaagacgatggcgatggtcctcagcatcgtgtccctgttccccctgtgcctcagcaccacctcccagaagaccacgtggctgcccgtgctgctcggcagcctggggtgcaagccgctgaccatgttcctcatcgccgagaacaagatctggggccggaagtcctggcccctgaacgaggggatcatggccgtcggcatcgtgagcatcctgctcagctccctgctgaagaacgacgtgcccctcgccgggcccctgatcgccggcggcatgctgatcgcgtgctacgtcatcagcgggtccagcgccgacctctccctggagaaggccgccgaggtgagctgggaggaggaggccgagcactccggcgcgagccacaacatcctggtggaggtccaggacgacgggaccatgaagatcaaggacgaggagcgcgacgacaccctcaccatcctgctgaaggccacgctcctggccgtgtccggcgtgtacccgctgagcatccccgccaccctcttcgtctggtacttctggcagaagaagaagcagcggtccggggtgctgtgggacacccccagcccgcccgaggtggagcgcgccgtcctggacgacggcatctaccggatcatgcagcgcggcctgctcgggcggtcccaggtgggcgtgggggtcttccaggagaacgtgttccacaccatgtggcacgtgacgcgcggcgcggtcctgatgtaccaggggaagcggctggagcccagctgggcctccgtgaagaaggacctcatcagctacggcggcgggtggcgcctgcagggctcctggaacaccggggaggaggtgcaggtcatcgccgtggagcccggcaagaaccccaagaacgtgcagaccgcccccgggaccttcaagacgcccgagggcgaggtcggcgccatcgcgctggacttcaagcccgggaccagcggctcccccatcgtgaaccgggaggggaagatcgtgggcctctacggcaacggggtcgtgaccaccagcggcacgtacgtgagcgccatcgcccaggccaaggcgtcccaggaggggccgctgcccgagatcgaggacgaggtcttccgcaagcggaacctgaccatcatggacctccaccccggcagcgggaagacccgccggtacctgccggccatcgtgcgcgaggccatcaagcggaagctgcgcaccctcatcctggcccccacgcgcgtggtcgcctccgagatggcggaggccctgaagggcatgcccatccggtaccagaccaccgccgtcaagagcgagcacaccggcaaggagatcgtggacctcatgtgccacgccacgttcaccatgcgcctgctgtcccccgtccgggtgccgaactacaacatgatcatcatggacgaggcccacttcaccgaccccagctccatcgcggcccgcgggtacatcagcacccgggtgggcatgggggaggccgccgccatcttcatgacggcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctccgcaagaacgggaagcgggtgatccagctgtcccgcaagacgttcgacaccgagtaccagaagaccaagaacaacgactgggactacgtggtcaccacggacatcagcgagatgggcgcgaacttccgggccgaccgcgtgatcgacccgcggcgctgcctgaagcccgtgatcctcaaggacgggcccgagcgggtcatcctggccggccccatgccggtgaccgtcgcctccgccgcgcagcgccgggggcgcgtgggccggaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccgcctccggggcgaggcccgcaagacgttcgtggagctgatgcggcgcggggacctgcccgtctggctctcctacaaggtggccagcgagggcttccagtacagcgaccggcgctggtgcttcgacggcgagcggaacaaccaggtgctggaggagaacatggacgtcgagatctggaccaaggagggggagcgcaagaagctgcggccccgctggctcgacgcccggacctactccgaccccctggccctgcgcgagttcaaggagttcgcggccggccggcgcagcgtgtccggggacctcatcctggagatcggcaagctgccgcagcacctcacccagcgggcccagaacgccctggacaacctggtgatgctccacaacagcgagcagggcgggcgcgcgtaccggcacgccatggaggagctgcccgacacgatcgagaccctgatgctcctggccctgatcgccgtcctcaccggcggggtgaccctgttcttcctgtccggccgcgggctcggcaagaccagcatcggcctgctgtgcgtgatggcctccagcgtcctcctgtggatggcgtccgtggagccccactggatcgccgccagcatcatcctggagttcttcctcatggtgctgctgatccccgagccggaccggcagcgcacgccccaggacaaccagctcgcctacgtcgtgatcgggctgctgttcatgatcctcaccgtggccgcgaacgagatgggcctgctggagaccaccaagaaggacctcgggatcggccacgtcgccgtggagaaccaccaccacgccgccatgctggacgtggacctgcaccccgcctccgcgtggacgctctacgccgtcgccaccaccatcatcaccccgatgatgcggcacacgatcgagaacaccaccgccaacatcagcctgaccgccatcgcgaaccaggccgccatcctgatggggctcgacaagggctggcccatctccaagatggacatcggcgtgcccctgctggccctcgggtgctacagccaggtgaaccccctgacgctgaccgcggccgtcctcatgctggtggcccactacgccatcatcggcccggggctgcaggccaaggcgacccgcgaggcccagaagcgcaccgccgccggcatcatgaagaaccccacggtggacgggatcgtcgccatcgacctcgaccccgtggtgtacgacgcgaagttcgagaagcagctgggccagatcatgctgctcatcctgtgcacctcccagatcctgctcatgcggaccacctgggccctgtgcgagagcatcacgctggccaccggccccctcaccaccctgtgggaggggtccccgggcaagttctggaacacgaccatcgccgtcagcatggccaacatcttccgcgggtcctacctggcgggcgccggcctcgccttcagcctgatgaagtccctcgggggcgggcggcgcgggaccggggcccagggcgagaccctcggcgagaagtggaagcggcagctgaaccagctgtccaagagcgagttcaacacgtacaagcgctccgggatcatggaggtggaccggagcgaggcgaaggagggcctcaagcgcggggagaccaccaagcacgccgtgtcccggggcaccgccaagctgcgctggttcgtcgagcggaacctggtgaagcccgaggggaaggtgatcgacctgggctgcggccgcgggggctggagctactactgcgccgggctcaagaaggtcacggaggtgaagggctacaccaagggcgggcccggccacgaggagcccatcccgatggccacctacgggtggaacctggtgaagctgcactccggcaaggacgtcttcttcatcccgcccgagaagtgcgacaccctcctgtgcgacatcggggagagctcccccaacccgacgatcgaggagggccggaccctgcgcgtgctcaagatggtggagccctggctgcgggggaaccagttctgcatcaagatcctgaacccctacatgcccagcgtcgtggagaccctcgagcagatgcagcgcaagcacggcggcatgctggtgcggaacccgctgtcccgcaacagcacccacgagatgtactgggtctcctgcgggaccggcaacatcgtgagcgcggtgaacatgacgtcccggatgctcctgaaccgcttcaccatggcccaccgcaagcccacctacgagcgggacgtcgacctgggggccggcacccgccacgtggccgtggagcccgaggtcgccaacctcgacatcatcggccagcggatcgagaacatcaagcacgagcacaagagcacgtggcactacgacgaggacaacccctacaagacctgggcgtaccacgggtcctacgaggtgaagccgagcggctccgccagcagcatggtcaacggggtggtgaagctgctgaccaagccctgggacgtcatccccatggtgacccagatcgccatgacggacaccacccccttcggccagcagcgcgtgttcaaggagaaggtcgacacccggacgccgaaggccaagcgcgggaccacccagatcatggaggtgaccgcccggtggctctggggcttcctgtcccgcaacaagaagccccggatctgcacgcgcgaggagttcatccggaaggtgcgcagcaacgcggccatcggcgccgtcttcgtggacgagaaccagtggaactccgccaaggaggcggtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggccaagatcaccgacatcatggagccggagcacgccctgctggcgaaggccatcttcaagctcacctaccagaacaaggtcgtgcgcgtgcagcgccccgccaagaacgggaccgtcatggacgtgatctcccggcgcgaccagcggggcagcggccaggtggggacgtacggcctgaacaccttcaccaacatggaggcccagctgatccgccagatggagtccgaggggatcttcagcccctccgagctcgagacccccaacctggccgagcgggtcctggactggctcgagaagtacggcgtggagcgcctgaagcggatggcgatcagcggggacgactgcgtggtcaagccgatcgacgaccgcttcgccacggccctgaccgccctcaacgacatgggcaaggtgcggaaggacatcccccagtgggagccctccaaggggtggaacgactggcagcaggtccccttctgcagccaccacttccaccagctgatcatgaaggacggccgcgagatcgtcgtgccgtgccggaaccaggacgagctggtgggccgcgcccgggtctcccagggggcgggctggagcctccgcgagaccgcctgcctgggcaagagctacgcccagatgtggcagctgatgtacttccaccggcgcgacctccggctggccgcgaacgccatctgctccgccgtgcccgtggactgggtccccaccagccgcacgacctggtccatccacgcccaccaccagtggatgaccaccgaggacatgctgagcgtgtggaaccgggtgtggatcgaggagaacccctggatggaggacaaggcccacgtctccagctgggaggacgtgccgtacctcggcaagcgcgaggaccagtggtgcgggtccctgatcggcctgacggcgcgcgccacctgggccaccaacatccaggtggccatcaaccaggtccggcgcctcatcggcaacgagaactacctggactacatgaccagcatgaagcggttcaagaacgagtccgaccccgagggggccctgtggtga

SEQ ID NO: 8900 - RNA, 9879 nt, synthetic construct
  misc_feature 1..9879: note = derived and/or modified CDS sequence (opt1) from DENV-1__KC762629__SS-prME
  source 1..9879: mol_type = other RNA
agcgtgaccatgctgctcatgctgatgcccaccgccctggccttccacctcaccacccggggcggggagccccacatggtggtgagcaagcaggagcggggcaagagcctgctgttcaagaccagcgcgggggtgaacatgtgcaccctcatcgccatggacctgggcgagctgtgcgaggacacgctcacctacaagtgcccccggatcaccgaggccgagcccgacgacgtcgactgctggtgcaacgccaccgacacctgggtgacctacgggacctgcagccagaccggcgagcaccggcgggacaagcggtccgtggccctggcgccccacgtcggcctggggctcgagacgcgcaccgagacctggatgagctccgagggcgcctggcggcagatccagcgggtggagacctgggccctgcggcaccccgggttcacggtgatcgccctgttcctcgcgcacgccatcggcaccagcatcacccagaaggggatcatcttcatcctgctgatgctcgtcaccccctccatggccatgcgctgcgtgggcatcggcagccgggacttcgtggaggggctgtccggcgccacgtgggtcgacgtggtgctggagcacgggagctgcgtcaccaccatggccaaggacaagcccaccctcgacatcgagctgctgaagacggaggtgaccaaccccgcggtgctccgcaagctgtgcatcgaggccaagatctccaacaccaccacggacagccggtgcccgacccagggcgaggccaccctggtcgaggagcaggacgccaacttcgtgtgccgccggaccttcgtggaccgcggctgggggaacggctgcgggctgttcggcaaggggtccctgatcacgtgcgccaagttcaagtgcgtcaccaagctggagggcaagatcgtgcagtacgagaacctcaagtacagcgtgatcgtcaccgtgcacaccggcgaccagcaccaggtcgggaacgagtccacggagcacggcaccaccgcgaccatcacgccccaggcccccacgaccgagatccagctgaccgactacggggccctgaccctcgactgcagcccccggacgggcctggacttcaacgagatggtgctgctcaccatgaaggagaagtcctggctggtgcacaagcagtggttcctggacctccccctgccctggaccagcggggccagcacctcccaggagacgtggaaccgccaggacctgctcgtcaccttcaagaccgcccacgcgaagaagcaggaggtggtggtcctgggcagccaggagggcgccatgcacaccgccctgacgggggccaccgagatccagacctccggcaccacgaccatcttcgccgggcacctcaagtgccggctgaagatggacaagctgaccctcaagggcatgagctacgtgatgtgcaccgggtccttcaagctggagaaggaggtggcggagacgcagcacggcaccgtcctggtgcagatcaagtacgagggcaccgacgccccctgcaagatccccttcagcacccaggacgagaagggggtgacgcagaacggccgcctgatcaccgccaacccgatcgtcaccgacaaggagaagcccgtgaacatcgaggccgagccgcccttcggggagtcctacatcgtgatcggcgcgggcgagaagaccctcaagctgagctggttcaagaaggggtccagcatcggcaagatgttcgaggccacggcccgcggggcccgccgcatggccatcctgggcgacaccgcgtgggacttcgggtccatcggcggcgtcttcaccagcgtggggaagctcgtgcaccagatcttcggcaccgcctacggggtcctgttctccggcgtgagctggacgatgaagatcgggatcggcgtgctgctcacctggctgggcctgaactcccggagcacctccctcagcatgacctgcatcgccgtcgggctggtgacgctgtacctcggcgtgatggtccaggccgactccgggtgcgtgatcaactggaagggccgcgagctgaagtgcgggagcggcatcttcgtgaccaacgaggtccacacctggaccgagcagtacaagttccaggccgacagcccgaagcggctgtccgcggccatcggcaaggcctgggaggagggggtgtgcggcatccgcagcgccacccggctcgagaacatcatgtggaagcagatctccaacgagctgaaccacatcctgctcgagaacgacatgaagttcacggtggtcgtgggggacgtggccggcatcctggcgcaggggaagaagatgatccgcccccagcccatggagcacaagtacagctggaagtcctggggcaaggccaagatcatcggcgccgacgtccagaacaccaccttcatcatcgacgggcccaacaccccggagtgccccgacgaccagcgggcctggaacatctgggaggtggaggactacggcttcgggatcttcacgaccaacatctggctgaagctccgcgacagctacacccaggtgtgcgaccaccggctgatgtccgcggccatcaaggacagcaaggccgtccacgccgacatgggctactggatcgagtccgagaagaacgagacctggaagctggcccgcgcgagcttcatcgaggtgaagacgtgcatctggcccaagtcccacaccctctggagcaacggcgtgctggagtccgagatgatcatccccaagatctacgggggcccgatcagccagcacaactaccggcccgggtacttcacccagaccgccggcccctggcacctggggaagctcgagctggacttcaacctgtgcgagggcacgaccgtcgtggtggacgagcactgcggcaaccgcgggccgtccctccggaccaccacggtcaccggcaagatcatccacgagtggtgctgccgcagctgcaccctgccgcccctgcggttccgcggggaggacggctgctggtacgggatggagatccggcccgtgaaggagaaggaggagaacctcgtgaagtccatggtcagcgccggcagcggcgaggtggactccttcagcctggggctgctctgcatctccatcatgatcgaggaggtgatgcgcagccggtggtcccgcaagatgctgatgaccggcacgctggccgtcttcttcctcctgatcatggggcagctgacctggaacgacctcatccgcctgtgcatcatggtgggcgccaacgcgagcgaccggatggggatgggcaccacctacctggccctcatggccacgttcaagatgcgcccgatgttcgccgtgggcctgctgttccggcgcctcacctcccgggaggtcctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtgctcagcatcgtgtccctgttccccctgtgcctcagcaccacctcccagaagaccacgtggctgcccgtcctgctcggcagcctggggtgcaagccgctgaccatgttcctcatcgcggagaacaagatctggggccgcaagtcctggcccctgaacgaggggatcatggccgtgggcatcgtgagcatcctgctcagctccctgctgaagaacgacgtccccctcgccgggcccctgatcgccggcggcatgctgatcgcctgctacgtgatcagcgggtccagcgcggacctctccctggagaaggccgccgaggtgagctgggaggaggaggccgagcactccggcgccagccacaacatcctggtcgaggtgcaggacgacgggaccatgaagatcaaggacgaggagcgggacgacaccctcaccatcctgctgaaggcgacgctcctggccgtgtccggcgtctacccgctgagcatccccgccaccctcttcgtgtggtacttctggcagaagaagaagcagcgctccggggtgctgtgggacacccccagcccgcccgaggtcgagcgggccgtgctggacgacggcatctaccgcatcatgcagcggggcctgctcgggcgctcccaggtgggcgtcggggtgttccaggagaacgtgttccacaccatgtggcacgtcacgcggggcgccgtgctgatgtaccaggggaagcgcctggagcccagctgggcgtccgtgaagaaggacctcatcagctacggcggcgggtggcggctgcagggctcctggaacaccggggaggaggtccaggtgatcgccgtggagcccggcaagaaccccaagaacgtccagaccgcccccgggaccttcaagacgcccgagggcgaggtgggcgccatcgccctggacttcaagcccgggaccagcggctcccccatcgtgaaccgcgaggggaagatcgtcggcctctacggcaacggggtggtgaccaccagcggcacgtacgtcagcgcgatcgcccaggccaaggcctcccaggaggggccgctgcccgagatcgaggacgaggtgttccggaagcgcaacctgaccatcatggacctccaccccggcagcgggaagacccggcgctacctgccggcgatcgtgcgggaggccatcaagcgcaagctgcgcaccctcatcctggcccccacgcgggtcgtggcctccgagatggccgaggcgctgaagggcatgcccatccgctaccagaccaccgccgtcaagagcgagcacaccggcaaggagatcgtcgacctcatgtgccacgccacgttcaccatgcggctgctgtcccccgtgcgcgtgccgaactacaacatgatcatcatggacgaggcccacttcaccgaccccagctccatcgccgcgcgggggtacatcagcacccgcgtcggcatgggggaggccgccgccatcttcatgacggccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctccggaagaacgggaagcgcgtgatccagctgtcccggaagacgttcgacaccgagtaccagaagaccaagaacaacgactgggactacgtcgtgaccacggacatcagcgagatgggcgccaacttccgcgcggaccgggtgatcgacccgcgccggtgcctgaagcccgtcatcctcaaggacgggcccgagcgcgtgatcctggccggccccatgccggtcaccgtggcctccgccgcccagcggcgcgggcgggtgggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccgcagcacctcacccagcgcgcccagaacgccctggacaacctggtcatgctccacaacagcgagcagggcgggcgggcctaccgccacgcgatggaggagctgcccgacacgatcgagaccctgatgctcctggccctgatcgccgtgctcaccggcggggtgaccctgttcttcctgtccggccgggggctcggcaagaccagcatcggcctgctgtgcgtcatggcctccagcgtgctcctgtggatggcctccgtggagccccactggatcgcggccagcatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccaccaagaaggacctcgggatcggccacgtggcggtggagaaccaccaccacgccgccatgctggacgtcgacctgcaccccgcctccgcctggacgctctacgcggtggccaccaccatcatcaccccgatgatgcgccacacgatcgagaacaccaccgccaacatcagcctgaccgccatcgccaaccaggcggccatcctgatggggctcgacaagggctggcccatctccaagatggacatcggcgtgcccctgctggccctcgggtgctacagccaggtcaaccccctgacgctgaccgccgcggtgctcatgctggtggcccactacgccatcatcggcccggggctgcaggccaaggccacccgcgaggcgcagaagcggaccgccgccggcatcatgaagaaccccacggtcgacgggatcgtggccatcgacctcgaccccgtggtctacgacgccaagttcgagaagcagctgggccagatcatgctgctcatcctgtgcacctcccagatcctgctcatgcgcaccacctgggcgctgtgcgagagcatcacgctggccaccggccccctcaccaccctgtgggaggggtccccgggcaagttctggaacacgaccatcgccgtgagcatggccaacatcttccgggggtcctacctggccggcgcgggcctcgccttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtggaccgcagcgaggccaaggagggcctcaagcgcggggagaccaccaagcacgcggtctcccgcggcaccgccaagctgcggtggttcgtggagcgcaacctggtgaagcccgaggggaaggtcatcgacctgggctgcggccgcgggggctggagctactactgcgccgggctcaagaaggtgacggaggtgaagggctacaccaagggcggccccggccacgaggagcccatcccgatggccacctacgggtggaacctggtcaagctgcactccggcaaggacgtgttcttcatcccgcccgagaagtgcgacaccctcctgtgcgacatcggggagagctcccccaacccgacgatcgaggagggccgcaccctgcgggtgctcaagatggtcgagccctggctgcgcgggaaccagttctgcatcaagatcctgaacccctacatgcccagcgtggtggagaccctcgagcagatgcagcggaagcacggcggcatgctggtccgcaacccgctgtcccggaacagcacccacgagatgtactgggtgtcctgcgggaccggcaacatcgtgagcgccgtcaacatgacgtcccgcatgctcctgaaccgcttcaccatggcgcaccggaagcccacctacgagcgcgacgtggacctgggggccggcacccggcacgtggccgtcgagcccgaggtggccaacctcgacatcatcggccagcgcatcgagaacatcaagcacgagcacaagagcacgtggcactacgacgaggacaacccctacaagacctgggcctaccacgggtcctacgaggtcaagccgagcggctccgcgagcagcatggtgaacggggtggtcaagctgctgaccaagccctgggacgtgatccccatggtgacccagatcgccatgacggacaccacccccttcggccagcagcgggtcttcaaggagaaggtggacacccgcacgccgaaggccaagcgggggaccacccagatcatggaggtgaccgcccgctggctctggggcttcctgtcccggaacaagaagccccgcatctgcacgcgggaggagttcacccgcaaggtccggagcaacgccgcgatcggcgccgtgttcgtggacgagaaccagtggaactccgccaaggaggccgtcgaggacgagcgcttctgggacctggtgcaccgggagcgcgagctccacaagcaggggaagtgcgcgacctgcgtgtacaacatgatgggcaagcgggagaagaagctgggggagttcggcaaggccaaggggagccgcgccatctggtacatgtggctgggcgcccggttcctcgagttcgaggccctgggcttcatgaacgaggaccactggttctcccgcgggaacagcctgtccggcgtcgagggggagggcctccacaagctggggtacatcctgcgggacatcagcaagatccccggcggcaacatgtacgcggacgacaccgccgggtgggacacgcgcatcaccgaggacgacctccagaacgaggccaagatcaccgacatcatggagccggagcacgccctgctggccaaggcgatcttcaagctcacctaccagaacaaggtggtgcgcgtccagcggcccgccaagaacggcacggtgatggacgtgatctcccgccgggaccagcgcgggagcggccaggtcggcacctacgggctgaacaccttcaccaacatggaggcccagctgatccggcagatggagtccgagggcatcttcagcccctccgagctcgagacgcccaacctggccgagcgcgtgctggactggctcgagaagtacggggtggagcggctgaagcgcatggccatcagcggcgacgactgcgtcgtgaagccgatcgacgaccggttcgcgaccgccctgaccgccctcaacgacatggggaaggtgcgcaaggacatcccccagtgggagccctccaagggctggaacgactggcagcaggtccccttctgcagccaccacttccaccagctgatcatgaaggacggccgggagatcgtggtgccgtgccgcaaccaggacgagctggtcgggcgggcccgcgtgtcccagggcgccgggtggagcctccgggagaccgcgtgcctgggcaagagctacgcccagatgtggcagctgatgtacttccaccgccgggacctccgcctggccgccaacgcgatctgctccgccgtgcccgtcgactgggtgcccacgagccggaccacctggtccatccacgcccaccaccagtggatgaccacggaggacatgctgagcgtgtggaaccgcgtctggatcgaggagaacccctggatggaggacaagacccacatctccagctgggaggacgtgccgtacctcgggaagcgcgaggaccagtggtgcggctccctgatcggcctgaccgcccgggccacctgggcgaccaacatccaggtggccatcaaccaggtccgccggctcatcgggaacgagaactacctggactacatgacgagcatgaagcgcttcaagaacgagtccgaccccgagggcgccctgtggtga

SEQ ID NO: 8901 - RNA, 9879 nt, synthetic construct
  misc_feature 1..9879: note = derived and/or modified CDS sequence (opt1) from DENV-1__KC762627__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgctcacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcagccgcgacttcgtggaggggctgtccggcgccacgtgggtggacgtcgtgctggagcacgggagctgcgtgaccaccatggccaaggacaagcccaccctcgacatcgagctgctgaagacggaggtcaccaaccccgcggtgctccggaagctgtgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctgatcacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctcatccaccagatcttcggcaccgcctacggggtgctgttctccggcgtgagctggaccatgaagatcgggatcggcgtcctgctcacgtggctgggcctgaactcccgcagcacctccctcagcatgacctgcatcgccgtggggctggtgaccctgtacctcggcgtcatggtgcaggccgactccgggtgcgtgatcaactggaagggccgggagctgaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctcgagaacatcatgtggaagcagatctccaacgagctgaaccacatcctgctcgagaacgacatgaagttcaccgtcgtggtgggggacgtcgcgggcatcctggcccaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcgtggaacatctgggaggtggaggactacggcttcgggatcttcaccacgaacatctggctgaagctccgggacagctacacccaggtctgcgaccaccgcctgatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcaccacggtggtggtcgacgagcactgcggcaaccgggggccgtccctccgcaccaccaccgtgacgggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatgatgatcgaggaggtcatgcggagccgctggtcccggaagatgctgatgaccggcaccctggccgtgttcttcctcctgatcatggggcagctgacgtggaacgacctcatccgcctgtgcatcatggtgggcgcgaacgccagcgaccgcatggggatgggcaccacctacctggccctcatggccaccttcaagatgcggccgatgttcgccgtcggcctgctgttccgccggctcacgtcccgcgaggtgctgctgctcaccatcgggctgagcctggtggcgtccgtcgagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcctggaagaccatggcgatggtgctcagcatcgtctccctgttccccctgtgcctcagcacgacctcccagaagaccacctggctgcccgtgctgctcggcagcctggggtgcaagccgctgacgatgttcctcatcgccgagaacaagatctggggccggaagtcctggcccctgaacgaggggatcatggccgtgggcatcgtcagcatcctgctcagctccctgctgaagaacgacgtgcccctcgccgggcccctgatcgccggcggcatgctgatcgcgtgctacgtgatcagcgggtccagcgccgacctctccctggagaaggccgccgaggtcagctgggaggaggaggccgagcactccggcgcgagccacaacatcctggtggaggtgcaggacgacgggaccatgaagatcaaggacgaggagcgcgacgacaccctcaccatcctgctgaaggccaccctcctggccgtctccggcgtgtacccgctgagcatccccgccaccctcttcgtgtggtacttctggcagaagaagaagcagcggtccggggtcctgtgggacacccccagcccgcccgaggtggagcgcgccgtgctggacgacggcatctaccggatcatgcagcgcggcctgctcgggcggtcccaggtcggcgtgggggtgttccaggagaacgtcttccacaccatgtggcacgtgacccgcggcgcggtgctgatgtaccaggggaagcggctggagcccagctgggcctccgtcaagaaggacctcatcagctacggcggcgggtggcgcctgcagggctcctggaacacgggggaggaggtccaggtgatcgccgtcgagcccggcaagaaccccaagaacgtgcagaccgcccccgggaccttcaagacccccgagggcgaggtgggcgccatcgcgctggacttcaagcccgggacgagcggctcccccatcgtcaaccgggaggggaagatcgtgggcctctacggcaacggggtggtcaccaccagcggcacctacgtgagcgccatcgcccaggccaaggcgtcccaggaggggccgctgcccgagatcgaggacgaggtgttccgcaagcggaacctgacgatcatggacctccaccccggcagcgggaagacccgccggtacctgccggccatcgtccgcgaggccatcaagcggaagctgcgcaccctcatcctggcccccacccgcgtggtggcctccgagatggcggaggccctgaagggcatgcccatccggtaccagacgaccgccgtcaagagcgagcacaccggcaaggagatcgtggacctcatgtgccacgccaccttcacgatgcgcctgctgtcccccgtgcgggtcccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtggaggccttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgccaactgcctccgcaagaacgggaagcgggtcatccagctgtcccgcaagaccttcgacacggagtaccagaagaccaagaacaacgactgggactacgtggtgaccaccgacatcagcgagatgggcgcgaacttccgggccgaccgcgtcatcgacccgcggcgctgcctgaagcccgtgatcctcaaggacgggcccgagcgggtgatcctggccggccccatgccggtcacggtggcctccgccgcgcagcgccgggggcgcgtcggccggaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccgcctccggggcgaggcccgcaagaccttcgtggagctgatgcggcgcggggacctgcccgtgtggctctcctacaaggtcgccagcgagggcttccagtacagcgaccggcgctggtgcttcgacggcgagcggaacaaccaggtgctggaggagaacatggacgtggagatctggacgaaggagggggagcgcaagaagctgcggccccgctggctcgacgcccggacctactccgaccccctggccctgcgcgagttcaaggagttcgcggccggccggcgcagcgtctccggggacctcatcctggagatcggcaagctgccgcagcacctcacccagcgggcccagaacgccctggacaacctggtgatgctccacaacagcgagcagggcgggcgcgcgtaccggcacgccatggaggagctgcccgacaccatcgagacgctgatgctcctggccctgatcgccgtgctcaccggcggggtcaccctgttcttcctgtccggccgcgggctcggcaagaccagcatcggcctgctgtgcgtgatggcctccagcgtgctcctgtggatggcgtccgtcgagccccactggatcgccgccagcatcatcctggagttcttcctcatggtgctgctgatccccgagccggaccggcagcgcacgccccaggacaaccagctcgcctacgtggtcatcgggctgctgttcatgatcctcacggtggccgcgaacgagatgggcctgctggagaccaccaagaaggacctcgggatcggccacgtggccgtcgagaaccaccaccacgccgccatgctggacgtggacctgcaccccgcctccgcgtggaccctctacgccgtggccacgaccatcatcaccccgatgatgcggcacaccatcgagaacacgaccgccaacatcagcctgaccgccatcgcgaaccaggccgccatcctgatggggctcgacaagggctggcccatctccaagatggacatcggcgtccccctgctggccctcgggtgctacagccaggtgaaccccctgaccctgacggcggccgtgctcatgctggtcgcccactacgccatcatcggcccggggctgcaggccaaggcgacccgcgaggcccagaagcgcaccgccgccggcatcatgaagaaccccaccgtggacgggatcgtggccatcgacctcgaccccgtcgtgtacgacgcgaagttcgagaagcagctgggccagatcatgctgctcatcctgtgcacgtcccagatcctgctcatgcggaccacctgggccctgtgcgagagcatcaccctggccacgggccccctcaccaccctgtgggaggggtccccgggcaagttctggaacaccacgatcgccgtgagcatggccaacatcttccgcgggtcctacctggcgggcgccggcctcgccttcagcctgatgaagtccctcgggggcgggcggcgcgggaccggggcccagggcgagaccctcggcgagaagtggaagcggcagctgaaccagctgtccaagagcgagttcaacacctacaagcgctccgggatcatggaggtcgaccggagcgaggcgaaggagggcctcaagcgcggggagacgaccaagcacgccgtgtcccggggcaccgccaagctgcgctggttcgtggagcggaacctggtcaagcccgaggggaaggtgatcgacctgggctgcggccgcgggggctggagctactactgcgccgggctcaagaaggtgaccgaggtcaagggctacacgaagggcggccccggccacgaggagcccatcccgatggccacctacgggtggaacctggtgaagctgcactccggcaaggacgtgttcttcatcccgcccgagaagtgcgacaccctcctgtgcgacatcggggagagctcccccaacccgaccatcgaggagggccggacgctgcgcgtcctcaagatggtggagccctggctgcgggggaaccagttctgcatcaagatcctgaacccctacatgcccagcgtggtcgagaccctcgagcagatgcagcgcaagcacggcggcatgctggtgcggaacccgctgtcccgcaacagcacccacgagatgtactgggtgtcctgcgggaccggcaacatcgtcagcgcggtgaacatgacctcccggatgctcctgaaccgcttcacgatggcccaccgcaagcccacctacgagcgggacgtggacctgggggccggcacccgccacgtcgccgtggagcccgaggtggccaacctcgacatcatcggccagcggatcgagaacatcaagcacgagcacaagagcacctggcactacgacgaggacaacccctacaagacgtgggcgtaccacgggtcctacgaggtcaagccgagcggctccgccagcagcatggtgaacggggtcgtgaagctgctgaccaagccctgggacgtgatccccatggtcacccagatcgccatgaccgacacgacccccttcggccagcagcgcgtgttcaaggagaaggtggacacccggaccccgaaggccaagcgcgggacgacccagatcatggaggtcaccgcccggtggctctggtccttcctgagccgcaacaagaagccccggatctgcacccgcgaggagttcacgcggaaggtgcgctccaacgcggccatcggcgccgtgttcgtcgacgagaaccagtggaacagcgccaaggaggcggtggaggacgagcggttctgggacctggtgcaccgcgagcgggagctccacaagcagggcaagtgcgcgacctgcgtctacaacatgatggggaagcgcgagaagaagctgggcgagttcgggaaggccaagggctcccgggccatctggtacatgtggctgggggcccgcttcctcgagttcgaggcgctgggcttcatgaacgaggaccactggttcagccgggagaactccctgagcggcgtggagggggagggcctccacaagctggggtacatcctgcgcgacatctccaagatccccggcgggaacatgtacgccgacgacaccgccggctgggacacccggatcacggaggacgacctccagaacgaggccaagatcaccgacatcatggagccggagcacgccctgctggcgaaggccatcttcaagctcacctaccagaacaaggtggtccgcgtgcagcgccccgccaagaacggcaccgtgatggacgtcatcagccggcgcgaccagcgggggtccggccaggtggggacgtacggcctgaacaccttcaccaacatggaggcccagctgatccgccagatggagagcgagggcatcttctcccccagcgagctcgagacctccaacctggccgagcgggtgctggactggctcgagaagtacggggtcgagcgcctgaagcggatggcgatcagcggcgacgactgcgtggtgaagcccatcgacgaccgcttcgccacggccctgaccgccctcaacgacatggggaaggtccggaaggacatcccgcagtgggagccctccaagggctggaacgactggcagcaggtccccttctgcagccaccacttccaccagctgatcatgaaggacgggcgcgagatcgtggtcccctgccggaaccaggacgagctggtgggccgcgcccgggtgagccagggcgcggggtggtccctccgcgagaccgcctgcctgggcaagagctacgcccagatgtggcagctgatgtacttccaccggcgcgacctccggctggccgcgaacgccatctgctccgccgtcccggtggactgggtgcccaccagccgcacgacctggtccatccacgcccaccaccagtggatgaccaccgaggacatgctgagcgtctggaaccgggtgtggatcgaggagaacccctggatggaggacaagacgcacatctccagctgggaggacgtgccctacctcgggaagcgcgaggaccagtggtgcggctccctgatcgggctgaccgcccgcgcgacctgggccaccaacatccaggtcgccatcaaccaggtgcggcgcctcatcggcaacgagaactacctggactacatgaccagcatgaagcggttcaagaacgagtccgacccggagggcgccctgtggtga

SEQ ID NO: 8902 - RNA, 9879 nt, synthetic construct
  misc_feature 1..9879: note = derived and/or modified CDS sequence (opt1) from DENV-1__KC762647__SS-prME
  source 1..9879: mol_type = other RNA
agcgtgaccatgctgctcatgctgacccccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccctcacctacaagtgcccccgcatcaccgaggccgagcccgacgacgtggactgctggtgcaacgccacggacacctgggtgacctacgggacctgcagccagacgggcgagcaccggcgcgacaagcggtccgtggccctggcgccccacgtgggcctggggctcgagacccgcaccgagacctggatgagctccgagggcgcctggaagcagatccagcgggtcgagacgtgggccctgcgccaccccgggttcaccgtgatcgccctgttcctcgcgcacgccatcggcaccagcatcacccagaaggggatcatcttcatcctgctgatgctcgtgacgccctccatggccatgcggtgcgtcggcatcggcagccgcgacttcgtggaggggctgtccggcgccacctgggtggacgtcgtgctggagcacgggagctgcgtgaccaccatggccaaggacaagcccacgctcgacatcgagctgctgaagaccgaggtcaccaaccccgcggtgctccggaagctgtgcatcgaggccaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctgatcacgtgcgccaagttcaagtgcgtgaccaagctggagggcaagatcgtccagtacgagaacctcaagtacagcgtgatcgtgaccgtccacacgggcgaccagcaccaggtggggaacgagtccaccgagcacggcaccaccgcgaccatcacgccccaggcccccaccaccgagatccagctgaccgactacggggccctgacgctcgactgcagcccccgcaccggcctggacttcaacgagatggtcctgctcaccatgaaggagaagtcctggctggtgcacaagcagtggttcctggacctccccctgccctggaccagcggggccagcacgtcccaggagacctggaaccggcaggacctgctcgtgaccttcaagaccgcccacgcgaagaagcaggaggtcgtggtgctgggcagccaggagggcgccatgcacacggccctgaccggggccaccgagatccagacctccggcacgaccaccatcttcgccgggcacctcaagtgccgcctgaagatggacaagctgaccctcaagggcatgagctacgtcatgtgcacggggtccttcaagctggagaaggaggtggcggagacccagcacggcaccgtgctggtccagatcaagtacgagggcaccgacgccccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccacggcccgcggggcccggcgcatggcgatcctgggcgacaccgcctgggacttcgggtccatcggcggcgtgttcaccagcgtcgggaagctcgtgcaccagatcttcggcaccgcctacggggtgctgttctccggcgtcagctggacgatgaagatcgggatcggcgtgctgctcacctggctgggcctgaactcccgcagcacctccctcagcatgacctgcatcgccgtggggctggtcacgctgtacctcggcgtgatggtgcaggccgactccgggtgcgtcatcaactggaagggccgggagctgaagtgcgggagcggcatcttcgtgaccaacgaggtgcacacctggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcacggtggtggtcggggacgtggcgggcatcctggcccaggggaagaagatgatccggccccagcccatggagcacaagtacagctggaagtcctggggcaaggccaagatcatcggcgccgacgtgcagaacaccaccttcatcatcgacgggcccaacaccccggagtgccccgacgaccagcgcgcgtggaacatctgggaggtcgaggactacggcttcgggatcttcacgaccaacatctggctgaagctccgggacagctacacccaggtgtgcgaccaccgcctgatgtccgccgccatcaaggacagccgggccgtgcacgccgacatgggctactggatcgagtccgagaagaacgagacctggaagctggcgcgcgccagcttcatcgaggtcaagacgtgcgtgtggcccaagtcccacaccctctggagcaacggcgtgctggagtccgagatgatcatccccaagatctacgggggcccgatcagccagcacaactaccggcccgggtacttcacccagaccgccggcccctggcacctggggaagctcgagctggacttcgacctgtgcgagggcacgaccgtcgtggtggacgagcactgcggcaaccgcgggccgtccctccggaccaccacggtcaccggcaagatcatccacgagtggtgctgccgcagctgcaccctgccgcccctgcggttccgcggggaggacggctgctggtacgggatggagatccggcccgtgaaggagaaggaggagaacctcgtgaagtccatggtcagcgccggcagcggcgaggtggactccttcagcctggggctgctctgcatctccatcatgatcgaggaggtgatgcgcagccggtggtcccgcaagatgctgatgaccggcacgctggccgtcttcttcctcctgatcatggggcagctgacctggaacgacctcatccgcctgtgcatcatggtgggcgcgaacgccagcgaccggatggggatgggcaccacctacctggccctcatggccacgttcaagatgcgcccgatgttcgccgtggggctgctgttccggcgcctcacctcccgggaggtcctgctgctcaccatcgggctgagcctggtggcgtccgtcgagctccccaacagcctggaggagctgggcgacgggctcgccatgggcatcatgatcctgaagctgctcaccgacttccagtcccaccagctgtgggccacgctgctcagcctgaccttcatcaagaccaccttctccctgcactacgcctggaagacgatggcgatggtgctcagcatcgtgtccctgttccccctgtgcctcagcaccacctcccagaagaccacgtggctgcccgtcctgctcggcagcctggggtgcaagccgctgaccatgttcctcatcgccgagaacaagatctggggccgcaagtcctggcccctgaacgaggggatcatggccgtgggcatcgtgagcatcctgctcagctccctgctgaagaacgacgtccccctcgccgggcccctgatcgccggcggcatgctgatcgcgtgctacgtgatcagcgggtccagcgccgacctctccctggagaaggccgccgaggtgagctgggaggaggaggccgagcactccggcgcgagccacaacatcctggtcgaggtgcaggacgacgggaccatgaagatcaaggacgaggagcgggacgacaccctcaccatcctgctgaaggccacgctcctggccgtgtccggcgtctacccgctgagcatccccgccaccctcttcgtgtggtacttctggcagaagaagaagcagcgctccggggtgctgtgggacacccccagcccgcccgaggtcgagcgggccgtgctggacgacggcatctaccgcatcatgcagcggggcctgctcgggcgctcccaggtgggcgtcggggtgttccaggagaacgtgttccacaccatgtggcacgtcacgcggggcgcggtgctgatgtaccaggggaagcgcctggagcccagctgggcctccgtgaagaaggacctcatcagctacggcggcgggtggcggctgcagggctcctggaacaccggggaggaggtccaggtgatcgccgtggagcccggcaagaaccccaagaacgtccagaccgcccccgggaccttcaagacgcccgagggcgaggtgggcgccatcgcgctggacttcaagcccgggaccagcggctcccccatcgtgaaccgcgaggggaagatcgtcggcctctacggcaacggggtggtgaccaccagcggcacgtacgtcagcgccatcgcccaggccaaggcgtcccaggaggggccgctgcccgagatcgaggacgaggtgttccggaagcgcaacctgaccatcatggacctccaccccggcagcgggaagacccggcgctacctgccggccatcgtgcgggaggccatcaagcgcaagctgcgcaccctcatcctggcccccacgcgggtcgtggcctccgagatggcggaggccctgaagggcatgcccatccgctaccagaccaccgccgtcaagagcgagcacaccggcaaggagatcgtcgacctcatgtgccacgccacgttcaccatgcggctgctgtcccccgtgcgcgtgccgaactacaacatgatcatcatggacgaggcccacttcaccgaccccagctccatcgcggcccgggggtacatcagcacccgcgtcggcatgggggaggccgccgccatcttcatgacggcgacgccgcccggctccgtggaggccttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctccggaagaacgggaagcgcgtgatccagctgtcccggaagacgttcgacaccgagtaccagaagaccaagaacaacgactgggactacgtcgtgaccacggacatcagcgagatgggcgcgaacttccgcgccgaccgggtgatcgacccgcgccggtgcctgaagcccgtcatcctcaaggacgggcccgagcgcgtgatcctggccggccccatgccggtcaccgtggcctccgccgcgcagcggcgcgggcgggtgggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccggctccgcggcgaggcccggaagacgttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctactccgaccccctggccctgcgggagttcaaggagttcgcggccggccgccggagcgtgtccggggacctcatcctggagatcggcaagctgccgcagcacctcacccagaaggcccagaacgccctggacaacctggtcatgctccacaacagcgagcagggcgggcgcgcgtaccggcacgccatggaggagctgcccgacacgatcgagaccctgatgctcctggccctgatcgccgtgctcaccggcggggtgaccctgttcttcctgtccggccgcgggctcggcaagaccagcatcggcctgctgtgcgtcatggcctccagcgtgctcctgtggatggcgtccgtggagccccactggatcgccgccagcatcatcctggagttcttcctcatggtcctgctgatccccgagccggaccggcagcgcacgccccaggacaaccagctcgcctacgtggtgatcgggctgctgttcatgatcctcaccgtcgccgcgaacgagatgggcctgctggagaccaccaagaaggacctcgggatcggccacgtggccgtggagaaccaccaccacgccgccatgctggacgtcgacctgcaccccgcctccgcgtggacgctctacgccgtggccaccaccatcatcaccccgatgatgcggcacacgatcgagaacaccaccgccaacatcagcctgaccgccatcgcgaaccaggccgccatcctgatggggctcgacaagggctggcccatctccaagatggacatcggcgtgcccctgctggccctcgggtgctacagccaggtcaaccccctgacgctgaccgcggccgtgctcatgctggtggcccactacgccatcatcggcccggggctgcaggccaaggcgacccgcgaggcccagaagcgcaccgccgccggcatcatgaagaaccccacggtcgacgggatcgtggccatcgacctcgaccccgtggtctacgacgcgaagttcgagaagcagctgggccagatcatgctgctcatcctgtgcacctcccagatcctgctcatgcggaccacctgggccctgtgcgagagcatcacgctggccaccggccccctcaccaccctgtgggaggggtccccgggcaagttctggaacacgaccatcgccgtgagcatggccaacatcttccgcgggtcctacctggcgggcgccggcctcgccttcagcctgatgaagtccctcgggggcgggcggcgcgggaccggggcccagggcgagaccctcggcgagaagtggaagcggcagctgaaccagctgtccaagagcgagttcaacacgtacaagcgctccgggatcatggaggtggaccggagcgaggcgaaggagggcctcaagcgcggggagaccaccaagcacgccgtctcccggggcaccgccaagctgcgctggttcgtggagcggaacctggtgaagcccgaggggaaggtcatcgacctgggctgcggccgcgggggctggagctactactgcgccgggctcaagaaggtgacggaggtgaagggctacaccaagggcgggcccggccacgaggagcccatcccgatggccacctacgggtggaacctggtcaagctgcactccggcaaggacgtgttcttcatcccgcccgagaagtgcgacaccctcctgtgcgacatcggggagagctcccccaacccgacgatcgaggagggccggaccctgcgcgtgctcaagatggtcgagccctggctgcgggggaaccagttctgcatcaaggtgctgaacccctacatgcccagcgtggtcgagaccctcgagcagatgcagcgcaagcacggcggcatgctggtgcggaacccgctgtcccgcaacagcacccacgagatgtactgggtgtcctgcgggaccggcaacatcgtcagcgcggtgaacatgacgtcccggatgctcctgaaccgcttcaccatggcccaccgcaagcccacctacgagcgggacgtggacctgggggccggcacccgccacgtcgccgtggagcccgaggtcgccaacctcgacatcatcggccagcggatcgagaacatcaagcacgagcacaagagcacgtggcactacgacgaggacaacccctacaagacctgggcgtaccacgggtcctacgaggtgaagccgagcggctccgccagcagcatggtgaacggggtcgtgaagctgctgaccaagccctgggacgtgatccccatggtcacccagatcgccatgacggacaccacccccttcggccagcagcgcgtgttcaaggagaaggtggacacccggacgccgaaggccaagcgcgggaccacccagatcatggaggtcaccgcccggtggctctggggcttcctgtcccgcaacaagaagccccggatctgcacgcgcgaggagttcacccggaaggtgcgcagcaacgcggccatcggcgccgtgttcgtcgacgagaaccagtggaactccgccaaggaggcggtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacgcggatcaccgaggacgacctccagaacgaggccaagatcaccgacatcatggagccggagcacgccctgctggcgaaggccatcttcaagctcacctaccagaacaaggtggtccgcgtgcagcgccccgccaagaacgggacggtgatggacgtcatctcccggcgcgaccagcggggcagcggccaggtgggcacctacggcctgaacaccttcaccaacatggaggcccagctgatccgccagatggagtccgaggggatcttcagcccctccgagctcgagacgcccaacctggccgagcgggtgctggactggctcgagaagtacggcgtcgagcgcctgaagcggatggcgatcagcggggacgactgcgtggtgaagccgatcgacgaccgcttcgccaccgccctgaccgccctcaacgacatgggcaaggtccggaaggacatcccccagtgggagccctccaaggggtggaacgactggcagcaggtccccttctgcagccaccacttccaccagctgatcatgaaggacggccgcgagatcgtggtcccgtgccggaaccaggacgagctggtgggccgcgcccgggtgtcccagggggcgggctggagcctccgcgagcccgcctgcctgggcaagagctacgcccagatgtggcagctgatgtacttccaccggcgcgacctccggctggccgcgaacgccatctgctccgccgtccccgtggactgggtgcccaccagccgcacgacctggtccatccacgcccaccaccagtggatgaccaccgaggacatgctgagcgtctggaaccgggtgtggatcgaggagaacccgtggatggaggacaagacgcacatctccagctgggaggacgtgccctacctcggcaagcgcgaggaccagtggtgcgggtccctgatcggcctgaccgcccgcgcgacctgggccaccaacatccaggtcgccatcaaccaggtgcggcgcctcatcggcaacgagaactacctggactacatgaccagcatgaagcggttcaagaacgagtccgaccccgagggggccctgtggtga

SEQ ID NO: 8903 - RNA, 9879 nt, synthetic construct
  misc_feature 1..9879: note = derived and/or modified CDS sequence (opt1) from DENV-1__KC762639__SS-prME
  source 1..9879: mol_type = other RNA
agcgtgaccatgctgctcatgctgacccccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccctcacctacaagtgcccccgcatcaccgaggccgagcccgacgacgtggactgctggtgcaacgccacggacacctgggtgacctacgggacctgcagccagacgggcgagcaccggcgcgacaagcggtccgtggccctggcgccccacgtgggcctggggctcgagacccgcaccgagacctggatgagctccgagggcgcctggaagcagatccagcgggtcgagacgtgggccctgcgccaccccgggttcaccgtgatcgccctgttcctcgcgcacgccatcggcaccagcatcacccagaaggggatcatcttcatcctgctgatgctcgtgacgccctccatggccatgcggtgcgtcggcatcggcagccgcgacttcgtggaggggctgtccggcgccacctgggtggacgtcgtgctggagcacgggagctgcgtgaccaccatggccaaggacaagcccacgctcgacatcgagctgctgaagaccgaggtcaccaaccccgcggtgctccggaagctgtgcatcgaggccaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctgatcacgtgcgccaagttcaagtgcgtgaccaagctggagggcaagatcgtccagtacgagaacctcaagtacagcgtgatcgtgaccgtccacacgggcgaccagcaccaggtggggaacgagtccaccgagcacggcaccaccgcgaccatcacgccccaggcccccaccaccgagatccagctgaccgactacggggccctgacgctcgactgcagcccccgcaccggcctggacttcaacgagatggtcctgctcaccatgaaggagaagtcctggctggtgcacaagcagtggttcctggacctccccctgccctggaccagcggggccagcacgtcccaggagacctggaaccggcaggacctgctcgtgaccttcaagaccgcccacgcgaagaagcaggaggtcgtggtgctgggcagccaggagggcgccatgcacacggccctgaccggggccaccgagatccagacctccggcacgaccaccatcttcgccgggcacctcaagtgccgcctgaagatggacaagctgaccctcaagggcatgagctacgtcatgtgcacggggtccttcaagctggagaaggaggtggcggagacccagcacggcaccgtgctggtccagatcaagtacgagggcaccgacgccccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccacggcccgcggggcccggcgcatggcgatcctgggcgacaccgcctgggacttcgggtccatcggcggcgtgttcaccagcgtcgggaagctcgtgcaccagatcttcggcaccgcctacggggtgctgttctccggcgtcagctggacgatgaagatcgggatcggcgtgctgctcacctggctgggcctgaactcccgcagcacctccctcagcatgacctgcatcgccgtggggctggtcacgctgtacctcggcgtgatggtgcaggccgactccgggtgcgtcatcaactggaagggccgggagctgaagtgcgggagcggcatcttcgtgaccaacgaggtgcacacctggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcacggtggtggtcggggacgtggcgggcatcctggcccaggggaagaagatgatccggccccagcccatggagcacaagtacagctggaagtcctggggcaaggccaagatcatcggcgccgacgtgcagaacaccaccttcatcatcgacgggcccaacaccccggagtgccccgacgaccagcgcgcgtggaacatctgggaggtcgaggactacggcttcgggatcttcacgaccaacatctggctgaagctccgggacagctacacccaggtgtgcgaccaccgcctgatgtccgccgccatcaaggacagccgggccgtgcacgccgacatgggctactggatcgagtccgagaagaacgagacctggaagctggcgcgcgccagcttcatcgaggtcaagacgtgcgtgtggcccaagtcccacaccctctggagcaacggcgtgctggagtccgagatgatcatccccaagatctacgggggcccgatcagccagcacaactaccggcccgggtacttcacccagaccgccggcccctggcacctggggaagctcgagctggacttcgacctgtgcgagggcacgaccgtcgtggtggacgagcactgcggcaaccgcgggccgtccctccggaccaccacggtcaccggcaagatcatccacgagtggtgctgccgcagctgcaccctgccgcccctgcggttccgcggggaggacggctgctggtacgggatggagatccggcccgtgaaggagaaggaggagaacctcgtgaagtccatggtcagcgccggcagcggcgaggtggactccttcagcctggggctgctctgcatctccatcatgatcgaggaggtgatgcgcagccggtggtcccgcaagatgctgatgaccggcacgctggccgtcttcttcctcctgatcatggggcagctgacctggaacgacctcatccgcctgtgcatcatggtgggcgcgaacgccagcgaccggatggggatgggcaccacctacctggccctcatggccacgttcaagatgcgcccgatgttcgccgtggggctgctgttccggcgcctcacctcccgggaggtcctgctgctcaccatcgggctgagcctggtggcgtccgtcgagctccccaacagcctggaggagctgggcgacgggctcgccatgggcatcatgatcctgaagctgctcaccgacttccagtcccaccagctgtgggccacgctgctcagcctgaccttcatcaagaccaccttctccctgcactacgcctggaagacgatggcgatggtgctcagcatcgtgtccctgttccccctgtgcctcagcaccacctcccagaagaccacgtggctgcccgtcctgctcggcagcctggggtgcaagccgctgaccatgttcctcatcgccgagaacaagatctggggccgcaagtcctggcccctgaacgaggggatcatggccgtgggcatcgtgagcatcctgctcagctccctgctgaagaacgacgtccccctcgccgggcccctgatcgccggcggcatgctgatcgcgtgctacgtgatcagcgggtccagcgccgacctctccctggagaaggccgccgaggtgagctgggaggaggaggccgagcactccggcgcgagccacaacatcctggtcgaggtgcaggacgacgggaccatgaagatcaaggacgaggagcgggacgacaccctcaccatcctgctgaaggccacgctcctggccgtgtccggcgtctacccgctgagcatccccgccaccctcttcgtgtggtacttctggcagaagaagaagcagcgctccggggtgctgtgggacacccccagcccgcccgaggtcgagcgggccgtgctggacgacggcatctaccgcatcatgcagcggggcctgctcgggcgctcccaggtgggcgtcggggtgttccaggagaacgtgttccacaccatgtggcacgtcacgcggggcgcggtgctgatgtaccaggggaagcgcctggagcccagctgggcctccgtgaagaaggacctcatcagctacggcggcgggtggcggctgcagggctcctggaacaccggggaggaggtccaggtgatcgccgtggagcccggcaagaaccccaagaacgtccagaccgcccccgggaccttcaagacgcccgagggcgaggtgggcgccatcgcgctggacttcaagcccgggaccagcggctcccccatcgtgaaccgcgaggggaagatcgtcggcctctacggcaacggggtggtgaccaccagcggcacgtacgtcagcgccatcgcccaggccaaggcgtcccaggaggggccgctgcccgagatcgaggacgaggtgttccggaagcgcaacctgaccatcatggacctccaccccggcagcgggaagacccggcgctacctgccggccatcgtgcgggaggccatcaagcgcaagctgcgcaccctcatcctggcccccacgcgggtcgtggcctccgagatggcggaggccctgaagggcatgcccatccgctaccagaccaccgccgtcaagagcgagcacaccggcaaggagatcgtcgacctcatgtgccacgccacgttcaccatgcggctgctgtcccccgtgcgcgtgccgaactacaacatgatcatcatggacgaggcccacttcaccgaccccagctccatcgcggcccgggggtacatcagcacccgcgtcggcatgggggaggccgccgccatcttcatgacggcgacgccgcccggctccgtggaggccttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctccggaagaacgggaagcgcgtgatccagctgtcccggaagacgttcgacaccgagtaccagaagaccaagaacaacgactgggactacgtcgtgaccacggacatcagcgagatgggcgcgaacttccgcgccgaccgggtgatcgacccgcgccggtgcctgaagcccgtcatcctcaaggacgggcccgagcgcgtgatcctggccggccccatgccggtcaccgtggcctccgccgcgcagcggcgcgggcgggtgggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccggctccgcggcgaggcccggaagacgttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctactccgaccccctggccctgcgggagttcaaggagttcgcggccggccgccggagcgtgtccggggacctcatcctggagatcggcaagctgccgcagcacctcacccagaaggcccagaacgccctggacaacctggtcatgctccacaacagcgagcagggcgggcgcgcgtaccggcacgccatggaggagctgcccgacacgatcgagaccctgatgctcctggccctgatcgccgtgctcaccggcggggtgaccctgttcttcctgtccggccgcgggctcggcaagaccagcatcggcctgctgtgcgtcatggcctccagcgtgctcctgtggatggcgtccgtggagccccactggatcgccgccagcatcatcctggagttcttcctcatggtcctgctgatccccgagccggaccggcagcgcacgccccaggacaaccagctcgcctacgtggtgatcgggctgctgttcatgatcctcaccgtcgccgcgaacgagatgggcctgctggagaccaccaagaaggacctcgggatcggccacgtggccgtggagaaccaccaccacgccgccatgctggacgtcgacctgcaccccgcctccgcgtggacgctctacgccgtggccaccaccatcatcaccccgatgatgcggcacacgatcgagaacaccaccgccaacatcagcctgaccgccatcgcgaaccaggccgccatcctgatggggctcgacaagggctggcccatctccaagatggacatcggcgtgcccctgctggccctcgggtgctacagccaggtcaaccccctgacgctgaccgcggccgtgctcatgctggtggcccactacgccatcatcggcccggggctgcaggccaaggcgacccgcgaggcccagaagcgcaccgccgccggcatcatgaagaaccccacggtcgacgggatcgtggccatcgacctcgaccccgtggtctacgacgcgaagttcgagaagcagctgggccagatcatgctgctcatcctgtgcacctcccagatcctgctcatgcggaccacctgggccctgtgcgagagcatcacgctggccaccggccccctcaccaccctgtgggaggggtccccgggcaagttctggaacacgaccatcgccgtgagcatggccaacatcttccgcgggtcctacctggcgggcgccggcctcgccttcagcctgatgaagtccctcgggggcgggcggcgcgggaccggggcccagggcgagaccctcggcgagaagtggaagcggcagctgaaccagctgtccaagagcgagttcaacacgtacaagcgctccgggatcatggaggtggaccggagcgaggcgaaggagggcctcaagcgcggggagaccaccaagcacgccgtctcccggggcaccgccaagctgcgctggttcgtggagcggaacctggtgaagcccgaggggaaggtcatcgacctgggctgcggccgcgggggctggagctactactgcgccgggctcaagaaggtgacggaggtgaagggctacaccaagggcgggcccggccacgaggagcccatcccgatggccacctacgggtggaacctggtcaagctgcactccggcaaggacgtgttcttcatcccgcccgagaagtgcgacaccctcctgtgcgacatcggggagagctcccccaacccgacgatcgaggagggccggaccctgcgcgtgctcaagatggtcgagccctggctgcgggggaaccagttctgcatcaaggtgctgaacccctacatgcccagcgtggtcgagaccctcgagcagatgcagcgcaagcacggcggcatgctggtgcggaacccgctgtcccgcaacagcacccacgagatgtactgggtgtcctgcgggaccggcaacatcgtcagcgcggtgaacatgacgtcccggatgctcctgaaccgcttcaccatggcccaccgcaagcccacctacgagcgggacgtggacctgggggccggcacccgccacgtcgccgtggagcccgaggtcgccaacctcgacatcatcggccagcggatcgagaacatcaagcacgagcacaagagcacgtggcactacgacgaggacaacccctacaagacctgggcgtaccacgggtcctacgaggtgaagccgagcggctccgccagcagcatggtgaacggggtcgtgaagctgctgaccaagccctgggacgtgatccccatggtcacccagatcgccatgacggacaccacccccttcggccagcagcgcgtgttcaaggagaaggtggacacccggacgccgaaggccaagcgcgggaccacccagatcatggaggtcaccgcccggtggctctggggcttcctgtcccgcaacaagaagccccggatctgcacgcgcgaggagttcacccggaaggtgcgcagcaacgcggccatcggcgccgtgttcgtcgacgagaaccagtggaactccgccaaggaggcggtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacgcggatcaccgaggacgacctccagaacgaggccaagatcaccgacatcatggagccggagcacgccctgctggcgaaggccatcttcaagctcacctaccagaacaaggtggtccgcgtgcagcgccccgccaagaacgggacggtgatggacgtcatctcccggcgcgaccagcggggcagcggccaggtgggcacctacggcctgaacaccttcaccaacatggaggcccagctgatccgccagatggagtccgaggggatcttcagcccctccgagctcgagacgcccaacctggccgagcgggtgctggactggctcgagaagtacggcgtcgagcgcctgaagcggatggcgatcagcggggacgactgcgtggtgaagccgatcgacgaccgcttcgccaccgccctgaccgccctcaacgacatgggcaaggtccggaaggacatcccccagtgggagccctccaaggggtggaacgactggcagcaggtccccttctgcagccaccacttccaccagctgatcatgaaggacggccgcgagatcgtggtcccgtgccggaaccaggacgagctggtgggccgcgcccgggtgtcccagggggcgggctggagcctccgcgagaccgcctgcctgggcaagagctacgcccagatgtggcagctgatgtacttccaccggcgcgacctccggctggccgcgaacgccatctgctccgccgtccccgtggactgggtgcccacgagccgcaccacctggtccatccacgcccaccaccagtggatgaccacggaggacatgctgagcgtctggaaccgggtgtggatcgaggagaacccctggatggaggacaagacccacatctccagctgggaggacgtgccgtacctcggcaagcgcgaggaccagtggtgcgggtccctgatcggcctgaccgcccgcgcgacctgggccaccaacatccaggtcgccatcaaccaggtgcggcgcctcatcggcaacgagaactacctggactacatgacgagcatgaagcggttcaagaacgagtccgaccccgagggggccctgtggtga

SEQ ID NO: 8904 - RNA, 9879 nt, synthetic construct
  misc_feature 1..9879: note = derived and/or modified CDS sequence (opt1) from DENV-1__KC762642__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccctcacctacaagtgcccccggatcaccgaggccgagcccgacgacgtggactgctggtgcaacgccaccgacacctgggtcacctacgggacctgcagccagaccggcgagcaccggcgggacaagcggtccgtggccctggcgccccacgtgggcctggggctcgagacgcggaccgagacctggatgagctccgagggcgcctggaagcagatccagcgggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcggtgcgtcggcatcggcagccgcgacttcgtggaggggctgtccggcgccacgtgggtggacgtcgtgctggagcacgggagctgcgtgaccaccatggccaaggacaagcccaccctcgacatcgagctgctgaagacggaggtcaccaaccccgcggtgctccggaagctgtgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctgatcacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcaccacgcaggagacctggaaccggcaggacctgctcgtgaccttcaagaccgcccacgcgaagaagcaggaggtcgtggtgctgggctcccaggagggcgccatgcacacggccctgaccggggccaccgagatccagaccagcggcacgaccaccatcttcgccgggcacctcaagtgccgcctgaagatggacaagctgaccctcaagggcatgtcctacgtcatgtgcacggggagcttcaagctggagaaggaggtggcggagacccagcacggcaccgtgctggtccagatcaagtacgagggcaccgacgccccctgcaagatccccttctccacgcaggacgagaagggggtgacccagaacggccggctgatcaccgccaacccgatcgtgaccgacaaggagaagcccgtcaacatcgaggccgagccgcccttcggggagagctacatcgtgatcggcgcgggcgagaaggccctcaagctgtcctggttcaagaaggggagctccatcggcaagatgttcgaggccacggcccgcggggcccggcgcatggcgatcctgggcgacaccgcctgggacttcgggagcatcggcggcgtgttcacctccgtcgggaagctcgtgcaccagatcttcggcaccgcctacggggtgctgttcagcggcgtctcctggacgatgaagatcgggatcggcgtgctgctcacctggctgggcctgaacagccgctccaccagcctctccatgacctgcatcgccgtggggctggtcacgctgtacctcggcgtgatggtgcaggccgacagcgggtgcgtcatcaactggaagggccgggagctgaagtgcgggtccggcatcttcgtgaccaacgaggtgcacacctggaccgagcagtacaagttccaggcggacagcccgaagcgcctgagcgccgccatcggcaaggcctgggaggagggggtctgcggcatccggtccgccacccgcctcgagaacatcatgtggaagcagatcagcaacgagctgaaccacatcctgctcgagaacgacatgaagttcacggtggtggtcggggacgtggcgggcatcctggcccaggggaagaagatgatccggccccagcccatggagcacaagtactcctggaagtcctggggcaaggccaagatcatcggcgccgacgtgcagaacaccaccttcatcatcgacgggcccaacaccccggagtgccccgacgaccagcgcgcgtggaacatctgggaggtcgaggactacggcttcgggatcttcacgaccaacatctggctgaagctccgggactcctacacccaggtgtgcgaccaccgcctgatgagcgccgccatcaaggactccaaggccgtgcacgccgacatgggctactggatcgagagcgagaagaacgagacctggaagctggcgcgggcctccttcatcgaggtcaagacgtgcatctggcccaagagccacaccctctggtccaacggcgtgctggagagcgagatgatcatccccaagatctacgggggcccgatctcccagcacaactaccgccccgggtacttcacccagaccgccggcccctggcacctggggaagctcgagctggacttcgacctgtgcgagggcacgaccgtggtcgtggacgagcactgcggcaaccgggggccgagcctccgcaccaccacggtgaccggcaagatcatccacgagtggtgctgccggtcctgcaccctgccgcccctgcgcttccgcggggaggacggctgctggtacgggatggagatccgccccgtcaaggagaaggaggagaacctcgtcaagagcatggtgtccgccggcagcggcgaggtcgacagcttctccctggggctgctctgcatcagcatcatgatcgaggaggtgatgcggtcccgctggagccggaagatgctgatcaccggcacgctggccgtgttcttcctcctgatcatggggcaggtcacctggaacgacctgacccgcctctgcatcatggtgggcgcgaacgcctccgaccgcatggggatgggcaccacgtacctggccctgatggccaccttcaagatgcggccgatgttcgccgtgggcctcctgttccgccggctgaccagccgcgaggtcctcctgctgaccatcgggctctccctggtggcgagcgtcgagctgcccaactccctcgaggagctgggcgacgggctggccatgggcatcatgatcctcaagctgctgacggacttccagagccaccagctctgggccaccctgctgtccctcaccttcatcaagaccacgttcagcctgcactacgcctggaagaccatggcgatggtgctgtccatcgtgagcctcttccccctgtgcctgtccaccaccagccagaagacgacctggctccccgtcctgctgggctccctcgggtgcaagccgctgaccatgttcctgatcgccgagaacaagatctggggccgcaagagctggcccctcaacgaggggatcatggccgtgggcatcgtgtccatcctgctgagcagcctcctgaagaacgacgtccccctggccgggcccctcatcgccggcggcatgctgatcgcgtgctacgtgatctccgggagctccgccgacctgagcctcgagaaggccgccgaggtgtcctgggaggaggaggccgagcacagcggcgcgtcccacaacatcctggtcgaggtgcaggacgacgggaccatgaagatcaaggacgaggagcgcgacgacaccctgacgatcctcctgaaggccaccctgctcgccgtgagcggcgtctacccgctgtccatccccgccaccctgttcgtgtggtacttctggcagaagaagaagcagcggagcggggtgctctgggacacccccagcccgcccgaggtcgagcgcgccgtgctggacgacggcatctaccggatcatgcagcgcggcctgctggggcggagccaggtgggcgtcggggtgttccaggagaacgtgttccacacgatgtggcacgtcacccgcggcgcggtgctcatgtaccaggggaagcggctggagccctcctgggccagcgtgaagaaggacctgatctcctacggcggcgggtggcgcctccagggcagctggaacaccggggaggaggtccaggtgatcgccgtggagcccggcaagaaccccaagaacgtccagaccgcccccgggacgttcaagacccccgagggcgaggtgggcgccatcgcgctggacttcaagcccgggacctccggcagccccatcgtgaaccgggaggggaagatcgtcggcctgtacggcaacggggtggtgaccacgtccggcacctacgtcagcgccatcgcccaggccaaggcgagccaggaggggccgctccccgagatcgaggacgaggtgttccgcaagcggaacctgaccatcatggacctgcaccccggctccgggaagacccgccggtacctcccggccatcgtgcgcgaggccatcaagcggaagctgcgcacgctgatcctcgcccccacccgcgtcgtggccagcgagatggcggaggccctgaagggcatgcccatccggtaccagaccaccgccgtgaagtccgagcacacgggccgcgagatcgtcgacctgatgtgccacgccaccttcaccatgcggctcctgagccccgtgcgcgtgccgaactacaacatgatcatcatggacgaggcccacttcaccgacccctccagcatcgcggcccgggggtacatctccacgcgcgtcggcatgggggaggccgccgccatcttcatgaccgcgacgccgcccggcagcgtggaggccttcccgcagtccaacgccgtgatccaggacgaggagcgggacatccccgagcgcagctggaactccgggtacgagtggatcaccgacttccccggcaagacggtctggttcgtgcccagcatcaagtccggcaacgacatcgccaactgcctgcggaagaacgggaagcgcgtgatccagctcagccggaagaccttcgacaccgagtaccagaagaccaagaacaacgactgggactacgtcgtgacgaccgacatctccgagatgggcgcgaacttccgcgccgaccgggtgatcgacccgcgccggtgcctgaagcccgtcatcctgaaggacgggcccgagcgcgtgatcctcgccggccccatgccggtcaccgtggccagcgccgcgcagcggcgcgggcggatcggccgcaaccacaacaaggagggcgaccagtacatctacatggggcagcccctgaacaacgacgaggaccacgcccactggaccgaggccaagatgctgctcgacaacatcaacacgcccgagggcatcatccccgccctgttcgagccggagcgcgagaagtccgccgcgatcgacggggagtaccggctgcgcggcgaggcccggaagaccttcgtggagctcatgcgccgcggggacctgcccgtctggctgagctacaaggtggcctccgagggcttccagtacagcgaccgccggtggtgcttcgacggcgagcgcaacaaccaggtgctcgaggagaacatggacgtcgagatctggaccaaggagggggagcggaagaagctgcgcccccggtggctggacgcccgcacctacagcgaccccctcgccctgcgggagttcaaggagttcgcggccggccgccggtccgtgagcggggacctgatcctcgagatcggcaagctgccgcagcacctgacgcagcgcgcccagaacgccctcgacaacctggtgatgctgcacaactccgagcagggcgggcgggcgtaccgccacgccatggaggagctccccgacaccatcgagaccctgatgctgctcgccctgatcgccgtcctgaccggcggggtgaccctcttcttcctgagcggccgggggctgggcaagacgtccatcggcctcctgtgcgtgatggccagctccgtcctgctctggatggcgagcgtggagccccactggatcgccgcctccatcatcctggagttcttcctgatggtgctcctgatccccgagccggaccgccagcggacgccccaggacaaccagctggcctacgtcgtgatcgggctcctgttcatgatcctgaccgtggccgcgaacgagatgggcctcctggagaccacgaagaaggacctggggatcggccacgtcgccgtggagaaccaccaccacgccgccatgctcgacgtggacctgcaccccgccagcgcgtggaccctgtacgccgtcgccaccaccatcatcacgccgatgatgcgccacaccatcgagaacaccaccgccaacatctccctcacggccatcgcgaaccaggccgccatcctgatggggctggacaagggctggcccatcagcaagatggacatcggcgtgcccctcctggccctggggtgctactcccaggtgaaccccctcaccctgaccgcggccgtcctgatgctcgtggcccactacgccatcatcggcccggggctgcaggccaaggcgacccgcgaggcccagaagcggacggccgccggcatcatgaagaaccccaccgtggacgggatcgtcgccatcgacctggaccccgtggtgtacgacgcgaagttcgagaagcagctcggccagatcatgctgctgatcctctgcaccagccagatcctgctgatgcgcaccacgtgggccctctgcgagtccatcaccctggccaccggccccctgaccacgctctgggaggggagcccgggcaagttctggaacaccaccatcgccgtctccatggccaacatcttccgggggagctacctggcgggcgccggcctggccttctccctcatgaagtccctcgggggcgggcgccgggggaccggggcccagggcgagacgctgggcgagaagtggaagcgccagctcaaccagctgagcaagtccgagttcaacacctacaagcggagcgggatcatggaggtggaccgctccgaggcgaaggagggcctgaagcgcggggagaccaccaagcacgccgtgagccgcggcacggccaagctccggtggttcgtcgagcgcaacctggtgaagcccgaggggaaggtgatcgacctgggctgcggccgcggcgggtggtcctactactgcgccgggctgaagaaggtcaccgaggtgaaggggtacaccaagggcggccccggccacgaggagcccatcccgatggccacctacgggtggaacctcgtgaagctgcacagcggcaaggacgtcttcttcatcccgcccgagaagtgcgacacgctgctctgcgacatcggggagtccagccccaacccgaccatcgaggagggccgcaccctgcgggtgctgaagatggtggagccctggctccgcgggaaccagttctgcatcaagatcctgaacccctacatgccctccgtcgtggagaccctggagcagatgcagcggaagcacggcggcatgctcgtgcgcaacccgctgagccggaactccacccacgagatgtactgggtcagctgcgggacgggcaacatcgtgtccgcggtgaacatgaccagccgcatgctgctcaaccgcttcaccatggcccaccggaagcccacctacgagcgcgacgtcgacctgggggccggcacgcggcacgtggccgtggagcccgaggtcgccaacctggacatcatcggccagcgcatcgagaacatcaagtacgagcacaagtccacctggcactacgacgaggacaacccctacaagacctgggcgtaccacgggagctacgaggtgaagccgtccggcagcgcctccagcatggtcaacggggtggtgaagctcctgaccaagccctgggacgtcatccccatggtgacgcagatcgccatgaccgacaccacccccttcggccagcagcgggtgttcaaggagaaggtcgacacgcgcaccccgaaggccaagcgggggaccgcccagatcatggaggtgaccgcgcgctggctgtggggcttcctcagccggaacaagaagccccgcatctgcacgcgggaggagttcacccgcaaggtgcggtccaacgccgccatcggcgccgtcttcgtggacgagaaccagtggaacagcgcgaaggaggccgtggaggacgagcgcttctgggacctggtccaccgggagcgcgagctgcacaagcaggggaagtgcgcgacctgcgtgtacaacatgatgggcaagcgggagaagaagctcggggagttcggcaaggccaaggggtcccgcgccatctggtacatgtggctgggcgcgcggttcctggagttcgaggccctcggcttcatgaacgaggaccactggttcagccgcgagaactccctgagcggggtggagggcgaggggctgcacaagctcggctacatcctgcgggacatctccaagatccccgggggcaacatgtacgccgacgacaccgccggctgggacacgcgcatcaccgaggacgacctgcagaacgaggccaagatcaccgacatcatggagccggagcacgcgctcctggccaaggccgtcttcaagctgacctaccagaacaaggtggtgcgcgtccagcggcccgccaagaacgggacggtgatggacgtgatcagccgccgggaccagcgcggctccgggcaggtcggcacctacggcctcaacaccttcaccaacatggaggcccagctgatccggcagatggagagcgaggggatcttctcccccagcgagctggagacgcccaacctcgcggagcgcgtgctgtactggctggagaagtacggcgtggagcggctcaagcgcatggccatctccggggacgactgcgtcgtgaagccgatcgacgaccggttcgccaccgccctgaccgccctgaacgacatgggcaaggtgcgcaaggacatcccccagtgggagcccagcaaggggtggaacgactggcagcaggtccccttctgctcccaccacttccaccagctcatcatgaaggacggccgggagatcgtggtgccgtgccgcaaccaggacgagctggtcggccgggcgcgcgtgagccagggggccggctggtccctgcgggagaccgcctgcctcggcaagagctacgcccagatgtggcagctgatgtacttccaccgccgggacctgcgcctcgcggccaacgccatctgcagcgccgtgcccgtcgactgggtgcccacgtcccggaccacctggagcatccacgcccaccaccagtggatgaccacggaggacatgctgtccgtgtggaaccgcgtctggatcgaggagaacccctggatggaggacaagacccacatcagctcctgggaggacgtgccgtacctgggcaagcgcgaggaccagtggtgcgggagcctcatcggcctgaccgcgcgggccacctgggccaccaacatccaggtggccatcaaccaggtccgccggctgatcggcaacgagaactacctcgactacatgacgtccatgaagcgcttcaagaacgagagcgaccccgagggggccctgtggtga

SEQ ID NO: 8905 - RNA, 9879 nt, synthetic construct
  misc_feature 1..9879: note = derived and/or modified CDS sequence (opt1) from DENV-1__JQ915077__SS-prME
  source 1..9879: mol_type = other RNA
agcgtgaccatgctgctcatgctgctgcccaccgtgctcaccttccacctgaccacccgcggcggggagccccacatgatcgtgagcaagcaggagcggggcaagagcctcctgttcaagacctccgccggggtgaacatgtgcaccctgatcgccatggacctgggcgagctctgcgacgacaccatgacctacaagtgcccccgcatcaccgagaccgagcccgacgacgtggactgctggtgcaacgcgaccgagacctgggtgacctacgggacgtgcagccagaccggcgagcaccggcgcgacaagcggtccgtggccctggcgccccacgtcggcctggggctcgagacccgcaccgagacgtggatgagctccgagggcgcctggcggcagatccagaaggtggagacctgggccctgcgccaccccgggttcaccgtgatcgcgctgttcctcgcccacgccatcggcaccagcatcacgcagaaggggatcatcttcatcctgctgatgctcgtcaccccctccatggccatgcggtgcgtgggcatcggcaaccgcgacttcgtggaggggctgagcggcgcgacctgggtcgacgtggtgctggagcacgggtcctgcgtcaccacgatggccaaggacaagcccaccctcgacatcgagctgctgaagaccgaggtgaccaaccccgccgtgctccggaagctgtgcatcgaggccaagatcagcaacacgaccaccgactcccgctgcccgacccagggcgaggccacgctggtcgaggagcaggacaccaacttcgtgtgccggcgcaccttcgtggaccggggctgggggaacggctgcggcctcttcggcaaggggagcctgatcacgtgcgcgaagttcaagtgcgtcacgaagctggagggcaagatcgtgcagtacgagaacctcaagtactccgtgatcgtcaccgtgcacaccggcgaccagcaccaggtcgggaacgagaccaccgagcacggcacgatcgccaccatcacgccccaggcccccaccagcgagatccagctgacggactacggggccctgaccctcgactgcagcccccggaccggcctggacttcaacgagatggtgctgctcaccatgaaggagaagtcctggctggtgcacaagcagtggttcctggacctcccgctgccctggacgtccggggccagcaccagccaggagacctggaaccggcaggacctgctcgtcaccttcaagacggcgcacgccaagaagcaggaggtggtggtcctgggctcccaggagggcgccatgcacaccgccctgaccggggccaccgagatccagacgagcggcaccaccaccatcttcgcggggcacctcaagtgccgcctgaagatggacaagctgacgctcaagggcatctcctacgtgatgtgcaccgggagcttcaagctggagaaggaggtggccgagacccagcacggcaccgtcctggtccaggtgaagtacgagggcacggacgccccctgcaagatccccttctccagccaggacgagaagggggtcacccagaacggccggctggtgaccgccaacccgatcgtgaccgacaaggagaagcccgtcaacatcgaggccgagccgcccttcggggagtcctacatcgtggtgggcgcgggcgagaaggccctcaagctgagctggttcaagaaggggtccagcatcggcaagatgttcgaggccacggcccgcggggcgcggcgcatggccatcctgggcgacaccgcctgggacttcgggtccatcggcggcgtcttcaccagcgtggggaagctcgtgcaccagatcttcggcaccgcctacggggtcctgttctccggcgtgagctggacgatgaagatcgggatcggcatcctgctcacctggctgggcctgaactcccgcagcacctccctcagcatgacctgcatcgccgtggggatggtcacgctgtacctgggcgtgatggtgcaggcggactccgggtgcgtcatcaactggaagggccgggagctcaagtgcgggagcggcatcttcgtgaccaacgaggtgcacacctggaccgagcagtacaagttccaggccgacagcccgaagcgcctgtccgccgccatcggcaaggcctgggaggagggggtctgcggcatccggagcgcgacccgcctggagaacatcatgtggaagcagatctccaacgagctcaaccacatcctgctggagaacgacatgaagttcacggtggtggtcggggacgtgagcggcatcctcgcccaggggaagaagaccatccggccccagcccatggagcacaagtactcctggaagtcctggggcaaggccaagatcatcggcgccgacgtgcagaacaccaccttcatcatcgacgggcccaacacgccggagtgccccgacgaccagcgcgcctggaacatctgggaggtcgaggactacggcttcgggatcttcaccaccaacatctggctgaagctgcgggactcctacacccaggtgtgcgaccaccgcctcatgagcgcggccatcaaggactccaaggccgtgcacgccgacatgggctactggatcgagagcgagaagaacgagacgtggaagctggcgcgggcctccttcatcgaggtcaagacctgcgtgtggcccaagagccacaccctgtggtccaacggcgtgctcgagagcgagatgatcatccccaagatctacgggggcccgatctcccagcacaactaccgccccgggtacttcacccagacggccggcccctggcacctggggaagctggagctcgacttcgacctgtgcgagggcaccaccgtcgtggtggacgagcactgcggcaaccgggggccgagcctgcgcaccacgaccgtcaccggcaagatcatccacgagtggtgctgccggtcctgcaccctgccgcccctgcgcttcaagggggaggacggctgctggtacgggatggagatccggcccgtgaaggagaaggaggagaacctggtcaagagcatggtcagcgccggctccggcgaggtggacagcttctccctcgggctgctgtgcatcagcatcatgatcgaggaggtgatgcgctcccggtggagccgcaagatgctcatgacgggcaccctggtcgtgttcctgctcctgaccctggggcagctcacctggaacgacctgatccggctgtgcatcatggtcggcgccaacgcgtccgacaacatggggatgggcacgacctacctcgccctgatggccaccttccgcatgcgcccgatgttcgccgtggggctcctcttccggcgcctgaccagccgggaggtgctgctcctgacggtcgggctgtccctcgtggccagcgtggagctgcccaactccctggacgagctcggcgacgggctggccatgggcatcatgatcctgaagctcctgaccgacttccagagccaccagctgtgggccatcctcctgtccctgaccttcgtcaagaccacgctcagcctgcactacgcctggaagaccatggccatgatcctgtccatcgtgagcctcctgcccctgtgcctctccaccaccagccagaagacgacctggctgcccgtgctgctcggctccctggggtgcaagccgctgaccatgttcctcatcaccgagaacaagatctggggccgcaagagctggcccctgaacgaggggatcatggccgtcggcatcgtgagcatcctgctctccagcctgctgaagaacgacgtgcccctcgcggggcccctgatcgccggcggcatgctgatcgcctgctacgtcatctccgggagctccgccgacctcagcctggagaaggcggccaaggtgtcctgggaggaggaggccgagcacagcggcgcctcccacaacatcctggtggagatccaggacgacgggaccatgaagatcaaggacgaggagcgggacgacacgatcaccatcctcctgaaggccaccctgctcgcgatcagcggcgtctacccgatgtccatccccgccaccctgttcgtgtggcacttctggcagaagaagaagcagcgcagcggggtgctgtgggacacgcccagcccgcccgaggtcgagaaggccgtgctggacgacggcatctaccggatcctccagcgcggcctgctggggcggagccaggtgggcgtcggggtgttccaggagggcgtgttccacaccatgtggcacgtcacccgcggggccgtgctcatgtaccagggcaagcggctggagccctcctgggccagcgtgaagaaggacctgatctcctacggcgggggctggcgcttccaggggagctggaacaccggcgaggaggtccaggtgatcgcggtggagcccgggaagaaccccaagaacgtccagacggcccccggcaccttcaagacctccgagggcgaggtgggggccatcgccctcgacttcaagcccggcaccagcgggagccccatcgtgaaccgggagggcaagatcgtcggcctgtacgggaacggcgtggtgacgacctccgggacctacgtcagcgccatcgcgcaggccaaggcctcccaggagggccccctgccggagatcgaggacgaggtgttccgcaagcggaacctcaccatcatggacctgcaccccgggagcggcaagacgcgccggtacctgcccgccatcgtgcgcgaggccatcaagcggaagctccgcaccctggtcctggcgccgacccgggtggtggcctccgagatggccgaggccctcaagggcatgcccatccgctaccagaccacggcggtcaagagcgagcacaccgggaaggagatcgtggacctgatgtgccacgccaccttcaccatgcgcctgctctcccccgtgcgggtccccaactacaacatgatcatcatggacgaggcccacttcacggacccggccagcatcgccgcgcgcggctacatctccacccgggtggggatgggcgaggccgccgccatcttcatgaccgccacgccgcccgggagcgtggaggcgttcccccagtccaacgccgtcatccaggacgaggagaaggacatcccggagcgcagctggaactccggctacgactggatcacggacttccccggcaagaccgtgtggttcgtgcccagcatcaagtccgggaacgacatcgccaactgcctgcggaagaacggcaagcgcgtcatccagctgagccggaagaccttcgacaccgagtaccagaagacgaagaacaacgactgggactacgtggtcaccaccgacatctccgagatgggggccaacttccgcgccgaccgggtgatcgacccccgccggtgcctcaagccggtgatcctgaaggacggccccgagcgcgtcatcctggcggggcccatgcccgtgaccgtggccagcgccgcccagcggcgcggccggatcggccgcaaccagaacaaggagggggaccagtacatctacatgggccagccgctcaacaacgacgaggaccacgcgcactggacggaggccaagatgctgctggacaacatcaacacccccgaggggatcatccccgccctcttcgagcccgagcgggagaagtccgccgccatcgacggcgagtaccgcctgcgcggggaggcgcgcaagaccttcgtcgagctgatgcgccggggcgacctcccggtgtggctgagctacaaggtggccagcgagggcttccagtactccgaccgccggtggtgcttcgacggggagcgcaacaaccaggtcctggaggagaacatggacgtggagatctggaccaaggagggcgagcggaagaagctccgcccccggtggctggacgcccgcacgtacagcgaccccctggccctccgggagttcaaggagttcgccgcggggcgccggtccgtgagcggcgacctgatcctggagatcggcaagctcccccagcacctgacccagcgcgcccagaacgccctggacaacctcgtcatgctgcacaactccgagcagggcgggaaggcctaccggcacgccatggaggagctgccggacaccatcgagaccatcatgctcctggcgctgatcgccgtgctcaccgggggcgtgacgctgttcttcctgagcgggcgcggcctcggcaagacctccatcgggctgctgtgcgtcaccagctccagcgtgctcctgtggatggcctccgtggagccccactggatcgccgcgagcatcatcctggagttcttcctcatggtcctgctgatccccgagcccgaccggcagcgcaccccgcaggacaaccagctcgcctacgtggtgatcggcctgctgttcatgatcctcacggtcgccgccaacgagatggggctgctggagaccaccaagaaggacctcggcatcgggcacgccgcggccgagaaccaccaccacgccgccatgctggacgtggacctgcaccccgcctccgcgtggaccctctacgccgtggccacgaccatcatcacccccatgatgcggcacaccatcgagaacacgaccgccaacatcagcctgaccgccatcgcgaaccaggccgccatcctgatgggcctcgacaagggctggccgatctccaagatggacatcggggtccccctgctggccctcggctgctacagccaggtgaaccccctgaccctgacggccgcggtgctcatgctggtcgcccactacgccatcatcgggcccggcctgcaggccaaggcgacccgcgaggcccagaagcggaccgccgccgggatcatgaagaacccgaccgtggacggcatcgtggccatcgacctcgaccccgtcgtgtacgacgcgaagttcgagaagcagctgggccagatcatgctgctcatcctgtgcacgtcccagatcctgctcatgcgcaccacctgggccctgtgcgagagcatcaccctggccacggggcccctcaccaccctgtgggagggctcccccgggaagttctggaacaccacgatcgccgtgagcatggccaacatcttccggggcagctacctggcgggcgccgggctcgccttctccctgatgaagtccctgggcgggggccgccgcgggaccggcgcccagggcgagaccctcggggagaagtggaagcggcagctgaaccagctgtccaagagcgagttcaacacctacaagcgctccggcatcatcgaggtcgaccggagcgaggccaaggaggggctcaagcgcggcgagacgaccaagcacgcggtgtcccgggggaccgccaagctgcgctggttcgtggagcggaacctggtcaagccggagggcaaggtgatcgacctgggctgcgggcgcggcgggtggagctactactgcgccggcctcaagaaggtgaccgaggtcaaggggtacacgaagggcggccccgggcacgaggagcccatccccatggccacctacggctggaacctggtgaagctgcactccgggaaggacgtgttcttcatcccgcccgagaagtgcgacaccctcctgtgcgacatcggcgagagctcccccaaccccaccatcgaggaggggcggaccctgcgcgtcctcaagatggtggagccgtggctgcggggcaaccagttctgcatcaagatcctgaacccctacatgcccagcgtggtcgagacgctcgagcagatgcagcgcaagcacggcgggatgctggtgcggaaccccctgtcccgcaacagcacccacgagatgtactgggtgtcctgcggcaccgggaacatcgtcagcgcggtgaacatgacctcccggatgctcctgaaccgcttcacgatggcccaccggaagccgacctacgagcgcgacgtggacctgggcgccggcacccggcacgtcgccgtggagcccgaggtcgccaacctcgacatcatcgggcagcgcatcgagaacatcaagaacgagcacaagagcacctggcactacgacgaggacaacccctacaagacgtgggcgtaccacggctcctacgaggtgaagcccagcgggagcgcctccagcatggtgaacggcgtcgtgcgcctgctgaccaagccgtgggacgtgatccccatggtcacccagatcgccatgaccgacacgacccccttcgggcagcagcgggtgttcaaggagaaggtggacacccgcacccccaaggccaagcggggcacggcccagatcatggaggtcaccgcgaagtggctctggggcttcctgtcccgcaacaagaagccgcggatctgcacccgcgaggagttcacccggaaggtgcgcagcaacgccgccatcggggccgtgttcgtcgacgagaaccagtggaactccgccaaggaggcggtggaggacgagcggttctgggacctggtgcgccgggagcgcgagctccacaagcagggcaagtgcgccacgtgcgtctacaacatgatggggaagcgggagaagaagctgggcgagttcgggaaggccaagggcagccgcgccatctggtacatgtggctgggcgcgcggttcctcgagttcgaggccctggggttcatgaacgaggaccactggttctcccgcgagaacagcctgtccggcgtggagggggagggcctccacaagctggggtacatcctgcgggacatcagcaagatccccggcggcaacatgtacgccgacgacaccgccgggtgggacacccgcatcaccgaggacgacctccagaacgaggccaagatcacggacatcatggagcccgagcacgcgctgctggccacctccatcttcaagctcacctaccagaacaaggtggtccgggtgcagcgcccggccaagaacggcaccgtgatggacgtcatcagccggcgcgaccagcgcgggtccggccaggtgggcacgtacgggctgaacaccttcaccaacatggaggcccagctgatccggcagatggagagcgagggcatcttctcccccagcgagctcgagacccccaacctggccgggcgcgtgctggactggctcgagaagcacggcacggagcggctgcgccggatggcgatctccggggacgactgcgtcgtgaagcccatcgacgaccgcttcgccaccgccctgaccgccctcaacgacatgggcaaggtgcggaaggacatcccgcagtgggagcccagcaagggctggaacgactggcagcaggtccccttctgcagccaccacttccaccagctgatcatgaaggacgggcgcgagatcgtggtgccctgccggaaccaggacgagctggtcggccgcgcccgggtgtcccagggggcgggctggagcctccgcgagaccgcctgcctggggaagtcctacgcccagatgtggcagctgatgtacttccaccggcgcgacctccggctggccgccaacgcgatctgcagcgccgtgccggtcgactgggtgcccacgtcccgcaccacctggagcatccacgcccaccaccagtggatgaccaccgaggacatgctgtccgtgtggaaccgggtctggatcgaggagaacccctggatggaggacaagacgcacgtgagctcctgggaggacgtgccctacctcggcaagcgcgaggaccagtggtgcggcagcctgatcgggctgaccgcccgggcgacctgggccaccaacatccaggtcgccatcaaccaggtgcgccgcctcatcggcaacgagaactacctggactacatgacgtccatgaagcggttcaagaacgagagcgacccggagggggccctgtggtga

SEQ ID NO: 8906 - RNA, 9879 nt, synthetic construct
  misc_feature 1..9879: note = derived and/or modified CDS sequence (opt1) from DENV-1__JQ915079__SS-prME
  source 1..9879: mol_type = other RNA
agcgtgaccatgctgctcatgctgctgcccaccgtgctcaccttccacctgaccacccggggcggggagccccacatgatcgtgagcaagcaggagcggggcaagagcctcctgttcaagacctccgccggggtgaacatgtgcacgctgatcgccatggacctgggcgagctctgcgacgacaccatgacctacaagtgcccccgcatcaccgagacggagcccgacgacgtggactgctggtgcaacgcgaccgagacctgggtgacctacgggacgtgcagccagaccggcgagcaccggcgcgacaagcggtccgtggccctggcgccccacgtcggcctggggctcgagacccgcaccgagacgtggatgagctccgagggcgcctggcggcagatccagaaggtggagacctgggccctgcgccaccccgggttcaccgtgatcgcgctgttcctcgcccacgccatcggcaccagcatcacgcagaaggggatcatcttcatcctgctgatgctcgtcaccccctccatggccatgcggtgcgtgggcatcggcaaccgcgacttcgtggaggggctgagcggcgcgacctgggtcgacgtggtgctggagcacgggtcctgcgtcaccacgatggccaaggacaagcccaccctcgacatcgagctgctgaagaccgaggtgaccaaccccgccgtgctccggaagctgtgcatcgaggccaagatcagcaacacgaccaccgactcccgctgcccgacccagggcgaggccacgctggtcgaggagcaggacaccaacttcgtgtgccggcgcaccttcgtggaccggggctgggggaacggctgcggcctcttcggcaaggggagcctgatcacgtgcgcgaagttcaagtgcgtcacgaagctggagggcaagatcgtgcagtacgagaacctcaagtactccgtgatcgtcaccgtgcacaccggcgaccagcaccaggtcgggaacgagaccaccgagcacggcacgatcgccaccatcacgccccaggcccccaccagcgagatccagctgacggactacggggccctgaccctcgactgcagcccccggaccggcctggacttcaacgagatggtgctgctcaccatgaaggagaagtcctggctggtgcacaagcagtggttcctggacctcccgctgccctggacgaccggggcctccaccagccaggagacctggaaccggcaggacctgctcgtcacgttcaagaccgcgcacgccaagaagcaggaggtggtggtcctgggcagccaggagggcgccatgcacaccgccctgaccggggccacggagatccagacctccggcaccaccacgatcttcgcggggcacctcaagtgccgcctgaagatggacaagctgaccctcaagggcatcagctacgtgatgtgcaccgggtccttcaagctggagaaggaggtggccgagacccagcacggcacggtcctggtccaggtgaagtacgagggcaccgacgccccctgcaagatccccttcagctcccaggacgagaagggggtcacccagaacggccggctggtgaccgccaacccgatcgtgacggacaaggagcgccccgtcaacatcgaggccgagccgcccttcggggagagctacatcgtggtgggcgcgggcgagaaggccctcaagctgtcctggttcaagaaggggagctccatcggcaagatgttcgaggccaccgcccgcggggcccgccgcatggccatcctgggcgacaccgcctgggacttcgggagcatcggcggcgtcttcacctccgtggggaagctcgtgcaccagatcttcggcacggcctacggggtcctgttcagcggcgtgtcctggaccatgaagatcgggatcggcatcctgctcacctggctgggcctgaacagccggtccaccagcctctccatgacgtgcatcgccgtggggatggtcaccctgtacctgggcgtgatggtgcaggcggacagcgggtgcgtcatcaactggaagggccgcgagctcaagtgcgggtccggcatcttcgtgaccaacgaggtgcacacctggaccgagcagtacaagttccaggccgacagcccgaagcggctgagcgccgccatcggcaaggcctgggaggagggggtctgcggcatccgctccgcgacgcggctggagaacatcatgtggaagcagatcagcaacgagctcaaccacatcctgctggagaacgacatgaagttcaccgtggtggtcggggacgtgtccggcatcctcgcccaggggaagaagaccatccgcccccagcccatggagcacaagtacagctggaagtcctggggcaaggccaagatcatcggcgccgacgtgcagaacaccacgttcatcatcgacgggcccaacaccccggagtgccccgacgaccagcgggcctggaacatctgggaggtcgaggactacggcttcgggatcttcaccaccaacatctggctgaagctgcgcgacagctacacccaggtgtgcgaccaccggctcatgtccgcggccatcaaggacagcaaggccgtgcacgccgacatgggctactggatcgagtccgagaagaacgagacctggaagctggcgcgcgccagcttcatcgaggtcaagacctgcgtgtggcccaagtcccacaccctgtggagcaacggcgtgctcgagtccgagatggtcatccccaagatctacgggggcccgatcagccagcacaactaccggcccgggtacttcacgcagaccgccggcccctggcacctggggaagctggagctcgacttcgacctgtgcgagggcaccaccgtggtggtcgacgagcactgcggcaaccgcgggccgtccctgcggacgaccaccgtgaccggcaagatcatccacgagtggtgctgccgcagctgcacgctgccgcccctgcggttcaagggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcaccctggtggtcttcctgctcctgaccctggggcagctcacgtggaacgacctgatccgcctgtgcatcatggtgggcgccaacgcgagcgacaacatggggatgggcacgacctacctcgccctgatggccaccttccgcatgcggccgatgttcgccgtggggctcctcttccgccggctgacgtcccgcgaggtcctgctcctgaccgtggggctgagcctcgtggcctccgtcgagctgcccaacagcctggacgagctcggcgacgggctggccatgggcatcatgatcctgaagctcctgaccgacttccagtcccaccagctgtgggccaccctcctgagcctgacgttcgtgaagaccaccctctccctgcactacgcctggaagaccatggccatgatcctgagcatcgtgtccctcctgcccctgtgcctcagcacgacctcccagaagaccacctggctgcccgtcctgctcggcagcctggggtgcaagccgctgaccatgttcctcatcacggagaacaagatctggggccggaagtcctggcccctgaacgaggggatcatggccgtgggcatcgtgagcatcctgctcagctccctgctgaagaacgacgtccccctcgcggggcccctgatcgccggcggcatgctgatcgcctgctacgtgatcagcgggtccagcgccgacctctccctggagaaggcggccaaggtgagctgggaggaggaggccgagcactccggcgccagccacaacatcctggtcgagatccaggacgacgggaccatgaagatcaaggacgaggagcgcgacgacaccatcaccatcctcctgaaggccacgctgctcgcgatctccggcgtgtacccgatgagcatccccgccaccctgttcgtgtggcacttctggcagaagaagaagcagcggtccggggtcctgtgggacacccccagcccgcccgaggtggagaaggccgtgctggacgacggcatctaccgcatcctccagcggggcctgctggggcgctcccaggtcggcgtgggggtgttccaggagggcgtcttccacaccatgtggcacgtgacgcgcggggccgtgctcatgtaccagggcaagcgcctggagcccagctgggcctccgtcaagaaggacctgatcagctacggcgggggctggcggttccaggggtcctggaacatgggcgaggaggtccaggtgatcgcggtcgagcccgggaagaaccccaagaacgtgcagaccgcccccggcaccttcaagaccagcgagggcgaggtgggggccatcgccctcgacttcaagcccggcacgtccgggagccccatcgtcaaccgcgagggcaagatcgtgggcctgtacgggaacggcgtggtcaccaccagcgggacctacgtgtccgccatcgcgcaggccaaggccagccaggagggccccctgccggagatcgaggacgaggtgttccggaagcgcaacctcacgatcatggacctgcaccccgggtccggcaagacccggcgctacctgcccgccatcgtccgggaggccatcaagcgcaagctccggaccctggtgctggcgccgacccgcgtggtcgccagcgagatggccgaggccctcaagggcatgcccatccgctaccagacgaccgcggtgaagtccgagcacaccgggaaggagatcgtggacctgatgtgccacgccaccttcacgatgcggctgctcagccccgtccgcgtgcccaactacaacatgatcatcatggacgaggcccacttcaccgacccggcctccatcgccgcgcggggctacatcagcacccgcgtggggatgggcgaggccgccgccatcttcatgaccgccacgccgcccgggtccgtcgaggcgttcccccagagcaacgccgtgatccaggacgaggagaaggacatcccggagcggtcctggaacagcggctacgactggatcaccgacttccccggcaagaccgtgtggttcgtcccctccatcaagagcgggaacgacatcgccaactgcctgcgcaagaacggcaagcgggtgatccagctgtcccgcaagaccttcgacacggagtaccagaagaccaagaacaacgactgggactacgtcgtgaccaccgacatcagcgagatgggggccaacttccgggccgaccgcgtgatcgacccccggcgctgcctcaagccggtcatcctgaaggacggccccgagcgggtgatcctggcggggcccatgcccgtgacggtcgcctccgccgcccagcgccggggccgcatcggccggaaccagaacaaggagggggaccagtacatctacatgggccagccgctcaacaacgacgaggaccacgcgcactggaccgaggccaagatgctgctggacaacatcaacacccccgaggggatcatccccgccctcttcgagcccgagcgcgagaagtccgccgccatcgacggcgagtaccggctgcgcggggaggcgcgcaagaccttcgtggagctgatgcggcgcggcgacctcccggtgtggctgtcctacaaggtcgccagcgagggcttccagtacagcgaccggcgctggtgcttcgacggggagcggaacaaccaggtgctggaggagaacatggacgtggagatctggacgaaggagggcgagcgcaagaagctccggccccgctggctggacgcccggacctactccgaccccctggccctccgcgagttcaaggagttcgccgcggggcggcgcagcgtctccggcgacctgatcctggagatcggcaagctcccccagcacctgacccagcgggcccagaacgccctggacaacctcgtgatgctgcacaacagcgagcagggcgggaaggcctaccgccacgccatggaggagctgccggacaccatcgagaccatcatgctcctggcgctgatcgccgtgctcaccggcggggtcaccctgttcttcctgtccgggcgggggctcggcaagaccagcatcgggctgctgtgcgtgacctccagctccgccctcctgtggatggccagcgtggagccccactggatcgcggcctccatcatcctggagttcttcctcatggtcctgctgatccccgagcccgaccgccagcggacgccgcaggacaaccagctcgcctacgtggtgatcggcctgctgttcatgatcctcaccgtcgccgccaacgagatggggctgctggagaccaccaagaaggacctcggcatcgggcacacggcggccgagaaccaccaccacgccgccatgctggacgtggacctgcaccccgccagcgcgtggaccctctacgccgtggccaccaccatcatcacgcccatgatgcgccacaccatcgagaacaccaccgccaacatctccctgacggccatcgcgaaccaggccgccatcctgatgggcctcgacaagggctggccgatcagcaagatggacatcggggtccccctgctggccctcggctgctactcccaggtgaaccccctgaccctgaccgccgcggtgctcatgctggtcgcccactacgccatcatcgggcccggcctgcaggccaaggcgacccgggaggcccagaagcgcacggccgccgggatcatgaagaacccgaccgtggacggcatcgtggccatcgacctcgaccccgtcgtgtacgacgcgaagttcgagaagcagctgggccagatcatgctgctcatcctgtgcaccagccagatcctgctcatgcggaccacgtgggccctgtgcgagtccatcaccctggccaccgggcccctcaccacgctgtgggagggcagccccgggaagttctggaacaccaccatcgccgtgtccatggccaacatcttccgcggcagctacctggcgggcgccgggctcgccttcagcctgatgaagtccctgggcgggggccgccgggggaccggcgcccagggcgagacgctcggggagaagtggaagcgccagctgaaccagctgagcaagtcccagttcaacacctacaagcggagcggcatcatcgaggtcgaccgctccgaggccaaggaggggctcaagcggggcgagaccaccaagcacgcggtgagccgcgggacggccaagctgcggtggttcgtggagcgcaacctggtcaagccggagggcaaggtgatcgacctgggctgcgggcggggcgggtggtcctactactgcgccggcctcaagaaggtgaccgaggtcaaggggtacaccaagggcggccccgggcacgaggagcccatccccatggccacctacggctggaacctggtgaagctgcacagcgggaaggacgtgttcttcatcccgcccgagaagtgcgacaccctcctgtgcgacatcggcgagtccagccccaaccccacgatcgaggaggggcgcaccctgcgggtcctcaagatggtggagccgtggctgcgcggcaaccagttctgcatcaagatcctgaacccctacatgccctccgtggtcgagaccctcgagcagatgcagcggaagcacggcgggatgctggtgcgcaaccccctgagccggaactccacccacgagatgtactgggtgagctgcggcacggggaacatcgtctccgcggtgaacatgaccagccgcatgctcctgaaccggttcaccatggcccaccgcaagccgacctacgagcgggacgtggacctgggcgccggcacgcgccacgtcgccgtggagcccgaggtcgccaacctcgacatcatcgggcagcgcatcgagaacatcaagaacgagcacaagtccacctggcactacgacgaggacaacccctacaagacctgggcgtaccacggcagctacgaggtgaagccctccgggagcgccagctccatggtgaacggcgtcgtgcggctgctgaccaagccgtgggacgtgatccccatggtcacgcagatcgccatgaccgacaccacccccttcgggcagcagcgcgtgttcaaggagaaggtggacacgcggacccccaaggccaagcgcggcaccgcccagatcatggaggtcaccgcgaagtggctctggggcttcctgagccggaacaagaagccgcgcatctgcacgcgggaggagttcacccgcaaggtgcggtccaacgccgccatcggggccgtgttcgtcgacgagaaccagtggaacagcgccaaggaggcggtggaggacgagcgcttctgggacctggtgcggcgcgagcgggagctccacaagcagggcaagtgcgcgacctgcgtctacaacatgatggggaagcgcgagaagaagctgggcgagttcgggaaggccaagggctcccgggccatctggtacatgtggctgggcgcgcgcttcctcgagttcgaggccctggggttcatgaacgaggaccactggttcagccgggagaactccctgagcggcgtggagggggagggcctccacaagctggggtacatcctgcgcgacatctccaagatccccggcggcaacatgtacgccgacgacaccgccgggtgggacacgcggatcaccgaggaggacctccagaacgaggccaagatcaccgacatcatggagcccgagcacgcgctgctggccaccagcatcttcaagctcacgtaccagaacaaggtggtccgcgtgcagcggccggccaagaacggcaccgtgatggacgtcatctcccgccgcgaccagcgggggagcggccaggtgggcacctacgggctgaacaccttcacgaacatggaggcccagctgatccgccagatggagtccgagggcatcttcagcccctccgagctcgagacccccaacctggccgggcgggtgctggactggctcgagaagcacggcatcgagcgcctgcggcgcatggcgatcagcggggacgactgcgtcgtgaagcccatcgacgaccggttcgccaccgccctgaccgccctcaacgacatgggcaaggtgcgcaaggacatcccgcagtgggagccctccaagggctggaacgactggcagcaggtccccttctgcagccaccacttccaccagctgatcatgaaggacgggcgggagatcgtggtgccctgccgcaaccaggacgagctggtcggccgggcccgcgtgagccagggggcgggctggtccctccgggagacggcctgcctgggcaagagctacgcccagatgtggcagctgatgtacttccaccgccgggacctccgcctggccgccaacgcgatctgctccgccgtgccggtcgactgggtgcccaccagccggaccacctggtccatccacgcccaccaccagtggatgaccacggaggacatgctgagcgtgtggaaccgcgtctggatcgaggagaacccctggatggaggacaagacccacgtgtccagctgggaggacgtgccctacctcggcaagcgggaggaccagtggtgcggctccctgatcgggctgaccgcccgcgcgacctgggccacgaacatccaggtcgccatcaaccaggtgcgccggctcatcggcaacgagaactacctggactacatgaccagcatgaagcgcttcaagaacgagtccgacccggagggggccctgtggtga

SEQ ID NO: 8907 - RNA, 9879 nt, synthetic construct
  misc_feature 1..9879: note = derived and/or modified CDS sequence (opt1) from DENV-1__JQ915080__SS-prME
  source 1..9879: mol_type = other RNA
agcgtgaccatgctgctcatgctgctgcccaccgtgctcaccttccacctgaccacccggggcggggagccccacatgatcgtgagcaagcaggagcggggcaagagcctcctgttcaagacctccgccggggtgaacatgtgcacgctgatcgccatggacctgggcgagctctgcgacgacaccatgacctacaagtgcccccgcatcaccgagacggagcccgacgacgtggactgctggtgcaacgcgaccgagacctgggtgacctacgggacgtgcagccagaccggcgagcaccggcgcgacaagcggtccgtggccctggcgccccacgtcggcctggggctcgagacccgcaccgagacgtggatgagctccgagggcgcctggcggcagatccagaaggtggagacctgggccctgcgccaccccgggttcaccgtgatcgcgctgttcctcgcccacgccatcggcaccagcatcacgcagaaggggatcatcttcatcctgctgatgctcgtcaccccctccatggccatgcggtgcgtgggcatcggcaaccgcgacttcgtggaggggctgagcggcgcgacctgggtcgacgtggtgctggagcacgggtcctgcgtcaccacgatggccaaggacaagcccaccctcgacatcgagctgctgaagaccgaggtgaccaaccccgccgtgctccggaagctgtgcatcgaggccaagatcagcaacacgaccaccgactcccgctgcccgacccagggcgaggccacgctggtcgaggagcaggacaccaacttcgtgtgccggcgcaccttcgtggaccggggctgggggaacggctgcggcctcttcggcaaggggagcctgatcacgtgcgcgaagttcaagtgcgtcacgaagctggagggcaagatcgtgcagtacgagaacctcaagtactccgtgatcgtcaccgtgcacaccggcgaccagcaccaggtcgggaacgagaccaccgagcacggcacgatcgccaccatcacgccccaggcccccaccagcgagatccagctgacggactacggggccctgaccctcgactgcagcccccggaccggcctggacttcaacgagatggtgctgctcaccatgaaggagaagtcctggctggtgcacaagcagtggttcctggacctcccgctgccctggacgaccggggcctccaccagccaggagacctggaaccggcaggacctgctcgtcacgttcaagaccgcgcacgccaagaagcaggaggtggtggtcctgggcagccaggagggcgccatgcacaccgccctgaccggggccacggagatccagacctccggcaccaccacgatcttcgcggggcacctcaagtgccgcctgaagatggacaagctgaccctcaagggcatcagctacgtgatgtgcaccgggtccttcaagctggagaaggaggtggccgagacccagcacggcacggtcctggtccaggtgaagtacgagggcaccgacgccccctgcaagatccccttcagctcccaggacgagaagggggtcacccagaacggccggctggtgaccgccaacccgatcgtgacggacaaggagcgccccgtcaacatcgaggccgagccgcccttcggggagagctacatcgtggtgggcgcgggcgagaaggccctcaagctgtcctggttcaagaaggggagctccatcggcaagatgttcgaggccaccgcccgcggggcccgccgcatggccatcctgggcgacaccgcctgggacttcgggagcatcggcggcgtcttcacctccgtggggaagctcgtgcaccagatcttcggcacggcctacggggtcctgttcagcggcgtgtcctggaccatgaagatcgggatcggcatcctgctcacctggctgggcctgaacagccggtccaccagcctctccatgacgtgcatcgccgtggggatggtcaccctgtacctgggcgtgatggtgcaggcggacagcgggtgcgtcatcaactggaagggccgcgagctcaagtgcgggtccggcatcttcgtgaccaacgaggtgcacacctggaccgagcagtacaagttccaggccgacagcccgaagcggctgagcgccgccatcggcaaggcctgggaggagggggtctgcggcatccgctccgcgacgcggctggagaacatcatgtggaagcagatcagcaacgagctcaaccacatcctgctggagaacgacatgaagttcaccgtggtggtcggggacgtgtccggcatcctcgcccaggggaagaagaccatccgcccccagcccatggagcacaagtacagctggaagtcctggggcaaggccaagatcatcggcgccgacgtgcagaacaccacgttcatcatcgacgggcccaacaccccggagtgccccgacgaccagcgggcctggaacatctgggaggtcgaggactacggcttcgggatcttcaccaccaacatctggctgaagctgcgcgacagctacacccaggtgtgcgaccaccggctcatgtccgcggccatcaaggacagcaaggccgtgcacgccgacatgggctactggatcgagtccgagaagaacgagacctggaagctggcgcgcgccagcttcatcgaggtcaagacctgcgtgtggcccaagtcccacaccctgtggagcaacggcgtgctcgagtccgagatggtcatccccaagatctacgggggcccgatcagccagcacaactaccggcccgggtacttcacgcagaccgccggcccctggcacctggggaagctggagctcgacttcgacctgtgcgagggcaccaccgtggtggtcgacgagcactgcggcaaccgcgggccgtccctgcggacgaccaccgtgaccggcaagatcatccacgagtggtgctgccgcagctgcacgctgccgcccctgcggttcaagggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcaccctggtggtcttcctgctcctgaccctggggcagctcacgtggaacgacctgatccgcctgtgcatcatggtgggcgccaacgcgagcgacaacatggggatgggcacgacctacctcgccctgatggccaccttccgcatgcggccgatgttcgccgtggggctcctcttccgccggctgacgtcccgcgaggtcctgctcctgaccgtggggctgagcctcgtggcctccgtcgagctgcccaacagcctggacgagctcggcgacgggctggccatgggcatcatgatcctgaagctcctgaccgacttccagtcccaccagctgtgggccaccctcctgagcctgacgttcgtgaagaccaccctctccctgcactacgcctggaagaccatggccatgatcctgagcatcgtgtccctcctgcccctgtgcctcagcacgacctcccagaagaccacctggctgcccgtcctgctcggcagcctggggtgcaagccgctgaccatgttcctcatcacggagaacaagatctggggccggaagtcctggcccctgaacgaggggatcatggccgtgggcatcgtgagcatcctgctcagctccctgctgaagaacgacgtccccctcgcggggcccctgatcgccggcggcatgctgatcgcctgctacgtgatcagcgggtccagcgccgacctctccctggagaaggcggccaaggtgagctgggaggaggaggccgagcactccggcgccagccacaacatcctggtcgagatccaggacgacgggaccatgaagatcaaggacgaggagcgcgacgacaccatcaccatcctcctgaaggccacgctgctcgcgatctccggcgtgtacccgatgagcatccccgccaccctgttcgtgtggcacttctggcagaagaagaagcagcggtccggggtcctgtgggacacccccagcccgcccgaggtggagaaggccgtgctggacgacggcatctaccgcatcctccagcggggcctgctggggcgctcccaggtcggcgtgggggtgttccaggagggcgtcttccacaccatgtggcacgtgacgcgcggggccgtgctcatgtaccagggcaagcgcctggagcccagctgggcctccgtcaagaaggacctgatcagctacggcgggggctggcggttccaggggtcctggaacatgggcgaggaggtccaggtgatcgcggtcgagcccgggaagaaccccaagaacgtgcagaccgcccccggcaccttcaagaccagcgagggcgaggtgggggccatcgccctcgacttcaagcccggcacgtccgggagccccatcgtcaaccgcgagggcaagatcgtgggcctgtacgggaacggcgtggtcaccaccagcgggacctacgtgtccgccatcgcgcaggccaaggccagccaggagggccccctgccggagatcgaggacgaggtgttccggaagcgcaacctcacgatcatggacctgcaccccgggtccggcaagacccggcgctacctgcccgccatcgtccgggaggccatcaagcgcaagctccggaccctggtgctggcgccgacccgcgtggtcgccagcgagatggccgaggccctcaagggcatgcccatccgctaccagacgaccgcggtgaagtccgagcacaccgggaaggagatcgtggacctgatgtgccacgccaccttcacgatgcggctgctcagccccgtccgcgtgcccaactacaacatgatcatcatggacgaggcccacttcaccgacccggcctccatcgccgcgcggggctacatcagcacccgcgtggggatgggcgaggccgccgccatcttcatgaccgccacgccgcccgggtccgtcgaggcgttcccccagagcaacgccgtgatccaggacgaggagaaggacatcccggagcggtcctggaacagcggctacgactggatcaccgacttccccggcaagaccgtgtggttcgtcccctccatcaagagcgggaacgacatcgccaactgcctgcgcaagaacggcaagcgggtgatccagctgtcccgcaagaccttcgacacggagtaccagaagaccaagaacaacgactgggactacgtcgtgaccaccgacatcagcgagatgggggccaacttccgggccgaccgcgtgatcgacccccggcgctgcctcaagccggtcatcctgaaggacggccccgagcgggtgatcctggcggggcccatgcccgtgacggtcgcctccgccgcccagcgccggggccgcatcggccggaaccagaacaaggagggggaccagtacatctacatgggccagccgctcaacaacgacgaggaccacgcgcactggaccgaggccaagatgctgctggacaacatcaacacccccgaggggatcatccccgccctcttcgagcccgagcgcgagaagtccgccgccatcgacggcgagtaccggctgcgcggggaggcgcgcaagaccttcgtggagctgatgcggcgcggcgacctcccggtgtggctgtcctacaaggtcgccagcgagggcttccagtacagcgaccggcgctggtgcttcgacggggagcggaacaaccaggtgctggaggagaacatggacgtggagatctggacgaaggagggcgagcgcaagaagctccggccccgctggctggacgcccggacctactccgaccccctggccctccgcgagttcaaggagttcgccgcggggcggcgcagcgtctccggcgacctgatcctggagatcggcaagctcccccagcacctgacccagcgggcccagaacgccctggacaacctcgtgatgctgcacaacagcgagcagggcgggaaggcctaccgccacgccatggaggagctgccggacaccatcgagaccatcatgctcctggcgctgatcgccgtgctcaccggcggggtcaccctgttcttcctgtccgggcgggggctcggcaagaccagcatcgggctgctgtgcgtgacctccagctccgccctcctgtggatggccagcgtggagccccactggatcgcggcctccatcatcctggagttcttcctcatggtcctgctgatccccgagcccgaccgccagcggacgccgcaggacaaccagctcgcctacgtggtgatcggcctgctgttcatcatcctcaccgtcgccgccaacgagatggggctgctggagaccaccaagaaggacctcggcatcgggcacacggcggccgagaaccaccaccacgccgccatgctggacgtggacctgcaccccgccagcgcgtggaccctctacgccgtggccaccaccatcatcacgcccatgatgcgccacaccatcgagaacaccaccgccaacatctccctgacggccatcgcgaaccaggccgccatcctgatgggcctcgacaagggctggccgatcagcaagatggacatcggggtccccctgctggccctcggctgctactcccaggtgaaccccctgaccctgaccgccgcggtgctcatgctggtcgcccactacgccatcatcgggcccggcctgcaggccaaggcgacccgggaggcccagaagcgcacggccgccgggatcatgaagaacccgaccgtggacggcatcgtggccatcgacctcgaccccgtcgtgtacgacgcgaagttcgagaagcagctgggccagatcatgctgctcatcctgtgcaccagccagatcctgctcatgcggaccacgtgggccctgtgcgagtccatcaccctggccaccgggcccctcaccacgctgtgggagggcagccccgggaagttctggaacaccaccatcgccgtgtccatggccaacatcttccgcggcagctacctggcgggcgccgggctcgccttcagcctgatgaagtccctgggcgggggccgccgggggaccggcgcccagggcgagacgctcggggagaagtggaagcgccagctgaaccagctgagcaagtcccagttcaacacctacaagcggagcggcatcatcgaggtcgaccgctccgaggccaaggaggggctcaagcggggcgagaccaccaagcacgcggtgagccgcgggacggccaagctgcggtggttcgtggagcgcaacctggtcaagccggagggcaaggtgatcgacctgggctgcgggcggggcgggtggtcctactactgcgccggcctcaagaaggtgaccgaggtcaaggggtacaccaagggcggccccgggcacgaggagcccatccccatggccacctacggctggaacctggtgaagctgcacagcgggaaggacgtgttcttcatcccgcccgagaagtgcgacaccctcctgtgcgacatcggcgagtccagccccaaccccacgatcgaggaggggcgcaccctgcgggtcctcaagatggtggagccgtggctgcgcggcaaccagttctgcatcaagatcctgaacccctacatgccctccgtggtcgagaccctcgagcagatgcagcggaagcacggcgggatgctggtgcgcaaccccctgagccggaactccacccacgagatgtactgggtgagctgcggcacggggaacatcgtctccgcggtgaacatgaccagccgcatgctcctgaaccggttcaccatggcccaccgcaagccgacctacgagcgggacgtggacctgggcgccggcacgcgccacgtcgccgtggagcccgaggtcgccaacctcgacatcatcgggcagcgcatcgagaacatcaagaacgagcacaagtccacctggcactacgacgaggacaacccctacaagacctgggcgtaccacggcagctacgaggtgaagccctccgggagcgccagctccatggtgaacggcgtcgtgcggctgctgaccaagccgtgggacgtgatccccatggtcacgcagatcgccatgaccgacaccacccccttcgggcagcagcgcgtgttcaaggagaaggtggacacgcggacccccaaggccaagcgcggcaccgcccagatcatggaggtcaccgcgaagtggctctggggcttcctgagccggaacaagaagccgcgcatctgcacgcgggaggagttcacccgcaaggtgcggtccaacgccgccatcggggccgtgttcgtcgacgagaaccagtggaacagcgccaaggaggcggtggaggacgagcgcttctgggacctggtgcggcgcgagcgggagctccacaagcagggcaagtgcgcgacctgcgtctacaacatgatggggaagcgcgagaagaagctgggcgagttcgggaaggccaagggctcccgggccatctggtacatgtggctgggcgcgcgcttcctcgagttcgaggccctggggttcatgaacgaggaccactggttcagccgggagaactccctgagcggcgtggagggggagggcctccacaagctggggtacatcctgcgcgacatctccaagatccccggcggcaacatgtacgccgacgacaccgccgggtgggacacgcggatcaccgaggaggacctccagaacgaggccaagatcaccgacatcatggagcccgagcacgcgctgctggccaccagcatcttcaagctcacgtaccagaacaaggtggtccgcgtgcagcggccggccaagaacggcaccgtgatggacgtcatctcccgccgcgaccagcgggggagcggccaggtgggcacctacgggctgaacaccttcacgaacatggaggcccagctgatccgccagatggagtccgagggcatcttcagcccctccgagctcgagacccccaacctggccgggcgggtgctggactggctcgagaagcacggcatcgagcgcctgcggcgcatggcgatcagcggggacgactgcgtcgtgaagcccatcgacgaccggttcgccaccgccctgaccgccctcaacgacatgggcaaggtgcgcaaggacatcccgcagtgggagccctccaagggctggaacgactggcagcaggtccccttctgcagccaccacttccaccagctgatcatgaaggacgggcgggagatcgtggtgccctgccgcaaccaggacgagctggtcggccgggcccgcgtgagccagggggcgggctggtccctccgggagacggcctgcctgggcaagagctacgcccagatgtggcagctgatgtacttccaccgccgggacctccgcctggccgccaacgcgatctgctccgccgtgccggtcgactgggtgcccaccagccggaccacctggtccatccacgcccaccaccagtggatgaccacggaggacatgctgagcgtgtggaaccgcgtctggatcgaggagaacccctggatggaggacaagacccacgtgtccagctgggaggacgtgccctacctcggcaagcgggaggaccagtggtgcggctccctgatcgggctgaccgcccgcgcgacctgggccacgaacatccaggtcgccatcaaccaggtgcgccggctcatcggcaacgagaactacctggactacatgaccagcatgaagcgcttcaagaacgagtccgacccggagggggccctgtggtga

SEQ ID NO: 8908 - RNA, 9879 nt, synthetic construct
  misc_feature 1..9879: note = derived and/or modified CDS sequence (opt1) from DENV-1__KJ755855__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggagcgtggccctcgcgccccacgtgggcctggggctggagacgcgcgccgagacctggatgagctccgagggcgcctggaagcagatccagcgggtcgagacctgggccctccgccaccccgggttcaccgtgatcgcgctgttcctggcccacgccatcggcacgagcatcacccagaaggggatcatcttcatcctcctgatgctggtgaccccctccatggccatgcggtgcgtcggcatcggcagccgcgacttcgtggaggggctctccggcgccacctgggtggacgtcgagctggagcacgggagctgcgtgacgaccatggcgaaggacaagcccaccctggacatcgagctcctgaagaccgaggtgacgaaccccgccgtcctgcggaagctctgcatcgaggccaagatctccaacaccaccaccgacagccgctgcccgacgcagggcgaggccaccctggtggaggagcaggacgccaacttcgtgtgccggcgcaccttcgtcgaccggggctgggggaacggctgcgagctgttcgggaagggctccctcctgacctgcgcgaagttcaagtgcgtgacgaagctggaggggaagatcgtgcagtacgagaacctcaagtacagcgtcatcgtgaccgtgcacatcgccgcccagcaccaggtcggcaacgagtccaccgagcacggcaccacggccatcatcacgccccaggcccccaccaccgagatccagctgaccgactacggggcgctgacgctcgactgcagcccccgcaccggcctggacttcaacgagatggtgctgctcaccatgaaggagaagtcctggctggtccacaagcagtggttcctggacctccccctgccctggaccagcggggccagcacgtcccaggagacctggaaccggctgttcctcctggtgaccttcaagaccgcccacgccaagaagcaggaggtggtcgtgctgggcagccaggagggggccatgcacacggcgctcaccggcgccaccgccctgcagaccttcggcacgaccaccatcttcgccgggcacctgaacatccgcctcaagatggacaagctgaccctgaagggcatgtcctacgtgatgtgcacggggagcttcaagctggagaaggaggtcgcggagacccagcacggcaccatcctcgtgcagatcaagtacgaggggaccgacgccccctgcaagatccccttctccacgcaggacgagaagggcgtgacccagaacggccggctgatcaccgccaacccgatcgtcaccgacaaggagaagcccgtgaacatcgaggccgagccgcccttcggggagagctacatcgtgatcggcgccggggagaaggcgctgaagctctcctggttcaagaagggcagctccatcggcaagatgttcgaggccacggcccgcggggcccggcgcatggccatcctgggcgacaccgcgtgggacttcgggagcatcggcggggtcttcacctccgtgggcaagctggtgcaccagatcttcggcaccgcctacggggtcctcttcagcggcgtgtcctggacgatgaagatcgggatcggcgtgctgctgacctggctcgggctgaacagccgctccaccagcctgtccatgacctgcatcgccgtcggcctcgtgacgctgtacctgggcgtgatggtccaggccgacagcgggtgcgtgatcaactggaagggccgggagctcaagtgcgggtccggcatcttcgtgaccaacgaggtccacacctggaccgagcagtacaagttccaggccgacagcccgaagcgcctgagcgcggccatcgggaaggcctgggaggagggcgtgtgcggcatccggtccgccacgcgcctggagaacatcatgtggaagcagatcagcaacgagctcaaccacatcctgctggagaacgacctcaagttcaccgtggtcgtgggggacgtggcgggcatcctggcccaggggaagaagatgatccggccccagcccatggagcacaagtactcctggaagaactggggcaaggccaagatcatcggggccgacgtccagaacagcaccttcatcatcgacggccccaacaccccggagtgctccgacgaccagcgcgcctggaacatctgggaggtggaggactacggcttcgggatcttcaccacgaacatctggctgaagctccgggacagctacacccaggtgtgcgaccaccgcctgatgtccgcggccatcaaggacagcaaggccgtccacgccgacatgggctactggatcgagtccgagaagaacgagacctggaagctggcccgggcgagcttcatcgaggtgaagacctgcacgtggcccaagtcccacaccctctggagcaacggggtgctggagtccgagatgatcatccccaagatctacggcggccccatcagccagcacaactactccccggggtacttcacccagaccgccggcccctggcacctggggaagctcgagctggacttcgacctgtgcgagggcacgaccgtcgtggtggacgagcactgcgggaaccgcggccccagcctccggaccaccacggtcaccggcaagatcatccacgagtggtgctgccgctcctgcaccctgccgcccctgcggttccgcggggaggacggctgctggtacgggatggagatccggcccgtgaaggagaaggaggagaacctcgtcaagagcatggtcagcgccggctccggggaggtggtgagcctgtccctgggcctcctgtgcatcagcatcatgatcgaggaggtcatgcgctcccggtggagccgcaagatgctgatgaccggcacgctcgccgtgttcttccggaagatccgcgggcagctgacctggaacgacctgatccgcctctgcatcatggtgggcgccaacgcgtccgaccggatggggacccgcaccacgtacctggccctgatggccaccttcaagatgcggcccatgttcagcgtcggcctcctgttccgccggctgacctcccgcgaggtgctcctgctgaccatcgggctcagcctggtggcctccgtcgagctgccgaacagcctcgaggagctgggcgtgctgctcgcgatgggcatcatgatcctgacgctgctcaccgacttccagtcccaccagctgtgggccaccctgctcagcatgaccttcatcaagacgaccttctccctgcactacacctggaagaccatggccatggtcctgagcatcgtgtccctcttccccctgtgcctgagcacgacctcccagaagaccacctggctccccgtgctgctggggagcctcggctgcaagcccctgacgatgttcctgatcgccgagaacaagatctgggggcgcaagagctggccgctcaacgagggcatcatggccgtcggcatcgtgtccatcctgctgagctccctcctgaagaacgacgtgcccctggcggggcccctcatcgccggcgggatgctgatcgcctgctacgtcatcagcggctccagcgccgacctgtccctcgagaaggccgcggaggtgagctgggaggaggaggccgagcactccggggccagccacaacatcctggtggaggtccaggacgacggcaccatgaagatcaaggacgaggagcgcgacgacaccctgaccatcctcctgaaggccaccctgctcgccgtgtccggcgtgtaccccctgagcatcccggcgacgctgttcgtctggtacttctggcagaagaagaagcagcggtccggggtgctgtgggacaccccctccccgcccaaggtggagaaggccgtcctcgacgacggcatctaccgcatcatgcagcgggggctgctgggccgctcccaggtgggggtgggcgtcttccaggagaacgtgttccacaccatgtggcacgtgacccggggcgccgtcctcatgtaccaggggaagcgcctggagccgagctggggccgggtgaagaaggacctgatctcctacgggggcgggtggggcctcaagggcagctggaacacgggggaggaggtgcaggtcatcgccgtggagcccggcaagaaccccaagaacgtgcagaccgcccccgggaccttcaagaccccggagggcgaggtcggggcgatcgccctggacttcaagcccggcacgtccggcagccccatcgtgaaccgcgaggggaagatcgtgggcctgtacgggaacggcgtcgtgaccaccagcggcacctacgtgtccgccatcgcccacgcgaaggccagccaggaggggcccctcccggagacggaggtcgaggccttccggaagcgcaacctgaccatcatggacctgcaccccggctccgggaagacccggcgctacctccccgccatcgtgcgggaggccatcaagcgcaagatgcgcaccctgatcctggcgccgacgcgggtggtcgccagcgagatggccgaggccctcaagggcatgcccatccgctaccagaccaccgccgtgaagtccgagcacaccgggaaggagatcgtggacctgatgtgccacgcgacgttcaccatgcggctgctcagccccgtccgcgtgcccaactacaacatgatcatcatggacgaggcccacttcaccgacccgtccagcctggccgcccggggctacatctccacccgcgtgggcatgggggaggccgcggccatcttcatgacggccacgccgcccggcagcgtcgaggccttcccccagtccaacgcggtgatccaggacgaggagcgggacatcccggagcgcagctggaactccgggtacgagtggatcaccgacttccccggcaagaccgtgtggttcgtccccagcatcaaggccgggaacgacatcgccaactgcctgcggaagaacggcaagcgcgtgatccagctctcccggaagacgttcgacaccgagtaccagaagaccaagaacaacgactgggactacgtggtcaccacggacatcagcgagatgggcgccaacttccccgccgaccgcgtgatcgacccgcggcgctgcctgaaccccgtgatcctgaaggacgggcccgagcgggtcatcctcgcgggccccatgccggtgaccgtcgcctccgccaaccagcgccgggggcgcatcggccggaaccacaacaaggagggggaccagtacatctacatgggccagcccctgaacaacgacgaggaccacgcccactggaccgaggccaagatgctgctcgacaacatcaacacccccgagggcatcatccccgcgctgttcgagccggagcgcgagaagtccgccgccatcgacggggagtaccgcctgcggggcgaggcccgcaagacgttcgtggagctcatgcggcgcggggacctgcccgtgtggctgtcctacaaggtcgccagcgagggcttccagtacagcgaccggcgctggtgcttcgacggggagcggaacaaccaggtgctcgaggagaacatggacgtggagatctggaccaaggagggcgagcgcaagaagctgcggccccgctggctggacgcgcggacctactccgaccccctcgccctgcgcgagaagaaggagttcgccgccggccggcgcagcgtctccggggacctgatcctcgagatcggcaagctgccgcagcacctgacccagcgggcgcagaacgccctcgacaacctggtgatgctgcacaacagcgagcagggcgggcgcgcctaccggcacgccatggaggagctccccgacacgatcgagaccctgatgctgctcgccctgatcgcggtgctgaccggcggggtcaccctcttcttcctgtccggcaaggggctgggcaaggccgggaacggcctcctgtgcgtgatggccagctccgccctgctctggatggccaacgtggagccccactggatcgcggccagcatcatcctggagttcttcctgatggtcctcctgatccccgagccggaccgccagcggacgccccaggacaaccagctggcctacgtggtgatccgcctcctgttcatgatcctgacggtcgccgccaacgagatgggcctcctggagaccaccaagaaggacctggggatcggccacgcggccgtggagaaccaccaccacgccgccatgctcgacatcgacctgcaccccgcctccgcgtggaccctgtacgccgtggccacgaccatcatcaccccgatgatgcggcacaccatcgagaacacgaccgccaacatcagcctcaccgcgatcgccaaccaggccgccatcctgatggggctggacaagggctggcccatctccaagatggacatcggggtccccctcctggccctgggcttcctcagccaggtgaaccccctgaccctgacggcggccgtgctcatgctggtcgcccactacgccatcatcggcccggggctgcaggccaaggcgacccgcgaggcccagaagcgcaccgccgccggcatcatgaagaaccccaccatcgacgggatcgtggccatcgacctcgaccccgtggtctacgacgcgaagttcgagaagcagctgggccagatcatgctgctcatcctgtgcacgtcccagatcctgctcatgcggaccacctgggccctgtgcgagagcatcaccctggccacggggcccctctccccgctgtgggagggcagccccggcaagtcctggaacaccaccatcgccgtgagcatggcgaacatcttccgcgggtcctacctggccggcgccgggctcgccttcagcctgatgaagtccctgggcggcgggcggcgcggcaccggggcccagggcgagacgctcggggagaagtggaagcggcagctgaaccagctgtccaagaccgagttcaacacctacaagcgcagcggcatcatggaggtggaccggtccgaggcgaaggagggcctgaagcgcggggagaccacgaagcacgccgtcagccggggcaccgccaagctccgctggttcgtggagcggaacctggtgaagcccgaggggaaggtcatcgacctgggctgcgggcgcggcggctggtcctactactgcgccgggctcaagaaggtgagcgaggtgcggggctacaccaagggcgggcccgggcacgaggagccgatccccatggccacctacggctgggacctgctgaagcgctgctccggcaaggagttcttcttcatcccgcccgagaagtgcgacagcttcctcggggacatcggcgagtccagcccgaaccccacgatcgaggaggggcggaccgtccgcgtgctgaagatggtggagccctggctgcggggcaaccagttctgcatcaagatcctcaacccctacatgccgtccgtcgtggagaccctggagcagatgcagcgcaagcacgggggcatgctggtgcggaaccccctcagccgcaactccacccacgagatgtactgggtcagctgcggcacggggaacatcgtgtccgcggtgaacatgaccagccgcatgctgctgaaccggttcaccatggcccaccgcaagcccacctacgagcgggacgtcgacctcggcgccgggacccgccacgtggccgtggagcccgaggtcgccaacctggacatcatcggccagcggatcgagaacatcaagcacgagcacaagtccacgtggcactacgacgaggacaacccgtacaagacctgggcgtaccacggcagctacgaggtgaagccctccgggagcgccagctccatggtgaacggcgtcgtgaagctgctcaccaagccctgggacgtgatccccatggtcacccagatcgccatgacggacaccaccccgttcgggcagcagcgcgtgttcaaggagaaggtcgacacccggacgcccaaggccaagcgcggcaccgcgcagatcatggaggtgaccgcccggtggctgtggagcttcctgtcccgcaacaagaagccccggatctgcacccgcgaggagttcacgcggaaggtgcgcagcaacgccgccatcggggccgtcttcgtggacgagaaccagtggaactccgcgaaggaggccgtggaggacgaccggttctgggacctcgtccaccgcgagcgggagctgcacaagcagggcaagtgcgcgacctgcgtgtacaacatgatgggcaagcgcgagaagaagctgggggagttcggcaaggccaaggggagccgggccatctggtacatgtggctcggcgcgcgcttcctggagttcgaggccctggggttcatgaacgaggaccactggttctcccgggagaacagcctctccggcgtggagggcgaggggctgcacaagctgggctacatcctccgcgacatcagcaagatccccggcgggaacatgtacgccgacgacaccgccgggtgggacacccgcatcacggaggacgacctgcagaacgaggccaagatcaccgacatcatggagcccgagcacgcgctgctcgccaagtccatcttcaagctgacctaccagaacaaggtcgtgcgggtgcagcgccccgccaagaacgggaccgtcatggacgtgatcagccggcgcgaccagcggggctccggccaggtgggcacgtacgggctgaacaccttcaccaacatggaggcccagctcatccgccagatggagagcgaggagatcttctcccccaacgagctggagaccccgaacctggccgagcgggtcctcgactggctggagaagtacggcgtggagcgcctgaagcggatggcgatcagcggcgacgactgcgtggtcaagcccatcgacgaccgcttcgccacggccctcaccgccctgaacgacatggggaaggtgcggaaggacatcccccagtgggagccctccaagggctggaacgactggcagcaggtcccgttctgcagccaccacttccaccagctggtcatgaaggacgggcgcgagatcgtggtgccctgccggaaccaggacgagctcgtcggccgcgcgcgggtgagccagggggccggctggtccctgcgcgagaccgcctgcctgggcaagagctacgcccagatgtggcagctcatgtacttccaccggcgcgacctgcggctggccgcgaacgccatctgctccgccgtgcccgtcgactgggtgcccaccagccgcacgacctggtccatccacgcccaccaccagtggatgaccaccgaggacatgctcagcgtgtggaaccgcgtctggatcgaggagaacccgtggatggaggacaagacgcgggtgtccagctgggaggacgtgccctacctggggaagcgcgaggaccagtggtgcggctccctgatcgggctcaccgcccgggcgacctgggccaccaacatccaggtcgccatcaaccaggtgcgccggctgatcggcaacgagaactacagcgactacatgacgtccatgaagcgcttcaagaacgagagcgagcccgagggggccctgtggtga

SEQ ID NO: 8909 - RNA, 9879 nt, synthetic construct
  misc_feature 1..9879: note = derived and/or modified CDS sequence (opt1) from DENV-1__KF289073__SS-prME
  source 1..9879: mol_type = other RNA
agcgtgaccatgctgttcatgctcctgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtcacctacgggacctgcagccagaccggcgagcaccggcgggacaagcggtccgtggccctcgcgccccacgtgggcctggggctggagacgcgcaccgagacctggatgagctccgagggcgcctggaagcagatccagaaggtcgagacctgggccctccggcaccccgggttcaccgtgatcgccctgttcctggcgcacgccatcggcaccagcatcacccagaaggggatcatcttcatcctcctgatgctggtgaccccctccatggccatgcgctgcgtcggcatcggcaaccgggacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcgcaagctctgcatcgaggccaagatcagcaagaccaccacggactcccggtgccccacccagggcgaggccaccctggtggaggagcaggacgccaacttcgtctgccgccggaccttcgtggaccgcggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccgccaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccggctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccatctccacccaggacgagaagggggtgacccagaacggccgcctgatcacggccaacccgatcgtcaccgacaaggagaagcccgtgaacatcgagaccgagccgcccttcggggagagctacatcgtgatcggcgccggcgagaaggcgctcaagctgtcctggttcaagaaggggagctccatcggcaagatgttcgaggccaccgcccgcggggcccgccggatggccatcctgggcgacacggcgtgggacttcgggagcatcggcggcgtcttcacctccgtggggaagctcgtgcaccaggtcttcggcaccgcctacggggtgctgttcagcggcgtgtcctggaccatgaagatcgggatcggcgtcctgctcacgtggctgggcctgaacagccgctccaccagcctctccatgacctgcatcgccgtggggatggtgaccctgtacctgggcgtcatggtgcaggccgacagcgggtgcgtgatcaactggaagggccgcgagctcaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtcgtggtgggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacgaccaccgggcctggaacatctgggaggtcgaggactacggcttcgggatcttcaccacgaacatctggctgaagctgcgcgactcctacacccagatgtgcgaccaccggctcatgagcgcggccatcaaggactccaaggccgtgcacgccgacatgggctactggatcgagagcgagaagaacgagacctggaagctggcccgcgcgtccttcatcgaggtgaagacctgcatctggcccaagagccacacgctgtggtccaacggcgtcctcgagagcgagatgatcatccccaagatctacgggggcccgatctcccagcacaactaccggcccgggtacttcacccagaccgccggcccctggcacctggggaagctggagctcgacttcgacctgtgcgagggcaccacggtggtggtcgacgagcactgcggcaaccgcgggccgagcctgcggaccaccaccgtgacgggcaagatcatccacgagtggtgctgccgctcctgcaccctgccgcccctccggttcaagggggaggacggctgctggtacgggatggagatccgccccgtgaaggagaaggaggagaacctggtccggagcatggtgtccgccggcagcggcgaggtggacagcttctccctcgggctgctgtgcgtcagcatcatgatcgaggaggtgatgcgctcccggtggagccgcaagatgctcatgaccggcaccctggccgtgttcctgctcctgatcatggggcagctgacgtggaacgacctcatccggctgtgcatcatggtcggcgccaacgcgtccgaccgcatggggatgggcaccacctacctggccctcatggccaccttcaagatgcgcccgatgttcgccgtgggcctgctgttccggcgcctcacgagccgggaggtgctgctgctcaccatcgggctgtccctggtcgccagcgtggagctccccaactccctggaggagctgggcgacgggctcgcgatgggcatcatgatgctgaagctgctcaccgacttccagagccaccagctgtggaccacgctgctctccctgaccttcatcaagaccaccctgagcctcgactacgcctggaagacgatggccatggtcctgtccatcgtgagcctgttccccctctgcctgtccaccaccagccagaagaccacgtggctgcccgtgctcctgggctccttcgggtgcaagccgctgaccatgttcctcatcaccgagaacaagatctggggccgcaagagctggcccctgaacgaggggatcatggccgtcggcatcgtgtccatcctgctcagcagcctgctgaagaacgacgtgcccctcgcggggcccctgatcgccggcggcatgctgatcgcctgctacgtcatctccgggagctccgccgacctcagcctggagaaggccgcggaggtgtcctgggaggaggaggccgagcacagcggcgcctcccacaacatcctggtggaggtccaggacgacgggaccatgaagatcaaggacgaggagcgggacgacaccctcacgatcctgctgaaggccaccctcctggccgtgagcggcgtgtacccgatgtccatccccgcgaccctgttcgtctggtacttctggcagaagaagaagcagcgcagcggggtgctctgggacacccccagcccgcccgaggtggagcgggccgtcctggacgacggcatctaccgcatcctgcagcggggcctgctcgggcgcagccaggtgggcgtgggggtcttccaggacggcgtgttccacacgatgtggcacgtgacccgcggggccgtcctgatgtaccagggcaagcgcctggagccctcctgggccagcgtgaagaaggacctcatctcctacggcgggggctggcggttccaggggagctggaacatgggcgaggaggtgcaggtcatcgccgtggagcccgggaagaaccccaagaacgtgcagaccacccccggcacgttcaagacccccgagggcgaggtcggggcgatcgccctggacttcaagcccggcacctccgggagccccatcgtgaaccgcgagggcaagatcgtgggcctgtacgggaacggcgtcgtgaccacgtccgggacctacgtgagcgccatcgcccaggccaaggcgagccaggagggcccgctccccgagatcgaggacgaggtcttccggaagcgcaacctgaccatcatggacctgcaccccgggtccggcaagacccggcgctacctcccggccatcgtgcgggaggccatcaagcgcaagctgcggacgctgatcctcgcccccacccgcgtggtcgcgagcgagatggccgaggccctgaagggcatgcccatccgctaccagaccaccgccgtgaagtccgagcacacggggcgggagatcgtggacctgatgtgccacgccaccttcaccatgcgcctcctgagccccgtccgggtgccgaactacaacatgatcatcatggacgaggcgcacttcaccgaccccgcctccatcgccgcccgcggctacatcagcacgcgggtggggatgggcgaggccgcggccatcttcatgaccgccacgccgcccgggtccgtcgaggccttcccgcagagcaacgccgtgatccaggacgaggagcgcgacatccccgagcggtcctggaacagcggctacgactggatcaccgacttccccggcaagacggtgtggttcgtcccctccatcaagagcgggaacgacatcgcgaactgcctgcgcaagaacggcaagcgggtgatccagctctcccgcaagaccttcgacaccgagtaccagaagaccaagaacaacgactgggactacgtggtcacgaccgacatcagcgagatgggggccaacttccgggccgaccgcgtgatcgacccgcggcgctgcctgaagcccgtgatcctgaaggacggccccgagcgggtcatcctcgccgggcccatgccggtgaccgtcgcgtccgccgcccagcgccggggccgcatcggccggaaccagaacaaggagggggaccagtacgtgtacatgggccagcccctgaacaacgacgaggaccacgcccactggaccgaggccaagatgctgctcgacaacatcaacacgcccgaggggatcatccccgcgctgttcgagccggagcgcaagaagtccgccgccatcgacggcgagtaccgcctgcgcggggaggcccgcaagaccttcgtggagctcatgcggcgcggcgacctgcccgtctggctgtcctacaaggtggccagcgagggcttccagtactccgaccggcgctggtgcttcgacggggagcggaacaaccaggtgctcgaggagaacatggacgtcgagatctggaccaaggagggcgagcgcaagaagctgcggccccgctggctggacgcgcggacctacagcgaccccctcgccctgcgcgagttcaaggagttcgccgccgggcggcgcagcgtgtccggcgacctgatcctcgagatcggcaagctgccgcagcacctgacgctccgggcccagaaggcgctggacaacctggtgatgctccacaacagcgagcagggcgggaaggcctaccgccacgccatggaggagctgcccgacaccatcgagaccctgatgctcctggccctgatcgcggtcctcaccgggggcgtgaccctgttcttcctgtccgggaagggcctcggcaagacgagcatcgggctgctgtgcgtgatggcctccagcgccctcctgtggatggcctccgtcgagccccactggatcgccgcgagcatcatcctggagttcttcctcatggtgctgctgatccccgagccggaccggcagcgcacgccccaggacaaccagctcgcctacgtggtcatcggcctgctgttcatgatcctcaccgtggccgccaacgagatggggctgctggagaccacgaagaaggacctcggcatcgggcacgtggccgcggagaaccaccaccacgccaccatgctggacgtcgacctgcggcccgcctccgcctggaccctctacgccgtggcgaccacgatcatcaccccgatgatgcgccacaccatcgagaacaccacggccaacatcagcctgaccgccatcgccaaccaggccgcgatcctgatgggcctcgacaagggctggcccatctccaagatggacatcggggtgcccctgctggccctcggctgctacagccaggtcaaccccctgaccctgaccgccgccgtgctcatgctggtggcgcactacgccatcatcgggccgggcctgcaggccaaggccacgcgggaggcccagaagcgcaccgcggccgggatcatgaagaaccccaccgtcgacggcatcgtggccatcgacctcgaccccgtggtctacgacgccaagttcgagaagcagctgggccagatcatgctgctcatcctgtgcacctcccagatcctgctcatgcgcacgacctgggccctgtgcgagagcatcaccctggcgaccgggcccctcacgaccctgtgggagggctccccggggaagttctggaacaccaccatcgccgtgagcatggccaacatcttccggggctcctacctggccggcgccgggctcgcgttcagcctgatgaagtccctgggcgggggccgccgggggacgggcgcccagggcgagaccctcggggagaagtggaagcgccagctgaaccagctgagcaagagcgagttcaacacctacaagcggtccggcatcatggaggtggaccgcagcgaggccaaggaggggctcaagcggggcgagaccacgaagcacgccgtctcccgcgggaccgcgaagctgcggtggttcgtggagcgcaacctggtgaagcccgagggcaaggtcatcgacctgggctgcgggcggggcgggtggagctactactgcgccggcctcaagaaggtgaccgaggtgaaggggtacaccaagggcggccccgggcacgaggagcccatcccgatggccacgtacggctggaacctggtcaagctgcactccgggaaggacgtgttcttcacgccgcccgagaagtgcgacaccctcctgtgcgacatcggcgagagctcccccaacccgaccatcgaggaggggcgcaccctgcgggtgctcaagatggtcgagccctggctgcgcggcaaccagttctgcatcaagatcctgaacccctacatgcccagcgtggtggagacgctcgagcagatgcagcggaagcacggcgggatgctggtccgcaacccgctgtcccggaacagcacccacgagatgtactgggtgtcctgcggcaccgggaacatcgtgagcgccgtcaacatgacctcccgcatgctcctgaaccggttcacgatgacccaccgcaagcccacctacgagcgcgacgtggacctgggcgccggcacccggcacgtggcggtcgagcccgaggtggccaacctcgacatcatcgggcagcgcatcgagaacatcaagaacgagcacaagagcacgtggcactacgacgaggacaacccctacaagacctgggcctaccacggctcctacgaggtgaagccgagcgggtccgccagctccatggtcaacggcgtggtccggctgctgaccaagccctgggacgtgatccccatggtgacccagatcgccatgacggacaccacccccttcgggcagcagcgcgtcttcaaggagaaggtggacacccggacgccgcgcgcgaagcggggcaccgcccagatcatggaggtgaccgccaagtggctctggggcttcctgagccgcaacaagaagccccggatctgcacccgcgaggagttcacgcggaaggtccgcagcaacgccgccatcggggcggtgttcgtggacgagaaccagtggaactccgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggcgaagggcagccgggccatctggtacatgtggctgggcgcccgcttcctcgagttcgaggccctggggttcatgaacgaggaccactggttctcccgggagaacagcctgtccggcgtcgagggggagggcctccacaagctggggtacatcctgcgcgacatcagcaagatccccggcggcaacatgtacgccgacgacaccaccgggtgggacacgcggatcaccgaggacgacctccagaacgaggcgaagatcaccgacatcatggagccggagcacgccctgctggccacctccatcttcaagctcacgtaccagaacaaggtggtgcgcgtccagcgccccgccaagagcggcaccgtgatggacgtgatctcccggcgcgaccagcgggggagcggccaggtcggcacctacgggctgaacaccttcacgaacatggaggtgcagctgatccgccagatggagtccgagggcatcttcctccccagcgagctggagacccccaacctggccgagcgggtgctcgactggctggagaagcacggggtcgagcgcctgaagcggatggcgatctccggcgacgactgcgtggtgaagccgaccgacgaccgcttcgccaccgccctcacggccctgaacgacatggggaaggtccggaaggacatcccccagtgggagcccagcaagggctggaacgactggcagcaggtccccttctgctcccaccacttccaccagctgatcatgaaggacggccgcgagatcgtggtcccgtgccggaaccaggacgagctcatggggcgcgcccgggtgagccagggcgcggggtggtccctgcgcgagaccgcctgcctgggcaagagctacgcccagatgtggcagctcatgtacttccaccggcgcgacctgcggctggccgccaacgcgatctgcagcgccgtgcccgtcgactgggtgcccacctcccgcaccacctggagcatccacgcccaccaccagtggatgacgaccgaggacatgctctccgtgtggaaccgggtctggatcgaggagaacccctggatggaggacaagacccacgtgagctcctgggaggacgtgccgtacctggggaagcgcgaggaccagtggtgcggcagcctgatcggcctcaccgcccgcgcgacgtgggccaccaacatccaggtcgccatcaaccaggtgcggcgcctgatcgggaacgagaactacctggactacatgacctccatgaagcggttcaagaacgagagcgaccccgagggcgccctctggtga

SEQ ID NO: 8910 - RNA, 9879 nt, synthetic construct
  misc_feature 1..9879: note = derived and/or modified CDS sequence (opt1) from DENV-1__JQ915072__SS-prME
  source 1..9879: mol_type = other RNA
agcgtgaccatgctgctcatgctgctgcccaccgtgctcaccttccacctgaccacccgcggcggggagccccacatgatcgtgagcaagcaggagcggggcaagagcctcctgttcaagacctccgccggggtgaacatgtgcacgctgatcgccatggacctgggcgagctctgcgacgacaccatgacctacaagtgcccccgcatcaccgagacggagcccgacgacgtggactgctggtgcaacgccaccgagacctgggtgacctacgggacgtgcagccagaccggcgagcaccggcgcgacaagcggtccgtggccctggcgccccacgtcggcctggggctcgagacccgcaccgagacgtggatgagctccgagggcgcctggcggcagatccagaaggtggagacctgggccctgcgccaccccgggttcaccgtgatcgccctgttcctcgcccacgccatcggcaccagcatcacgcagaaggggatcatcttcatcctgctgatgctcgtcaccccctccatggccatgcggtgcgtgggcatcggcaaccgcgacttcgtggaggggctgagcggcgcgacctgggtcgacgtggtgctggagcacgggtcctgcgtcaccacgatggccaaggacaagcccaccctcgacatcgagctgctgaagaccgaggtgaccaaccccgccgtgctccggaagctgtgcatcgaggccaagatcagcaacacgaccaccgactcccgctgcccgacccagggcgaggccacgctggtcgaggagcaggacaccaacttcgtgtgccggcgcaccttcgtggaccggggctgggggaacggctgcggcctcttcggcaaggggagcctgatcacgtgcgcgaagttcaagtgcgtcacgaagctggagggcaagatcgtgcagtacgagaacctcaagtactccgtgatcgtcaccgtgcacaccggcgaccagcaccaggtcgggaacgagaccaccgagcacggcacgatcgccaccatcacgccccaggcccccaccagcgagatccagctgacggactacggggccctgaccctcgactgcagcccccggaccggcctggacttcaacgagatggtgctgctcaccatgaaggagaagtcctggctggtgcacaagcagtggttcctggacctcccgctgccctggacgaccggggcctccaccagccaggagacctggaaccggcaggacctgctcgtcacgttcaagaccgcgcacgccaagaagcaggaggtggtggtcctgggcagccaggagggcgccatgcacaccgccctgaccggggccacggagatccagacctccggcaccaccacgatcttcgcggggcacctcaagtgccgcctgaagatggacaagctgaccctcaagggcatcagctacgtgatgtgcaccgggtccttcaagctggagaaggaggtggccgagacccagcacggcacggtcctggtccaggtgaagtacgagggcaccgacgccccctgcaagatccccttcagctcccaggacgagaagggggtcacccagaacggccggctggtgaccgccaacccgatcgtgacggacaaggagaagcccgtcaacatcgaggccgagccgcccttcggggagagctacatcgtggtgggcgcgggcgagaaggccctcaagctgtcctggttcaagaaggggagctccatcggcaagatgttcgaggccaccgcccgcggggcgcggcgcatggccatcctgggcgacaccgcctgggacttcgggagcatcggcggcgtcttcacctccgtggggaagctcgtgcaccagatcttcggcacggcctacggggtcctgttcagcggcgtgtcctggaccatgaagatcgggatcggcatcctgctcacctggctgggcctgaacagccgctccaccagcctctccatgacgtgcatcgccgtggggatggtcaccctgtacctgggcgtgatggtgcaggcggacagcgggtgcgtcatcaactggaagggccgggagctcaagtgcgggtccggcatcttcgtgaccaacgaggtgcacacctggaccgagcagtacaagttccaggccgacagcccgaagcgcctgagcgccgccatcggcaaggcctgggaggagggggtctgcggcatccggtccgcgacgcgcctggagaacatcatgtggaagcagatcagcaacgagctcaaccacatcctgctggagaacgacatgaagttcaccgtggtggtcggggacgtgtccggcatcctcgcccaggggaagaagaccatccggccccagcccatggagcacaagtacagctggaagtcctggggcaaggccaagatcatcggcgccgacgtgcagaacaccacgttcatcatcgacgggcccaacaccccggagtgccccgacgaccagcgcgcctggaacatctgggaggtcgaggactacggcttcgggatcttcaccaccaacatctggctgaagctgcgggacagctacacccaggtgtgcgaccaccgcctcatgtccgcggccatcaaggacagcaaggccgtgcacgccgacatgggctactggatcgagtccgagaagaacgagacgtggaagctggcgcgggccagcttcatcgaggtcaagacctgcgtgtggcccaagtcccacaccctgtggagcaacggcgtgctcgagtccgagatgatcatccccaagatctacgggggcccgatcagccagcacaactaccgccccgggtacttcacgcagaccgccggcccctggcacctggggaagctggagctcgacttcgacctgtgcgagggcaccaccgtcgtggtggacgagcactgcggccaccgggggccgtccctgcgcacgaccaccgtcaccggcaagatcatccacgagtggtgctgccggagctgcacgctgccgcccctgcgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggtcgtgttcctgctcctgaccctggggcagctcacgtggaacgacctgatccggctgtgcatcatggtcggcgccaacgcgagcgacaacatggggatgggcaccacctacctcgccctgatggccaccttccgcatgcgcccgatgttcgccgtgggcctcctcttccggcgcctgacgtcccgggaggtgctgctcctgaccgtcgggctgagcctcgtggcctccgtggagctgcccaacagcctggacgagctcggcgacgggctggcgatgggcatcatgatcctgaagctcctgaccgacttccagtcccaccagctgtgggccaccctcctgagcctgacgttcgtcaagaccaccctctccctgcactacgcctggaagaccatggccatgatcctgagcatcgtgtccctcctgcccctgtgcctcagcacgacctcccagaagaccacctggctgcccgtgctgctcggcagcctggggtgcaagccgctgaccatgttcctcatcacggagaacaagatctggggccgcaagtcctggcccctgaacgaggggatcatggccgtcggcatcgtgagcatcctgctcagctccctgctgaagaacgacgtgcccctcgcggggcccctgatcgccggcggcatgctgatcgcctgctacgtcatcagcgggtccagcgccgacctctccctggagaaggcggccaaggtgagctgggaggaggaggccgagcactccggcgccagccacaacatcctggtggagatccaggacgacgggaccatgaagatcaaggacgaggagcgggacgacaccatcaccatcctcctgaaggccacgctgctcgcgatctccggcgtctacccgatgagcatccccgccaccctgttcgtgtggcacttctggcagaagaagaagcagcgctccggggtgctgtgggacacccccagcccgcccgaggtcgagaaggccgtgctggacgacggcatctaccggatcctccagcgcggcctgctggggcggtcccaggtgggcgtcggggtgttccaggagggcgtgttccacaccatgtggcacgtcacgcgcggggccgtgctcatgtaccagggcaagcggctggagcccagctgggcctccgtgaagaaggacctgatcagctacggcgggggctggcgcttccaggggtcctggaacatgggcgaggaggtccaggtgatcgcggtggagcccgggaagaaccccaagaacgtccagaccgcccccggcaccttcaagaccagcgagggcgaggtgggggccatcgccctcgacttcaagcccggcacgtccgggagccccatcgtgaaccgggagggcaagatcgtcggcctgtacgggaacggcgtggtgaccaccagcgggacctacgtctccgccatcgcgcaggccaaggccagccaggagggccccctgccggagatcgaggacgaggtgttccgcaagcggaacctcacgatcatggacctgcaccccgggtccggcaagacccgccggtacctgcccgccatcgtgcgcgaggccatcaagcggaagctccgcaccctggtcctggcgccgacccgggtggtggccagcgagatggccgaggccctcaagggcatgcccatccgctaccagacgaccgcggtcaagtccgagcacaccgggaaggagatcgtggacctgatgtgccacgccaccttcacgatgcgcctgctcagccccgtgcgggtccccaactacaacatgatcatcatggacgaggcccacttcaccgacccggcctccatcgccgcgcgcggctacatcagcacccgggtggggatgggcgaggccgccgccatcttcatgaccgccacgccgcccgggtccgtggaggcgttcccccagagcaacgccgtcatccaggacgaggagaaggacatcccggagcgctcctggaacagcggctacgactggatcaccgacttccccggcaagaccgtgtggttcgtgccctccatcaagagcgggaacgacatcgccaactgcctgcggaagaacggcaagcgcgtcatccagctgtcccggaagaccttcgacacggagtaccagaagaccaagaacaacgactgggactacgtggtcaccaccgacatcagcgagatgggggccaacttccgcgccgaccgggtgatcgacccccgccggtgcctcaagccggtgatcctgaaggacggccccgagcgcgtcatcctggcggggcccatgcccgtgacggtggcctccgccgcccagcggcgcggccggatcggccgcaaccagaacaaggagggggaccagtacatctacatgggccagccgctcaacaacgacgaggaccacgcgcactggaccgaggccaagatgctgctggacaacatcaacacccccgaggggatcatccccgccctcttcgagcccgagcgggagaagtccgccgccatcgacggcgagtaccgcctgcgcggggaggcgcgcaagaccttcgtcgagctgatgcgccggggcgacctcccggtgtggctgtcctacaaggtggccagcgagggcttccagtacagcgaccgccggtggtgcttcgacggggagcgcaacaaccaggtcctggaggagaacatggacgtggagatctggacgaaggagggcgagcggaagaagctccgcccccggtggctggacgcccgcacctactccgaccccctggccctccgggagttcaaggagttcgccgcggggcgccggagcgtgtccggcgacctgatcctggagatcggcaagctcccccagcacctgacccagcgcgcccagaacgccctggacaacctcgtcatgctgcacaacagcgagcagggcgggaaggcctaccggcacgccatggaggagctgccggacaccatcgagaccatcatgctcctggcgctgatcgccgtgctcaccggcggggtgaccctgttcttcctgtccgggcgcgggctcggcaagaccagcatcgggctgctgtgcgtcacctccagctccgccctcctgtggatggccagcgtggagccccactggatcgcggcctccatcatcctggagttcttcctcatggtgctgctgatccccgagcccgaccggcagcgcacgccgcaggacaaccagctcgcctacgtcgtgatcggcctgctgttcatgatcctcaccgtggccgccaacgagatggggctgctggagaccaccaagaaggacctcggcatcgggcacacggcggccgagaaccaccaccacgccgccatgctggacgtcgacctgcaccccgccagcgcgtggaccctctacgccgtggccaccaccatcatcacgcccatgatgcggcacaccatcgagaacaccaccgccaacatctccctgacggccatcgcgaaccaggccgccatcctgatgggcctcgacaagggctggccgatcagcaagatggacatcggggtgcccctgctggccctcggctgctactcccaggtcaaccccctgaccctgaccgccgcggtgctcatgctggtggcccactacgccatcatcgggcccggcctgcaggccaaggcgacccgcgaggcccagaagcggacggccgccgggatcatgaagaacccgaccgtcgacggcatcgtggccatcgacctcgaccccgtggtctacgacgcgaagttcgagaagcagctgggccagatcatgctgctcatcctgtgcaccagccagatcctgctcatgcgcaccacgtgggccctgtgcgagtccatcaccctggccaccgggcccctcaccacgctgtgggagggcagccccgggaagttctggaacaccaccatcgccgtgtccatggccaacatcttccggggcagctacctggcgggcgccgggctcgccttcagcctgatgaagtccctgggcgggagccgccgcggcaccggggcccagggcgagacgctcggcgagaagtggaagcggcagctgaaccagctgtccaagagcgagttcaacatctacaagcgctccgggatcatcgaggtggaccggagcgaggccaaggagggcctcaagcgcggggagaccaccaagcacgcggtctcccggggcaccgccaagctgcgctggttcgtggagcggaacctggtgaagccggaggggaaggtcatcgacctgggctgcggccgcgggggctggagctactactgcgccgggctcaagaaggtgacggaggtgaagggctacaccaagggcgggcccggccacgaggagcccatccccatggccacctacgggtggaacctggtcaagctgcactccggcaaggacgtgttcttcatcccgcccgagaagtgcgacaccctcctgtgcgacatcggggagagctcccccaaccccaccatcgaggagggccggacgctgcgcgtgctcaagatggtcgagccgtggctgcgggggaaccagttctgcatcaagatcctgaacccctacatgcccagcgtggtggagaccctcgagcagatgcagcgcaagcacggcggcatgctggtccggaaccccctgtcccgcaacagcacccacgagatgtactgggtgtcctgcgggaccggcaacatcgtgagcgcggtcaacatgacgtcccggatgctcctgaaccgcttcaccatggcccaccggaagccgacctacgagcgcgacgtggacctgggggccggcacccggcacgtggccgtcgagcccgaggtggccaacctcgacatcatcggccagcgcatcgagaacatcaagaacgagcacaagagcacgtggcactacgacgaggacaacccctacaagacctgggcgtaccacgggtcctacgaggtcaagcccagcggcagcgcctccagcatggtgaacggggtggtccgcctgctgaccaagccgtgggacgtgatccccatggtgacccagatcgccatgacggacaccacccccttcggccagcagcgggtcttcaaggagaaggtggacacccgcacgcccaaggccaagcgggggaccgcccagatcatggaggtgaccgcgaagtggctctggggcttcctgtcccgcaacaagaagccgcggatctgcacccgcgaggagttcacgcggaaggtccgcagcaacgccgccatcggcgccgtgttcgtggacgagaaccagtggaactccgccaaggaggcggtcgaggacgagcggttctgggacctggtgcgccgggagcgcgagctccacaagcaggggaagtgcgcgacctgcgtgtacaacatgatgggcaagcgggagaagaagctgggggagttcggcaaggccaaggggagccgcgccatctggtacatgtggctgggcgcgcggttcctcgagttcgaggccctgggcttcatgaacgaggaccactggttctcccgcgagaacagcctgtccggggtcgagggcgaggggctccacaagctgggctacatcctgcgggacatcagcaagatccccgggggcaacatgtacgccgacgacaccgccggctgggacacccgcatcacggaggaggacctccagaacgaggccaagatcaccgacatcatggagcccgagcacgcgctgctggccacctccatcttcaagctcacctaccagaacaaggtggtgcgggtccagcgcccggccaagaacgggacggtgatggacgtgatcagccggcgcgaccagcgcggctccgggcaggtcggcacctacggcctgaacaccttcaccaacatggaggcccagctgatccggcagatggagagcgaggggatcttctcccccagcgagctcgagacgcccaacctggccggccgcgtgctggactggctcgagaagcacgggatcgagcggctgcgccggatggcgatctccggcgacgactgcgtggtcaagcccatcgacgaccgcttcgccaccgccctgaccgccctcaacgacatggggaaggtgcggaaggacatcccgcagtgggagcccagcaagggctggaacgactggcagcaggtccccttctgcagccaccacttccaccagctgatcatgaaggacggccgcgagatcgtcgtgccctgccggaaccaggacgagctggtggggcgcgcccgggtctcccagggcgcggggtggagcctccgcgagaccgcctgcctgggcaagtcctacgcccagatgtggcagctgatgtacttccaccggcgcgacctccggctggccgccaacgcgatctgcagcgccgtgccggtggactgggtccccacgtcccgcaccacctggagcatccacgcccaccaccagtggatgaccaccgaggacatgctgtccgtgtggaaccgggtgtggatcgaggagaacccctggatggaggacaagacgcacgtcagctcctgggaggacgtgccctacctcgggaagcgcgaggaccagtggtgcggcagcctgatcggcctgaccgcccgggcgacctgggccaccaacatccaggtggccatcaagcaggtccgccgcctcatcgggaacgagaactacctggactacatgacgtccatgaagcggttcaagaacgagagcgacccggagggcgccctgtggtga

SEQ ID NO: 8911 - RNA, 9879 nt, synthetic construct
  misc_feature 1..9879: note = derived and/or modified CDS sequence (opt1) from DENV-1__JQ915071__SS-prME
  source 1..9879: mol_type = other RNA
agcgtgaccatgctgctcatgctgctgcccaccgtgctcaccttccacctgaccacccggggcggggagccccacatgatcgtgagcaagcaggagcggggcaagagcctcctgttcaagacctccgccggggtgaacatgtgcaccctgatcgccatggacctgggcgagctctgcgacgacaccatgacctacaagtgcccccgcatcaccgagaccgagcccgacgacgtcgactgctggtgcaacgccaccgagacctgggtgacctacgggacgtgcagccagaccggcgagcaccggcgcgacaagcggtccgtggccctggcgccccacgtcggcctggggctcgagacccgcaccgagacgtggatgagctccgagggcgcctggcggcagatccagaaggtggagacctgggccctgcgccaccccgggttcaccgtgatcgcgctgttcctcgcccacgccatcggcaccagcatcacgcagaaggggatcatcttcatcctgctgatgctcgtcaccccctccatggccatgcggtgcgtgggcatcggcaaccgcgacttcgtggaggggctgagcggcgcgacctgggtcgacgtggtgctggagcacgggtcctgcgtcaccacgatggccaaggacaagcccaccctcgacatcgagctgctgaagaccgaggtgaccaaccccgccgtgctccggaagctgtgcatcgaggccaagatcagcaacacgaccaccgactcccgctgcccgacccagggcgaggccacgctggtcgaggagcaggacaccaacttcgtgtgccggcgcaccttcgtggaccggggctgggggaacggctgcggcctgttcggcaaggggagcctgatcacgtgcgcgaagttcaagtgcgccacgaagctggagggcaagatcgtccagtacgagaacctcaagtactccgtgatcgtgaccgtccacaccggcgaccagcaccaggtggggaacgagaccaccgagcacggcacgatcgccaccatcacgccccaggcccccaccagcgagatccagctgacggactacggggccctgaccctcgactgcagcccccggaccggcctggacttcaacgagatggtcctgctcaccatgaaggagaagtcctggctggtgcacaagcagtggttcctggacctcccgctgccctggacgaccggggcgtccaccagccaggagacctggaaccggcaggacctgctcgtgacgttcaagaccgcccacgccaagaagcaggaggtcgtggtgctgggcagccaggagggcgccatgcacaccgccctgaccggggcgacggagatccagacctccggcaccaccacgatcttcgccgggcacctcaagtgccgcctgaagatggacaagctgaccctcaagggcatcagctacgtcatgtgcaccgggtccttcaagctggagaaggaggtggccgagacccagcacggcacggtgctggtccaggtgaagtacgagggcaccgacgccccctgcaagatccccttcagctcccaggacgagaagggggtgacccagaacggccggctggtcaccgccaacccgatcgtgacggacaaggagcgccccgtgaacatcgaggcggagccgcccttcggggagagctacatcgtcgtgggcgccggcgagaaggccctcaagctgtcctggttcaagaaggggagctccatcggcaagatgttcgaggccaccgcgcgcggggcccgccgcatggccatcctgggcgacaccgcctgggacttcgggagcatcggcggcgtgttcacctccgtcgggaagctcgtgcaccagatcttcggcacggcctacggggtgctgttcagcggcgtctcctggaccatgaagatcgggatcggcatcctgctcacctggctgggcctgaacagccggtccaccagcctctccatgacgtgcatcgcggtggggatggtgaccctgtacctgggcgtcatggtgcaggccgacagcgggtgcgtgatcaactggaagggccgcgagctcaagtgcgggtccggcatcttcgtcaccaacgaggtgcacacctggaccgagcagtacaagttccaggccgacagcccgaagcggctgagcgccgccatcggcaaggcgtgggaggagggggtgtgcggcatccgctccgccacgcggctggagaacatcatgtggaagcagatcagcaacgagctcaaccacatcctgctggagaacgacatgaagttcaccgtcgtggtgggggacgtctccggcatcctcgcccaggggaagaagaccatccgcccccagcccatggagcacaagtacagctggaagtcctggggcaaggccaagatcatcggcgccgacgtgcagaacaccacgttcatcatcgacgggcccaacaccccggagtgccccgacgaccagcgggcgtggaacatctgggaggtggaggactacggcttcgggatcttcaccaccaacatctggctgaagctgcgcgacagctacacgcaggtctgcgaccaccggctcatgtccgccgccatcaaggacagcaaggccgtgcacgcggacatgggctactggatcgagtccgagaagaacgagacctggaagctggcccgcgccagcttcatcgaggtgaagacctgcgtctggcccaagtcccacaccctgtggagcaacggcgtgctcgagtccgagatgatcatccccaagatctacgggggcccgatcagccagcacaactaccggcccgggtacttcacgcagaccgccggcccctggcacctggggaagctggagctcgacttcgacctgtgcgagggcaccaccgtggtcgtggacgagcactgcggcaaccgcgggccgtccctgcggacgaccaccgtgaccggcaagatcatccacgagtggtgctgccgcagctgcacgctgccgcccctgcggttcaagggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcaccctggtggtcttcctgctcctgaccctggggcagctcacgtggaacgacctgatccgcctgtgcatcatggtgggcgcgaacgccagcgacaacatggggatgggcaccacctacctcgccctgatggccaccttccgcatgcggccgatgttcgccgtcgggctcctcttccgccggctgacgtcccgcgaggtgctgctcctgaccgtggggctgagcctcgtcgcctccgtggagctgcccaacagcctggacgagctcggcgacgggctggccatgggcatcatgatcctgaagctcctgaccgacttccagtcccaccagctgtgggccaccctcctgagcctgacgttcgtgaagaccaccctctccctgcactacgcctggaagaccatggccatgatcctgagcatcgtctccctcctgcccctgtgcctcagcacgacctcccagaagaccacctggctgcccgtgctgctcggcagcctggggtgcaagccgctgaccatgttcctcatcacggagaacaagatctggggccggaagtcctggcccctgaacgaggggatcatggcggtgggcatcgtcagcatcctgctcagctccctgctgaagaacgacgtgcccctcgccgggcccctgatcgccggcggcatgctgatcgcctgctacgtgatcagcgggtccagcgcggacctctccctggagaaggccgccaaggtcagctgggaggaggaggccgagcactccggcgccagccacaacatcctggtggagatccaggacgacgggaccatgaagatcaaggacgaggagcgcgacgacaccatcaccatcctcctgaaggcgacgctgctcgccatctccggcgtgtacccgatgagcatccccgccaccctgttcgtctggcacttctggcagaagaagaagcagcggtccggggtgctgtgggacacccccagcccgcccgaggtggagaaggccgtcctggacgacggcatctaccgcatcctccagcggggcctgctggggcgctcccaggtgggcgtgggggtcttccaggagggcgtgttccacaccatgtggcacgtgacgcgcggggccgtcctcatgtaccagggcaagcgcctggagcccagctgggcgtccgtgaagaaggacctgatcagctacggcgggggctggcggttccaggggtcctggaacaccggcgaggaggtgcaggtcatcgccgtggagcccgggaagaaccccaagaacgtgcagaccgcccccggcaccttcaagacgagcgagggcgaggtcggggccatcgccctcgacttcaagcccggcacctccgggagccccatcgtgaaccgcgagggcaagatcgtgggcctgtacgggaacggcgtcgtgaccaccagcgggacgtacgtgtccgcgatcgcccaggccaaggccagccaggagggccccctgccggagatcgaggacgaggtcttccggaagcgcaacctcaccatcatggacctgcaccccgggtccggcaagacccggcgctacctgcccgccatcgtgcgggaggcgatcaagcgcaagctccggaccctggtgctggccccgacgcgcgtcgtggccagcgagatggccgaggcgctcaagggcatgcccatccgctaccagaccaccgccgtgaagtccgagcacaccgggaaggagatcgtcgacctgatgtgccacgccacgttcaccatgcggctgctcagccccgtgcgcgtgcccaactacaacatgatcatcatggacgaggcccacttcaccgacccggcctccatcgcggcccggggctacatcagcacccgcgtcgggatgggcgaggccgccgccatcttcatgacggcgacgccgcccgggtccgtggaggccttcccccagagcaacgccgtgatccaggacgaggagaaggacatcccggagcggtcctggaacagcggctacgactggatcaccgacttccccggcaagaccgtctggttcgtgccctccatcaagagcgggaacgacatcgccaactgcctgcgcaagaacggcaagcgggtgatccagctgtcccgcaagacgttcgacaccgagtaccagaagaccaagaacaacgactgggactacgtcgtgaccacggacatcagcgagatgggggccaacttccgggcggaccgcgtcatcgacccccggcgctgcctcaagccggtgatcctgaaggacggccccgagcgggtgatcctggccgggcccatgcccgtcaccgtggcctccgccgcgcagcgccggggccgcatcggccggaaccagaacaaggagggggaccagtacatctacatgggccagccgctcaacaacgacgaggaccacgcccactggaccgaggccaagatgctgctggacaacatcaacacccccgaggggatcatccccgccctcttcgagcccgagcgcgagaagtccgccgcgatcgacggcgagtaccggctgcgcggggaggcccgcaagacgttcgtggagctgatgcggcgcggcgacctcccggtctggctgtcctacaaggtggccagcgagggcttccagtacagcgaccggcgctggtgcttcgacggggagcggaacaaccaggtgctggaggagaacatggacgtcgagatctggaccaaggagggcgagcgcaagaagctccggccccgctggctggacgcccggacctactccgaccccctggccctccgcgagttcaaggagttcgcggccgggcggcgcagcgtgtccagcgacctgatcctggagatcggcaagctcccccagcacctgacccagcgggcccagaacgccctggacaacctcgtgatgctgcacaactccgagcagggcgggaaggcctaccgccacgcgatggaggagctgccggacaccatcgagacgatcatgctcctggccctgatcgccgtcctcaccggcggggtgaccctgttcttcctgagcggccgggggctcggcaagacctccatcggcctgctgtgcgtgacgagctccagcgccctcctgtggatggcgaacgtcgagccccactggatcgccgcctccatcatcctggagttcttcctcatggtgctgctgatccccgagcccgaccgccagcggaccccgcaggacaaccagctcgcctacgtggtcatcgggctgctgttcatgatcctcaccgtggccgcgaacgagatgggcctgctggagaccacgaagaaggacctcgggatcggccacaccgccgccgagaaccaccaccacgccgccatgctggacgtggacctgcaccccgcgagcgcctggaccctctacgccgtcgccaccacgatcatcacccccatgatgcgccacaccatcgagaacaccacggccaacatctccctgaccgcgatcgccaaccaggccgccatcctgatggggctcgacaagggctggccgatcagcaagatggacatcggcgtgcccctgctggccctcgggtgctactcccaggtgaaccccctgaccctgaccgcggccgtcctcatgctggtggcccactacgccatcatcggccccgggctgcaggcgaaggccacgcgggaggcccagaagcgcaccgccgccggcatcatgaagaacccgaccgtggacgggatcgtcgcgatcgacctcgaccccgtggtgtacgacgccaagttcgagaagcagctgggccagatcatgctgctcatcctgtgcaccagccagatcctgctcatgcggacgacctgggccctgtgcgagtccatcaccctggccaccggccccctcacgaccctgtgggaggggagccccggcaagttctggaacaccaccatcgccgtctccatggcgaacatcttccgcgggagctacctggccggcgccggcctcgccttcagcctgatgaagtccctcgggggcgggcgccgggggacgggggcccagggcgagaccctcggcgagaagtggaagcgccagctgaaccagctgagcaagtccgagttcaacacctacaagcggagcgggatcatcgaggtggaccgctccgaggcgcgggagggcctcaagcgcggggagaccacgaagcacgccgtgagccggggcaccgccaagctgcgctggttcgtcgagcggaacctggtgaagccggaggggaaggtgatcgacctgggctgcggccgcgggggctggtcctactactgcgccgggctcaagaaggtcaccgaggtgaagggctacaccaagggcgggcccggccacgaggagcccatccccatggcgacctacgggtggaacctggtgaagctgcacagcggcaaggacgtcttcttcatcccgcccgagaagtgcgacacgctcctgtgcgacatcggggagtccagccccaaccccaccatcgaggagggccggaccctgcgcgtgctcaagatggtggagccgtggctgcgggggaaccagttctgcatcaagatcctgaacccctacatgccctccgtcgtggagaccctcgagcagatgcagcgcaagcacggcggcatgctggtgcggaaccccctgagccgcaactccacgcacgagatgtactgggtcagctgcgggaccggcaacatcgtgtccgccgtgaacatgaccagccggatgctcctgaaccgcttcaccatggcccaccggaagccgacgtacgagcgcgacgtcgacctgggggccggcacccgccacgtggccgtggagcccgaggtcgcgaacctcgacatcatcggccagcggatcgagaacatcaagaacgagcacaagtccacctggcactacgacgaggacaacccctacaagacctgggcctaccacgggagctacgaggtgaagccctccggcagcgccagctccatggtcaacggggtggtgcgcctgctgacgaagccgtgggacgtcatccccatggtgacccagatcgccatgaccgacaccacgcccttcggccagcagcgggtgttcaaggagaaggtcgacacccgcacccccaaggccaagcgggggaccgcgcagatcatggaggtgacggccaagtggctctggggcttcctgagccgcaacaagaagccgcggatctgcacccgcgaggagttcacccggaaggtgcgctccaacgccgccatcggcgccgtcttcgtggacgagaaccagtggaacagcgcgaaggaggccgtggaggacgagcggttctgggacctggtccgccgggagcgcgagctccacaagcaggggaagtgcgcgacctgcgtgtacaacatgatgggcaagcgggagaagaagctgggggagttcggcaaggccaaggggtcccgcgcgatctggtacatgtggctgggcgcccggttcctcgagttcgaggccctgggcttcatgaacgaggaccactggttcagccgcgagaactccctgagcggggtggagggcgaggggctccacaagctgggctacatcctgcgggacatctccaagatccccgggggcaacatgtacgccgacgacacggccggctgggacacccgcatcaccgaggaggacctccagaacgaggcgaagatcaccgacatcatggagcccgagcacgccctgctggccacgagcatcttcaagctcacctaccagaacaaggtcgtgcgggtgcagcgcccggccaagaacgggaccgtcatggacgtgatctcccgccgggaccagcgcggcagcggccaggtgggcacctacggcctgaacacgttcaccaacatggaggcccagctgatccggcagatggagtccgaggggatcttcagcccctccgagctcgagacccccaacctggcgggccgcgtcctggactggctcgagaagcacgggatcgagcggctgcgccggatggccatcagcggcgacgactgcgtggtgaagcccatcgacgaccgcttcgccaccgccctgacggccctcaacgacatggggaaggtccggaaggacatcccgcagtgggagccctccaagggctggaacgactggcagcaggtccccttctgcagccaccacttccaccagctgatcatgaaggacggccgcgagatcgtggtcccctgccggaaccaggacgagctggtggggcgcgcgcgggtgagccagggcgccgggtggtccctccgcgagaccgcctgcctgggcaagagctacgcccagatgtggcagctgatgtacttccaccggcgcgacctccggctggccgcgaacgccatctgctccgccgtcccggtggactgggtgcccaccagccgcaccacctggtccatccacgcccaccaccagtggatgacgaccgaggacatgctgagcgtctggaaccgggtgtggatcgaggagaacccctggatggaggacaagacccacgtgtccagctgggaggacgtcccctacctcgggaagcgcgaggaccagtggtgcggctccctgatcggcctgaccgcgcgcgccacgtgggccaccaacatccaggtggccatcaaccaggtgcggcgcctcatcgggaacgagaactacctggactacatgaccagcatgaagcggttcaagaacgagtccgacccggagggcgccctgtggtga

SEQ ID NO: 8912 - RNA, 9879 nt, synthetic construct
  misc_feature 1..9879: note = derived and/or modified CDS sequence (opt1) from DENV-1__JQ915073__SS-prME
  source 1..9879: mol_type = other RNA
agcgtgaccatgctgctcatgctgctgcccaccgtgctcaccttccacctgaccacccggggcggggagccccacatgatcgtgagcaagcaggagcggggcaagagcctcctgttcaagacctccgccggggtgaacatgtgcaccctgatcgccatggacctgggcgagctctgcgacgacaccatgacctacaagtgcccccgcatcaccgagaccgagcccgacgacgtggactgctggtgcaacgcgaccgagacctgggtgacctacgggacgtgcttccagaccggcgagcaccggcgcgacaagcggagcgtggccctggcgccccacgtcggcctggggctcgagacccgcaccgagacgtggatgtccagcgagggcgcctggcggcagatccagaaggtggagacctgggccctgcgccaccccgggttcaccgtgatcgcgctgttcctcgcccacgccatcggcacctccatcacgcagaaggggatcatcttcatcctgctgatgctcgtgacccccagcatggccatgcggtgcgtgggcatcggcaaccgcgacttcgtggaggggctgtccggcgcgacctgggtcgacgtggtgctggagcacgggagctgcgtcaccacgatggccaaggacaagcccaccctcgacatcgagctgctgaagaccgaggtgaccaaccccgccgtgctccggaagctgtgcatcgaggccaagatctccaacacgaccaccgacagccgctgcccgacccagggcgaggccacgctggtcgaggagcaggacaccaacttcgtgtgccggcgcaccttcgtggaccggggctgggggaacggctgcggcctcttcggcaaggggtccctgatcacgtgcgcgaagttcaagtgcgtcacgaagctggagggcaagatcgtgcagtacgagaacctcaagtacagcgtgatcgtcaccgtgcacaccggcgaccagcaccaggtcgggaacgagaccaccgagcacggcacgatcgccaccatcacgccccaggcccccacctccgagatccagctgacggactacggggccctgaccctcgactgcagcccccgcaccggcctggacttcaacgagatggtgctgctcaccatgaaggagaagtcctggctggtgcacaagcagtggttcctggacctcccgctgccctggacgaccggggccagcacctcccaggagacctggaaccggcaggacctgctcgtcacgttcaagaccgcgcacgccaagaagcaggaggtggtggtcctgggcagccaggagggcgccatgcacaccgccctgaccggggccacggagatccagaccagcggcaccaccacgatcttcgcggggcacctcaagtgccgcctgaagatggacaagctgaccctcaagggcatctcctacgtgatgtgcaccgggagcttcaagctggagaaggaggtggccgagacccagcacggcacggtcctggtccaggtgaagtacgagggcaccgacgccccctgcaagatccccttctccagccaggacgagaagggggtcacccagaacggccggctggtgaccgccaacccgatcgtgacggacaaggagaagcccgtcaacatcgaggccgagccgcccttcggggagtcctacatcgtggtgggcgcgggcgagaaggccctcaagctgagctggttcaagaaggggtccagcatcggcaagatgttcgaggccaccgcccgcggggcgcggcgcatggccatcctgggcgacaccgcctgggacttcgggtccatcggcggcgtcttcaccagcgtggggaagctcgtgcaccagatcttcggcacggcctacggggtcctgttctccggcgtgagctggaccatgaagatcgggatcggcatcctgctcacctggctgggcctgaactcccgcagcacctccctcagcatgacgtgcatcgccgtggggatggtcaccctgtacctgggcgtgatggtgcaggcggactccgggtgcgtcatcaactggaagggccgggagctcaagtgcgggagcggcatcttcgtgaccaacgaggtgcacacctggaccgagcagtacaagttccaggccgactccccgaagcgcctgagcgccgccatcggcaaggcctgggaggagggggtctgcggcatccggagcgcgacgcgcctggagaacatcatgtggaagcagatctccaacgagctcaaccacatcctgctggagaacgacatgaagttcaccgtggtggtcggggacgtgagcggcatcctcgcccaggggaagaagaccatccggccccagcccatggagcacaagtactcctggaagtcctggggcaaggccaagatcatcggcgccgacgtgcagaacaccacgttcatcatcgacgggcccaacaccccggagtgccccgacgaccagcgcgcctggaacatctgggaggtcgaggactacggcttcgggatcttcaccaccaacatctggctgaagctgcgggactcctacacccaggtgtgcgaccaccgcctcatgagcgcggccatcaaggactccaaggccgtgcacgccgacatgggctactggatcgagagcgagaagaacgagacctggaagctggcgcgggcctccttcatcgaggtcaagacctgcgtgtggcccaagagccacaccctgtggtccaacggcgtgctcgagagcgagatgatcatccccaagatctacgggggcccgatctcccagcacaactaccgccccgggtacttcacgcagaccgccggcccctggcacctggggaagctggagctcgacttcgacctgtgcgagggcaccaccgtcgtggtggacgagcactgcggccaccgggggccgagcctgcgcacgaccaccgtcaccggcaagatcatccacgagtggtgctgccggtcctgcacgctgccgcccctgcgcttcaagggggaggacggctgctggtacgggatggagatccggcccgtgaaggagaaggaggagaacctggtcaagagcatggtctccgccggcagcggcgaggtggacagcttctccctcgggctgctgtgcatcagcatcatgatcgaggaggtgatgcgctcccggtggagccgcaagatgctcatgaccggcaccctggtcgtgttcctgctcctgaccctggggcagctcacgtggaacgacctgatccggctgtgcatcatggtcggcgccaacgcgtccgacaacatggggatgggcacgacctacctcgccctgatggccaccttccgcatgcgcccgatgttcgccgtggggctcctcttccggcgcctgacgagccgggaggtgctgctcctgaccgtcgggctgtccctcgtggccagcgtggagctgcccaactccctggacgagctcggcgacgggctggccatgggcatcatgatcctgaagctcctgaccgacttccagagccaccagctgtgggccaccctcctgtccctgacgttcgtcaagaccaccctcagcctgcactacgcctggaagaccatggccatgatcctgtccatcgtgagcctcctgcccctgtgcctctccacgaccagccagaagaccacctggctgcccgtgctgctcggctccctggggtgcaagccgctgaccatgttcctcatcacggagaacaagatctggggccgcaagagctggcccctgaacgaggggatcatggccgtcggcatcgtgtccatcctgctcagcagcctgctgaagaacgacgtgcccctcgcggggcccctgatcgccggcggcatgctgatcgcctgctacgtcatctccgggagctccgccgacctcagcctggagaaggcggccaaggtgtcctgggaggaggaggccgagcacagcggcgcctcccacaacatcctggtggagatccaggacgacgggaccatgaagatcaaggacgaggagcgggacgacaccatcaccatcctcctgaaggccacgctgctcgcgatcagcggcgtctacccgatgtccatccccgccaccctgttcgtgtggcacttctggcagaagaagaagcagcgcagcggggtgctgtgggacacccccagcccgcccgaggtcgagaaggccgtgctggacgacggcatctaccggatcctccagcgcggcctgctggggcggagccaggtgggcgtcggggtgttccaggagggcgtgttccacaccatgtggcacgtcacgcgcggggccgtgctcatgtaccagggcaagcggctggagccctcctgggccagcgtgaagaaggacctgatctcctacggcgggggctggcgcttccaggggagctggaacaccggcgaggaggtccaggtgatcgcggtggagcccgggaagaaccccaagaacgtccagaccacccccggcacgttcaagacctccgagggcgaggtgggggccatcgccctcgacttcaagcccggcaccagcgggtcccccatcgtgaaccgggagggcaagatcgtcggcctgtacgggaacggcgtggtgaccacgagcgggacctacgtcagcgccatcgcccaggcgaaggcctcccaggagggccccctgccggagatcgaggacgaggtgttccgcaagcggaacctcaccatcatggacctgcaccccgggagcggcaagacccgccggtacctgcccgccatcgtgcgcgaggccatcaagcggaagctccgcacgctggtcctggccccgacccgggtggtggcgtccgagatggccgaggccctcaagggcatgcccatccgctaccagaccaccgccgtcaagagcgagcacacggggaaggagatcgtggacctgatgtgccacgcgaccttcaccatgcgcctgctctcccccgtgcgggtccccaactacaacatgatcatcatggacgaggcccacttcaccgacccggccagcatcgccgcccgcggctacatctccacgcgggtggggatgggcgaggcggccgccatcttcatgaccgccacgccgcccgggagcgccgaggcgttcccccagtccaacgccgtgatccaggacgaggagaaggacatcccggagcgcagctggaactccggctacgactggatcaccgacttccccggcaagacggtctggttcgtgcccagcatcaagtccgggaacgacatcgccaactgcctgcggaagaacggcaagcgcgtgatccagctgagccggaagaccttcgacaccgagtaccagaagaccaagaacaacgactgggactacgtcgtgacgaccgacatctccgagatgggggccaacttccgcgccgaccgggtcatcgacccccgccggtgcctcaagccggtgatcctgaaggacggccccgagcgcgtgatcctggcggggcccatgcccgtcaccgtggccagcgccgcccagcggcgcggccggatcggccgcaaccagaacaaggagggggaccagtacatctacatgggccagccgctcaacaacgacgaggaccacgcgcactggaccgaggccaagatgctgctggacaacatcaacacgcccgaggggatcatccccgccctcttcgagcccgagcgggagaagtccgccgccatcgacggcgagtaccgcctgcgcggggaggcgcgcaagaccttcgtggagctgatgcgccggggcgacctcccggtctggctgagctacaaggtggcctccgagggcttccagtacagcgaccgccggtggtgcttcgacggggagcgcaacaaccaggtgctggaggagaacatggacgtcgagatctggaccaaggagggcgagcggaagaagctccgcccccggtggctggacgcccgcacctacagcgaccccctggccctccgggagttcaaggagttcgccgcggggcgccggtccgtgagcggcgacctgatcctggagatcggcaagctcccccagcacctgacccagcgcgcccagaacgccctggacaacctcgtgatgctgcacaactccgagcagggcgggaaggcctaccggcacgccatggaggagctgccggacacgatcgagaccatcatgctcctggcgctgatcgccgtcctcaccgggggcgtgaccctgttcttcctgagcgggcgcggcctcggcaagacgtccatcgggctgctgtgcgtgaccagctccagcgccctcctgtggatggcctccgtcgagccccactggatcgcggccagcatcatcctggagttcttcctcatggtgctgctgatccccgagcccgaccggcagcgcaccccgcaggacaaccagctcgcctacgtggtcatcggcctgctgttcatgatcctcaccgtggccgccaacgagatggggctgctggagacgaccaagaaggacctcggcatcgggcacaccgcggccgagaaccaccaccacgccgccatgctggacgtggacctgcaccccgcctccgcgtggaccctctacgccgtcgccacgaccatcatcacccccatgatgcggcacaccatcgagaacacgaccgccaacatcagcctgaccgccatcgcgaaccaggccgccatcctgatgggcctcgacaagggctggccgatctccaagatggacatcggggtgcccctgctggccctcggctgctacagccaggtgaaccccctgaccctgacggccgcggtcctcatgctggtggcccactacgccatcatcgggcccggcctgcaggccaaggcgacccgcgaggcccagaagcggaccgccgccgggatcatgaagaacccgaccgtggacggcatcgtcgccatcgacctcgaccccgtggtgtacgacgcgaagttcgagaagcagctgggccagatcatgctgctcatcctgtgcacgtcccagatcctgctcatgcgcaccacctgggccctgtgcgagagcatcaccctggccacggggcccctcaccaccctgtgggagggctcccccgggaagttctggaacaccacgatcgccgtcagcatggccaacatcttccggggctcctacctggcgggcgccgggctcgccttcagcctgatgaagtccctgggcgggggccgccgcgggaccggcgcccagggcgagaccctcggggagaagtggaagcggcagctgaaccagctgtccaagagcgagttcaacacctacaagcgctccggcatcatcgaggtggaccggagcgaggccaaggaggggctcaagcgcggcgagacgaccaagcacgcggtgtcccgggggaccgccaagctgcgctggttcgtcgagcggaacctggtgaagccggagggcaaggtgatcgacctgggctgcgggcgcggcgggtggagctactactgcgccggcctcaagaaggtcaccgaggtgaaggggtacaccaagggcggccccgggcacgaggagcccatccccatggccacgtacggctggaacctggtgaagctgcactccgggaaggacgtcttcttcatcccgcccgagaagtgcgacaccctcctgtgcgacatcggcgagagctcccccaaccccaccatcgaggaggggcggaccctgcgcgtgctcaagatggtggagccgtggctgcggggcaaccagttctgcatcaagatcctgaacccctacatgcccagcgtcgtggagacgctcgagcagatgcagcgcaagcacggcgggatgctggtgcggaaccccctgtcccgcaacagcacccacgagatgtactgggtctcctgcggcaccgggaacatcgtgagcgcggtgaacatgacctcccggatgctcctgaaccgcttcacgatggcccaccggaagccgacctacgagcgcgacgtcgacctgggcgccggcacccggcacgtggccgtggagcccgaggtcgccaacctcgacatcatcgggcagcgcatcgagaacatcaagaacgagcacaagagcacctggcactacgacgaggacaacccctacaagacgtgggcgtaccacggctcctacgaggtgaagcccagcgggtccgccagcagcatggtcaacggcgtggtgcgcctgctgaccaagccgtgggacgtcatccccatggtgacccagatcgccatgaccgacacgacccccttcgggcagcagcgggtgttcaaggagaaggtcgacacccgcacccccaaggccaagcggggcacggcccagatcatggaggtgaccgcgaagtggctctggggcttcctgtcccgcaacaagaagccgcggatctgcacccgcgaggagttcacccggaaggtgcgcagcaacgccgccatcggggccgtcttcgtggacgagaaccagtggaactccgccaaggaggcggtggaggacgagcggttctgggacctggtccgccgggagcgcgagctccacaagcagggcaagtgcgccacgtgcgtgtacaacatgatggggaagcgggagaagaagctgggcgagttcgggaaggccaagggcagccgcgccatctggtacatgtggctgggcgcgcggttcctcgagttcgaggccctggggttcatgaacgaggaccactggttctcccgcgagaacagcctgtccggcgtggagggggagggcctccacaagctggggtacatcctgcgggacatcagcaagatccccggcggcaacatgtacgccgacgacaccgccgggtgggacacccgcatcaccgaggaggacctccagaacgaggccaagatcacggacatcatggagcccgagcacgcgctgctggccacctccatcttcaagctcacctaccagaacaaggtcgtgcgggtgcagcgcccggccaagaacggcaccgtcatggacgtgatcagccggcgcgaccagcgcgggtccggccaggtgggcacgtacgggctgaacaccttcaccaacatggaggcccagctgatccggcagatggagagcgagggcatcttctcccccagcgagctcgagacccccaacctggccgggcgcgtcctggactggctcgagaagcacggcatcgagcggctgcgccggatggcgatctccggggacgactgcgtggtgaagcccatcgacgaccgcttcgccacggccctgaccgccctcaacgacatgggcaaggtccggaaggacatcccgcagtgggagcccagcaagggctggaacgactggcagcaggtccccttctgctcccaccacttccaccagctgatcatgaaggacgggcgcgagatcgtggtcccctgccggaaccaggacgagctggtgggccgcgcccgggtgagccagggggcgggctggagcctccgcgagaccgcctgcctggggaagtcctacgcccagatgtggcagctgatgtacttccaccggcgcgacctccggctggccgccaacgcgatctgcagcgccgtcccggtggactgggtgcccacctcccgcaccacgtggagcatccacgcccaccaccagtggatgaccaccgaggacatgctgtccgtctggaaccgggtgtggatcgaggagaacccctggatggaggacaagacccacgtgagctcctgggaggacgtcccctacctcggcaagcgcgaggaccagtggtgcggcagcctgatcgggctgacggcccgggcgacctgggccaccaacatccaggtggccatcaaccaggtgcgccgcctcatcggcaacgagaactacctggactacatgacctccatgaagcggttcaagaacgagagcgacccggagggggccctgtggtga

SEQ ID NO: 8913 - RNA, 9879 nt, synthetic construct
  misc_feature 1..9879: note = derived and/or modified CDS sequence (opt1) from DENV-1__JQ915075__SS-prME
  source 1..9879: mol_type = other RNA
agcgtgaccatgctgctcatgctgctgcccaccgtgctcaccttccacctgaccacccggggcggggagccccacatgatcgtgagcaagcaggagcggggcaagagcctcctgttcaagacctccgccggggtgaacatgtgcaccctgatcgccatggacctgggcgagctctgcgacgacaccatgacctacaagtgcccccgcatcaccgagacggagcccgacgacgtcgactgctggtgcaacgccaccgagacctgggtgacctacgggacgtgcagccagaccggcgagcaccggcgcgacaagcggtccgtggccctggcgccccacgtcggcctggggctcgagacccgcaccgagacgtggatgagctccgagggcgcctggcggcagatccagaaggtggagacctgggccctgcgccaccccgggttcaccgtgatcgcgctgttcctcgcccacgccatcggcaccagcatcacgcagaaggggatcatcttcatcctgctgatgctcgtcaccccctccatggccatgcggtgcgtgggcatcggcaaccgcgacttcgtggaggggctgagcggcgcgacctgggtcgacgtggtgctggagcacgggtcctgcgtcaccacgatggccaaggacaagcccaccctcgacatcgagctgctgaagaccgaggtgaccaaccccgccgtgctccggaagctgtgcatcgaggccaagatcagcaacacgaccaccgactcccgctgcccgacccagggcgaggccacgctggtcgaggagcaggacaccaacttcgtgtgccggcgcaccttcgtggaccggggctgggggaacggctgcggcctgttcggcaaggggagcctgatcacgtgcgcgaagttcaagtgcgccacgaagctggagggcaagatcgtccagtacgagaacctcaagtactccgtgatcgtgaccgtccacaccggcgaccagcaccaggtggggaacgagaccaccgagcacggcacgatcgccaccatcacgccccaggcccccaccagcgagatccagctgacggactacggggccctgaccctcgactgcagcccccggaccggcctggacttcaacgagatggtcctgctcaccatgaaggagaagtcctggctggtgcacaagcagtggttcctggacctcccgctgccctggacgaccggggcgtccaccagccaggagacctggaaccggcaggacctgctcgtgacgttcaagaccgcccacgccaagaagcaggaggtcgtggtgctgggcagccaggagggcgccatgcacaccgccctgaccggggcgacggagatccagacctccggcaccaccacgatcttcgccgggcacctcaagtgccgcctgaagatggacaagctgaccctcaagggcatcagctacgtcatgtgcaccgggtccttcaagctggagaaggaggtggccgagacccagcacggcacggtgctggtccaggtgaagtacgagggcaccgacgccccctgcaagatccccttcagctcccaggacgagaagggggtgacccagaacggccggctggtcaccgccaacccgatcgtgacggacaaggagcgccccgtgaacatcgaggcggagccgcccttcggggagagctacatcgtcgtgggcgccggcgagaaggccctcaagctgtcctggttcaagaaggggagctccatcggcaagatgttcgaggccaccgcgcgcggggcccgccgcatggccatcctgggcgacaccgcctgggacttcgggagcatcggcggcgtgttcacctccgtcgggaagctcgtgcaccagatcttcggcacggcctacggggtgctgttcagcggcgtctcctggaccatgaagatcgggatcggcatcctgctcacctggctgggcctgaacagccggtccaccagcctctccatgacgtgcatcgcggtggggatggtgaccctgtacctgggcgtcatggtgcaggccgacagcgggtgcgtgatcaactggaagggccgcgagctcaagtgcgggtccggcatcttcgtcaccaacgaggtgcacacctggaccgagcagtacaagttccaggccgacagcccgaagcggctgagcgccgccatcggcaaggcgtgggaggagggggtgtgcggcatccgctccgccacgcggctggagaacatcatgtggaagcagatcagcaacgagctcaaccacatcctgctggagaacgacatgaagttcaccgtcgtggtgggggacgtctccggcatcctcgcccaggggaagaagaccatccgcccccagcccatggagcacaagtacagctggaagtcctggggcaaggccaagatcatcggcgccgacgtgcagaacaccacgttcatcatcgacgggcccaacaccccggagtgccccgacgaccagcgggcgtggaacatctgggaggtggaggactacggcttcgggatcttcaccaccaacatctggctgaagctgcgcgacagctacacgcaggtctgcgaccaccggctcatgtccgccgccatcaaggacagcaaggccgtgcacgcggacatgggctactggatcgagtccgagaagaacgagacctggaagctggcccgcgccagcttcatcgaggtgaagacctgcgtctggcccaagtcccacaccctgtggagcaacggcgtgctcgagtccgagatgatcatccccaagatctacgggggcccgatcagccagcacaactaccggcccgggtacttcacgcagaccgccggcccctggcacctggggaagctggagctcgacttcgacctgtgcgagggcaccaccgtggtcgtggacgagcactgcggcaaccgcgggccgtccctgcggacgaccaccgtgaccggcaagatcatccacgagtggtgctgccgcagctgcacgctgccgcccctgcggttcaagggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcaccctggtggtcttcctgctcctgaccctggggcagctcacgtggaacgacctgatccgcctgtgcatcatggtgggcgcgaacgccagcgacaacatggggatgggcaccacctacctcgccctgatggccaccttccgcatgcggccgatgttcgccgtcgggctcctcttccgccggctgacgtcccgcgaggtgctgctcctgaccgtggggctgagcctcgtcgcctccgtggagctgcccaacagcctggacgagctcggcgacgggctggccatgggcatcatgatcctgaagctcctgaccgacttccagtcccaccagctgtgggccaccctcctgagcctgacgttcgtgaagaccaccctctccctgcactacgcctggaagaccatggccatgatcctgagcatcgtctccctcttccccctgtgcctgagcacgacctcccagaagaccacctggctccccgtgctgctgggcagcctcgggtgcaagccgctgaccatgttcctgatcacggagaacaagatctggggccggaagtcctggcccctcaacgaggggatcatggcggtgggcatcgtcagcatcctgctgagctccctcctgaagaacgacgtgcccctggccgggcccctcatcgccggcggcatgctgatcgcctgctacgtgatcagcgggtccagcgcggacctgtccctcgagaaggccgccaaggtcagctgggaggaggaggccgagcactccggcgccagccacaacatcctggtggagatccaggacgacgggaccatgaagatcaaggacgaggagcgcgacgacaccatcaccatcctgctcaaggcgacgctgctggccatctccggcgtgtacccgatgagcatccccgccaccctcttcgtctggcacttctggcagaagaagaagcagcggtccggggtgctgtgggacacccccagcccgcccgaggtggagaaggccgtcctggacgacggcatctaccgcatcctgcagcggggcctcctggggcgctcccaggtgggcgtgggggtcttccaggagggcgtgttccacaccatgtggcacgtgacgcgcggggccgtcctgatgtaccagggcaagcgcctcgagcccagctgggcgtccgtgaagaaggacctgatcagctacggcgggggctggcggttccaggggtcctggaacaccggcgaggaggtgcaggtcatcgccgtggagcccgggaagaaccccaagaacgtgcagaccgcccccggcatcttcaagaccagcgagggcgaggtcggggccatcgccctggacttcaagcccggcacgtccgggagccccatcgtgaaccgcgagggcaagatcgtgggcctctacgggaacggcgtcgtgaccaccagcgggacctacgtgtccgcgatcgcccaggccaaggccagccaggagggccccctgccggagatcgaggacgaggtcttccggaagcgcaacctgacgatcatggacctccaccccgggtccggcaagacccggcgctacctgcccgccatcgtgcgggaggcgatcaagcgcaagctgcggaccctcgtgctggccccgacccgcgtcgtggccagcgagatggccgaggcgctgaagggcatgcccatccgctaccagacgaccgccgtgaagtccgagcacaccgggaaggagatcgtcgacctcatgtgccacgccaccttcacgatgcggctgctgagccccgtgcgcgtgcccaactacaacatgatcatcatggacgaggcccacttcaccgacccggcctccatcgcggcccggggctacatcagcacccgcgtcgggatgggcgaggccgccgccatcttcatgaccgcgacgccgcccgggtccgtggaggccttcccccagagcaacgccgtgatccaggacgaggagaaggacatcccggagcggtcctggaacagcggctacgactggatcaccgacttccccggcaagaccgtctggttcgtgccctccatcaagagcgggaacgacatcgccaactgcctccgcaagaacggcaagcgggtgatccagctgtcccgcaagaccttcgacacggagtaccagaagaccaagaacaacgactgggactacgtcgtgaccaccgacatcagcgagatgggggccaacttccgggcggaccgcgtcatcgacccccggcgctgcctgaagccggtgatcctcaaggacggccccgagcgggtgatcctggccgggcccatgcccgtcacggtggcctccgccgcgcagcgccggggccgcatcggccggaaccagaacaaggagggggaccagtacatctacatgggccagccgctgaacaacgacgaggaccacgcccactggaccgaggccaagatgctcctggacaacatcaacacccccgaggggatcatccccgccctgttcgagcccgagcgcgagaagtccgccgcgatcgacggcgagtaccggctccgcggggaggcccgcaagaccttcgtggagctgatgcggcgcggcgacctgccggtctggctctcctacaaggtggccagcgagggcttccagtacagcgaccggcgctggtgcttcgacggggagcggaacaaccaggtgctggaggagaacatggacgtcgagatctggacgaaggagggcgagcgcaagaagctgcggccccgctggctcgacgcccggacctactccgaccccctggccctgcgcgagttcaaggagttcgcggccgggcggcgcagcgtgtccagcgacctcatcctggagatcggcaagctgccccagcacctcacccagcgggcccagaacgccctggacaacctggtgatgctccacaactccgagcagggcgggaaggcctaccgccacgcgatggaggagctgccggacaccatcgagaccatcatgctgctcgccctgatcgccgtcctgacgggcggggtgaccctcttcttcctgagcggccgggggctgggcaagacctccatcggcctcctgtgcgtgaccagctccagcgccctgctctggatggcgaacgtcgagccccactggatcgccgcctccatcatcctggagttcttcctgatggtgctcctgatccccgagcccgaccgccagcggacgccgcaggacaaccagctggcctacgtggtcatcgggctcctgttcatgatcctgaccgtggccgcgaacgagatgggcctcctggagaccaccaagaaggacctggggatcggccacacggccgccgagaaccaccaccacgccgccatgctcgacgtggacctgcaccccgcgagcgcctggaccctgtacgccgtcgccaccaccatcatcacgcccatgatgcgccacaccatcgagaacaccaccgccaacatctccctcacggcgatggccaaccaggccgccatcctgatggggctggacaagggctggccgatcagcaagatggacatcggcgtgcccctcctggccctggggtgctactcccaggtgaaccccctcaccctgaccgcggccgtcctgatgctcgtggcccactacgccatcatcggccccgggctgcaggcgaaggccacccgggaggcccagaagcgcacggccgccggcatcatgaagaacccgaccgtggacgggatcgtcgcgatcgacctggaccccgtggtgtacgacgccaagttcgagaagcagctcggccagatcatgctgctgatcctctgcaccagccagatcctgctgatgcggaccacgtgggccctctgcgagtccatcaccctggccaccggccccctgaccacgctctgggaggggagccccggcaagttctggaacaccaccatcgccgtctccatggcgaacatcttccgcgggagctacctggccggcgccggcctggccttcagcctcatgaagtccctcgggggcgggcgccgggggaccggggcccagggcgagacgctgggcgagaagtggaagcgccagctcaaccagctgagcaagtccgagttcaacacctacaagcggagcgggatcatcgaggtggaccgctccgaggcgcgggagggcctgaagcgcggggagaccaccaagcacgccgtgagccggggcacggccaagctccgctggttcgtcgagcggaacctggtgaagccggaggggaaggtgatcgacctgggctgcggccgcgggggctggtcctactactgcgccgggctgaagaaggtcaccgaggtgaagggctacaccaagggcgggcccggccacgaggagcccatccccatggcgacctacgggtggaacctcgtgaagctgcacagcggcaaggacgtcttcttcatcccgcccgagaagtgcgacaccctgctctgcgacatcggggagtccagccccaaccccacgatcgaggagggccggaccctgcgcgtgctgaagatggtggagccgtggctccgggggaaccagttctgcatcaagatcctgaacccctacatgccctccgtcgtggagaccctggagcagatgcagcgcaagcacggcggcatgctcgtgcggaaccccctgagccgcaactccacccacgagatgtactgggtcagctgcgggacgggcaacatcgtgtccgccgtgaacatgaccagccggatgctgctcaaccgcttcaccatggcccaccggaagccgacctacgagcgcgacgtcgacctgggggccggcacgcgccacgtggccgtggagcccgaggtcgcgaacctggacatcatcggccagcggatcgagaacatcaagaacgagcacaagtccacctggcactacgacgaggacaacccctacaagacctgggcctaccacgggagctacgaggtgaagccctccggcagcgccagctccatggtcaacggggtggtgcgcctcctgaccaagccgtgggacgtcatccccatggtgacgcagatcgccatgaccgacaccacccccttcggccagcagcgggtgttcaaggagaaggtcgacacgcgcacccccaaggccaagcgggggaccgcgcagatcatggaggtgaccgccaagtggctgtggggcttcctcagccgcaacaagaagccgcggatctgcacgcgcgaggagttcacccggaaggtgcgctccaacgccgccatcggcgccgtcttcgtggacgagaaccagtggaacagcgcgaaggaggccgtggaggacgagcggttctgggacctggtccgccgggagcgcgagctgcacaagcaggggaagtgcgcgacctgcgtgtacaacatgatgggcaagcgggagaagaagctcggggagttcggcaaggccaaggggtcccgcgcgatctggtacatgtggctgggcgcccggttcctggagttcgaggccctcggcttcatgaacgaggaccactggttcagccgcgagaactccctgagcggggtggagggcgaggggctgcacaagctcggctacatcctgcgggacatctccaagatccccgggggcaacatgtacgccgacgacaccgccggctgggacacgcgcatcaccgaggaggacctgcagaacgaggcgaagatcaccgacatcatggagcccgagcacgccctcctggccaccagcatcttcaagctgacgtaccagaacaaggtcgtgcgggtgcagcgcccggccaagaacgggaccgtcatggacgtgatctcccgccgggaccagcgcggcagcggccaggtgggcacctacggcctcaacaccttcacgaacatggaggcccagctgatccggcagatggagtccgaggggatcttcagcccctccgagctggagacccccaacctcgcgggccgcgtcctggactggctggagaagcacgggatcgagcggctccgccggatggccatcagcggcgacgactgcgtggtgaagcccatcgacgaccgcttcgccaccgccctgaccgccctgaacgacatggggaaggtccggaaggacatcccgcagtgggagccctccaagggctggaacgactggcagcaggtccccttctgcagccaccacttccaccagctcatcatgaaggacggccgcgagatcgtggtcccctgccggaaccaggacgagctggtggggcgcgcgcgggtgagccagggcgccgggtggtccctgcgcgagacggcctgcctcggcaagagctacgcccagatgtggcagctgatgtacttccaccggcgcgacctgcggctcgccgcgaacgccatctgctccgccgtcccggtggactgggtgcccaccagccgcaccacctggtccatccacgcccaccaccagtggatgaccacggaggacatgctgagcgtctggaaccgggtgtggatcgaggagaacccctggatggaggacaagacccacgtgtccagctgggaggacgtcccctacctggggaagcgcgaggaccagtggtgcggctccctcatcggcctgaccgcgcgcgccacctgggccacgaacatccaggtggccatcaaccaggtgcggcgcctgatcgggaacgagaactacctcgactacatgaccagcatgaagcggttcaagaacgagtccgacccggagggcgccctgtggtga

SEQ ID NO: 8914 - RNA, 9879 nt, synthetic construct
  misc_feature 1..9879: note = derived and/or modified CDS sequence (opt1) from DENV-1__JQ915076__SS-prME
  source 1..9879: mol_type = other RNA
agcgtgaccatgctgctcatgctgctgcccaccgtgctcaccttccacctgaccacccgcggcggggagccccacatgatcgtgagcaagcaggagcggggcaagagcctcctgttcaagacctccgccggggtgaacatgtgcaccctgatcgccatggacctgggggagctctgcgacgacaccatgacctacaagtgcccccgcatcaccgagaccgagcccgacgacgtcgactgctggtgcaacgcgaccgagacctgggtgacctacgggacgtgcagccagaccggggagcaccggcgcgacaagcggtccgtggccctggcgccccacgtcggcctggggctcgagacccgcaccgagacgtggatgagctccgagggcgcctggcggcagatccagaaggtggagacctgggccctgcgccaccccgggttcaccgtgatcgccctgttcctcgcccacgccatcggcaccagcatcacgcagaaggggatcatcttcatcctgctgatgctcgtcaccccctccatggccatgcggtgcgtgggcatcggcaaccgcgacttcgtggaggggctgagcggcgcgacctgggtcgacgtggtgctggagcacgggtcctgcgtcaccacgatggccaaggacaagcccaccctcgacatcgagctgctgaagaccgaggtgaccaaccccgccgtgctccggaagctgtgcatcgaggccaagatcagcaacacgaccaccgactcccgctgcccgacccagggcgaggccacgctggtcgaggagcaggacaccaacttcgtgtgccggcgcaccttcgtggaccggggctgggggaacggctgcggcctcttcggcaaggggagcctgatcacgtgcgcgaagttcaagtgcgtcacgaagctggagggcaagatcgtgcagtacgagaacctcaagtactccgtgatcgtcaccgtgcacaccggcgaccagcaccaggtcgggaacgagaccaccgagcacggcacgatcgccaccatcacgccccaggcccccaccagcgagatccagctgacggactacggggccctgaccctcgactgcagcccccggaccggcctggacttcaacgagatggtgctgctcaccatgaaggagaagtcctggctggtgcacaagcagtggttcctggacctcccgctgccctggacgaccggggcctccaccagccaggagacctggaaccggcaggacctgctcgtcacgttcaagaccgcgcacgccaagaagcaggaggtggtggtcctgggcagccaggagggcgccatgcacaccgccctgaccggggccacggagatccagacctccggcaccaccacgatcttcgcggggcacctcaagtgccgcctgaagatggacaagctgaccctcaagggcatgagctacgtgatgtgcaccgggtccttcaagctggagaaggaggtggccgagacccagcacggcacggtcctggtccaggtgaagtacgagggcaccgacgccccctgcaagatccccttcagctcccaggacgagaagggggtcacccagaacggccggctggtgaccgccaacccgatcgtgacggacaaggagaagcccgtcaacatcgaggccgagccgcccttcggggagagctacatcgtggtgggcgcgggcgagaaggccctcaagctgtcctggttcaagaaggggagctccatcggcaagatgttcgaggccaccgcccgcggggcgcggcgcatggccatcctgggcgacaccgcctgggacttcgggagcatcggcggcgtcttcacctccgtggggaagctcgtgcaccagatcttcggcacggcctacggggtcctgttcagcggcgtgtcctggaccatgaagatcgggatcggcatcctgctcacctggctgggcctgaacagccgctccaccagcctctccatgacgtgcatcgccgtggggatggtcaccctgtacctgggcgtgatggtgcaggcggacagcgggtgcgtcatcaactggaagggccgggagctcaagtgcgggtccggcatcttcgtgaccaacgaggtgcacacctggaccgagcagtacaagttccaggccgacagcccgaagcgcctgagcgccgccatcggcaaggcctgggaggagggggtctgcggcatccggtccgcgacgcgcctggagaacatcatgtggaagcagatcagcaacgagctcaaccacatcctgctggagaacgacatgaagttcaccgtggtggtcggggacgtgtccggcatcctcgcccaggggaagaagaccatccggccccagcccatggagcacaagtacagctggaagtcctggggcaaggccaagatcatcggcgccgacgtgcagaacaccacgttcatcatcgacgggcccaacaccccggagtgccccgacgaccagcgcgcctggaacatctgggaggtcgaggactacggcttcgggatcttcaccaccaacatctggctgaagctgcgggacagctacacccaggtgtgcgaccaccgcctcatgtccgcggccatcaaggacagcaaggccgtgcacgccgacatgggctactggatcgagtccgagaagaacgagacgtggaagctggcgcgggccagcttcatcgaggtcaagacctgcgtgtggcccaagtcccacaccctgtggagcaacggcgtgctcgagtccgagatgatcatccccaagatctacgggggcccgatcagccagcacaactaccgccccgggtacttcacgcagaccgccggcccctggcacctggggaagctggagctcgacttcgacctgtgcgagggcaccaccgtcgtggtggacgagcactgcggccaccgggggccgtccctgcgcacgaccaccgtcaccggcaagatcatccacgagtggtgctgccggagctgcacgctgccgcccctgcgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggtcgtgttcctgctcctgaccctggggcagctcacgtggaacgacctgatccggctgtgcatcatggtcggcgccaacgcgagcgacaacatggggatgggcaccacctacctcgccctgatggccaccttccgcatgcgcccgatgttcgccgtgggcctcctcttccggcgcctgacgtcccgggaggtgctgctcctgaccgtcgggctgagcctcgtggcctccgtggagctgcccaacagcctggacgagctcggcgacgggctggcgatgggcatcatgatcctgaagctcctgaccgacttccagtcccaccagctgtgggccaccctcctgagcctgacgttcgtcaagaccaccctctccctgcactacgcctggaagaccatggccatgatcctgagcatcgtgtccctcctgcccctgtgcctcagcacgacctcccagaagaccacctggctgcccgtgctgctcggcagcctggggtgcaagccgctgaccatgttcctcatcacggagaacaagatctggggccgcaagtcctggcccctgaacgaggggatcatggccgtcggcatcgtgagcatcctgctcagctccctgctgaagaacgacgtgcccctcgcggggcccctgatcgccggcggcatgctgatcgcctgctacgtcatcagcgggtccagcgccgacctctccctggagaaggcggccaaggtgagctgggaggaggaggccgagcactccggcgccagccacaacatcctggtggagatccaggacgacgggaccatgaagatcaaggacgaggagcgggacgacaccatcaccatcctcctgaaggccacgctgctcgcgatctccggcgtctacccgatgagcatccccgccaccctgttcgtgtggcacttctggcagaagaagaagcagcgctccggggtgctgtgggacacccccagcccgcccgaggtcgagaaggccgtgctggacgacggcatctaccggatcctccagcgcggcctgctggggcggtcccaggtgggcgtcggggtgttccaggagggcgtgttccacaccatgtggcacgtcacgcgcggggccgtgctcatgtaccagggcaagcggctggagcccagctgggcctccgtgaagaaggacctgatcagctacggcgggggctggcgcttccaggggtcctggaacaccggcgaggaggtccaggtgatcgcggtggagcccgggaagaaccccaagaacgtccagaccgcccccggcaccttcaagacgagcgagggcgaggtgggggccatcgccctcgacttcaagcccggcacctccgggagccccatcgtgaaccgggagggcaagatcgtcggcctgtacgggaacggcgtggtgaccaccagcgggacgtacgtctccgccatcgcgcaggccaagaccagccaggagggccccctgccggagatcgaggacgaggtgttccgcaagcggaacctcaccatcatggacctgcaccccgggtccggcaagacccgccggtacctgcccgccatcgtgcgcgaggccatcaagcggaagctccgcacgctggtcctggccccgacccgggtggtggcgagcgagatggccgaggccctcaagggcatgcccatccgctaccagaccaccgccgtcaagtccgagcacacggggaaggagatcgtggacctgatgtgccacgcgaccttcaccatgcgcctgctcagccccgtgcgggtccccaactacaacatgatcatcatggacgaggcccacttcaccgacccggcctccatcgccgcccgcggctacatcagcacgcgggtggggatgggcgaggcggccgccatcttcatgaccgccacgccgcccgggtccgtggaggccttcccccagagcaacgcggtcatccaggacgaggagaaggacatcccggagcgctcctggaacagcggctacgactggatcaccgacttccccggcaagacggtgtggttcgtgccctccatcaagagcgggaacgacatcgccaactgcctgcggaagaacggcaagcgcgtcatccagctgtcccggaagaccttcgacaccgagtaccagaagaccaagaacaacgactgggactacgtggtcacgaccgacatcagcgagatgggggccaacttccgcgccgaccgggtgatcgacccccgccggtgcctcaagccggtgatcctgaaggacggccccgagcgcgtcatcctggccgggcccatgcccgtgaccgtggcgtccgccgcccagcggcgcggccggatcggccgcaaccagaacaaggagggggaccagtacgtctacatgggccagccgctcaacaacgacgaggaccacgcccactggaccgaggcgaagatgctgctggacaacatcaacacgcccgaggggatcatccccgccctcttcgagcccgagcgggagaagtccgccgccatcgacggcgagtaccgcctgcgcggggaggcccgcaagaccttcgtggagctgatgcgccggggcgacctcccggtgtggctgtcctacaaggtcgcgagcgagggcttccagtacagcgaccgccggtggtgcttcgacggggagcgcaacaaccaggtgctggaggagaacatggacgtggagatctggaccaaggagggcgagcggaagaagctccgcccccggtggctggacgcccgcacctactccgaccccctggccctccgggagttcaaggagttcgccgccgggcgccggagcgtctccggcgacctgatcctggagatcggcaagctcccccagcacctgacccagcgcgcgcagaacgccctggacaacctcgtgatgctgcacaacagcgagcagggcgggaaggcctaccggcacgccatggaggagctgccggacacgatcgagaccatcatgctcctggccctgatcgcggtgctcaccgggggcgtcaccctgttcttcctgtccgggcgcggcctcggcaagacgagcatcgggctgctgtgcgtgacctccagctccgccctcctgtggatggccagcgtggagccccactggatcgccgcgtccatcatcctggagttcttcctcatggtcctgctgatccccgagcccgaccggcagcgcaccccgcaggacaaccagctcgcctacgtggtgatcggcctgctgttcatgatcctcaccgtcgccgccaacgagatggggctgctggagacgaccaagaaggacctcggcatcgggcacaccgccgcggagaaccaccaccacgccgccatgctggacgtggacctgcaccccgccagcgcctggaccctctacgcggtggccacgaccatcatcacccccatgatgcggcacaccatcgagaacacgaccgccaacatctccctgaccgccatcgccaaccaggcggccatcctgatgggcctcgacaagggctggccgatcagcaagatggacatcggggtccccctgctggccctcggctgctactcccaggtgaaccccctgaccctgacggccgccgtgctcatgctggtcgcgcactacgccatcatcgggcccggcctgcaggccaaggccacccgcgaggcgcagaagcggaccgccgccgggatcatgaagaacccgaccgtggacggcatcgtggccatcgacctcgaccccgtcgtgtacgacgccaagttcgagaagcagctgggccagatcatgctgctcatcctgtgcacgagccagatcctgctcatgcgcaccacctgggcgctgtgcgagtccatcaccctggccacggggcccctcaccaccctgtgggagggcagccccgggaagttctggaacaccacgatcgccgtgtccatggccaacatcttccggggcagctacctggccggcgcggggctcgccttcagcctgatgaagtccctgggcgggggccgccgcgggaccggcgcccagggcgagaccctcggggagaagtggaagcggcagctgaaccagctgagcaagtccgagttcaacatctacaagcgcagcggcatcatcgaggtcgaccggtccgaggccaaggaggggctcaagcgcggcgagaccacgaagcacgccgtgagccgggggaccgcgaagctgcgctggttcgtggagcggaacctggtcaagccggagggcaaggtgatcgacctgggctgcgggcgcggcgggtggtcctactactgcgccggcctcaagaaggtgaccgaggtcaaggggtacaccaagggcggccccgggcacgaggagcccatccccatggccacctacggctggaacctggtgaagctgcacagcgggaaggacgtgttcttcatcccgcccgagaagtgcgacacgctcctgtgcgacatcggcgagtccagccccaaccccaccatcgaggaggggcggaccctgcgcgtcctcaagatggtggagccgtggctgcggggcaaccagttctgcatcaagatcctgaacccctacatgccctccgtggtcgagaccctcgagcagatgcagcgcaagcacggcgggatgctggtgcggaaccccctgagccgcaactccacgcacgagatgtactgggtgagctgcggcaccgggaacatcgtctccgccgtgaacatgaccagccggatgctcctgaaccgcttcaccatggcgcaccggaagccgacgtacgagcgcgacgtggacctgggcgccggcacccggcacgtcgccgtggagcccgaggtcgccaacctcgacatcatcgggcagcgcatcgagaacatcaagaacgagcacaagtccacctggcactacgacgaggacaacccctacaagacctgggcctaccacggcagctacgaggtgaagccctccgggagcgcgagctccatggtgaacggcgtcgtgcgcctgctgacgaagccgtgggacgtgatccccatggtcacccagatcgccatgaccgacaccacgcccttcgggcagcagcgggtgttcaaggagaaggtggacacccgcacccccaaggccaagcggggcaccgcccagatcatggaggtcacggccaagtggctctggggcttcctgagccgcaacaagaagccgcggatctgcacccgcgaggagttcacccggaaggtgcgctccaacgcggccatcggggccgtgttcgtcgacgagaaccagtggaacagcgccaaggaggccgtggaggacgagcggttctgggacctggtgcgccgggagcgcgagctccacaagcagggcaagtgcgcgacctgcgtctacaacatgatggggaagcgggagaagaagctgggcgagttcgggaaggccaagggctcccgcgccatctggtacatgtggctgggcgcccggttcctcgagttcgaggcgctggggttcatgaacgaggaccactggttcagccgcgagaactccctgagcggcgtggagggggagggcctccacaagctggggtacatcctgcgggacatctccaagatccccggcggcaacatgtacgccgacgacacggccgggtgggacacccgcatcaccgaggaggacctccagaacgaggccaagatcaccgacatcatggagcccgagcacgccctgctggcgacgagcatcttcaagctcacctaccagaacaaggtggtccgggtgcagcgcccggccaagaacggcaccgtgatggacgtcatctcccggcgcgaccagcgcgggagcggccaggtgggcacctacgggctgaacacgttcaccaacatggaggcccagctgatccggcagatggagtccgagggcatcttcagcccctccgagctcgagacccccaacctggccgggcgcgtgctggactggctcgagaagcacggcatcgagcggctgcgccggatggccatcagcggggacgactgcgtcgtgaagcccatcgacgaccgcttcgcgaccgccctgacggccctcaacgacatgggcaaggtgcggaaggacatcccgcagtgggagccctccaagggctggaacgactggcagcaggtccccttctgcagccaccacttccaccagctgatcatgaaggacgggcgcgagatcgtggtgccctgccggaaccaggacgagctggtcggccgcgcccgggtgagccagggggccggctggtccctccgcgagaccgcgtgcctgggcaagagctacgcccagatgtggcagctgatgtacttccaccggcgcgacctccggctggccgccaacgccatctgctccgcggtgccggtcgactgggtgcccaccagccgcaccacctggtccatccacgcccaccaccagtggatgacgaccgaggacatgctgagcgtgtggaaccgggtctggatcgaggagaacccctggatggaggacaagacccacgtgtccagctgggaggacgtgccctacctcggcaagcgcgaggaccagtggtgcggctccctgatcgggctgaccgcccgggccacgtgggcgaccaacatccaggtcgccatcaaccaggtgcgccgcctcatcggcaacgagaactacctggactacatgaccagcatgaagcggttcaagaacgagtccgacccggagggggccctgtggtga

SEQ ID NO: 8915 - RNA, 9879 nt, synthetic construct
  misc_feature 1..9879: note = derived and/or modified CDS sequence (opt1) from DENV-1__KF289072__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctgacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtcgaggactacggcttcggggtgttcaccaccaacatctggctgaagctccgggactcctacacccagatgtgcgaccaccgcctgatgagcgccgcgatcaaggactccaaggccgtgcacgccgacatgggctactggatcgagagcgagaagaacgagacgtggaagctggcccgggcctccttcatcgaggtcaagacctgcatctggccccgcagccacaccctctggtccaacggcgtgctggagagcgagatgatcatccccaagatctacgggggcccgatctcccagcacaactaccggcccgggtacttcacccagacggcgggcccctggcacctggggaagctcgagctggacttcaacctgtgcgagggcaccaccgtggtcgtggacgagcactgcggcaaccgcgggccgagcctccggaccacgaccgtgaccggcaagatcatccacgagtggtgctgccgctcctgcaccctgccgcccctgcggttcaagggggaggacggctgctggtacgggatggagatccgccccgtcaaggagaaggaggagaacctcgtgcggagcatggtgtccgccggcagcggcgaggtcgacagcttctccctggggctgctctgcgtgagcatcatgatcgaggaggtgatgcgctcccggtggagccgcaagatgctgatgacgggcaccctggccgtcttcttcctcctgatcatggggcagctgacctggaacgacctcatccgcctgtgcatcatggtgggcgccaacgtgtccgaccggatggggatgggcaccacgtacctggccctcatggcgaccttcaagatgcgcccgatgttcgccgtcgggctgctgttccggcgcctcaccagccgggaggtgctgctgctcaccatcgggctgtccctggtcgccagcgtggagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcctggaagaccatggcgatggtgctgtccatcgtcagcctgttccccctctgcctgtccaccacgagccagaagaccacctggctgcccgtgctcctgggctccttcgggtgcaagccgctgaccatgttcctcatcaccgagaacaagatctggggccgcaagagctggcccctgaacgaggggatcatggccgtgggcatcgtctccatcctgctcagcagcctgctgaagaacgacgtgcccctcgccgggcccctgatcgccggcggcatgctgatcgcgtgctacgtgatctccgggagctccgccgacctcagcctggagcgggccgccgaggtctcctgggaggaggaggccgagcacagcggcgcgtcccacaacatcctggtggaggtgcaggacgacgggacgatgaagatcaaggacgaggagcgcgacgacaccctcaccatcctgctgaaggccaccctcctggccgtcagcggcgtgtacccgatgtccatccccgccacgctgttcgtgtggtacttctggcagaagaagaagcagcggagcggggtcctctgggacacccccagcccgcccgaggtggagcgcgccgtgctggacgacggcatctaccggatcctgcagcgcggcctgctcgggcggagccaggtcggcgtgggggtgttccaggacggcgtcttccacaccatgtggcacgtgacccgcggggcggtgctgatgtaccagggcaagcggctggagccctcctgggccagcgtcaagaaggacctcatctcctacggcgggggctggcgcttccaggggagctggaacacgggcgaggaggtccaggtgatcgccgtcgagcccgggaagaaccccaagaacgtgcagaccacccccggcaccttcaagacgcccgagggcgccgtgggggccatcgcgctggacttcaagcccggcacctccgggagccccatcgtcaaccgggagggcaagatcgtgggcctgtacgggaacggcgtggtcaccacctccgggacgtacgtgagcgccatcgcccaggccaaggccagccaggagggcccgctccccgagatcgaggacgaggtgttcaagaagcgcaacctgaccatcatggacctgcaccccgggtccggcaagacccggcgctacctcccggcgatcgtccgggaggccatcaagcgcaagctgcgcaccctgatcctcgcccccacgcgggtggtggccagcgagatggcggaggccctgaagggcatgcccatccgctaccagaccaccgccgtcaagtccgagcacaccgggaaggagatcgtggacctgatgtgccacgccacgttcaccatgcggctcctgagccccgtgcgcgtcccgaactacaacatgatcatcatggacgaggcccacttcaccgaccccgcgtccatcgccgcccggggctacatcagcacccgcgtggggatgggcgaggccgccgcgatcttcatgacggccacgccgcccgggtccgtggaggccttcccgcagagcaacgccgtcatccaggacgaggagcgggacatccccgagcgctcctggaacagcggctacgactggatcaccgacttccccggcaagaccgtgtggttcgtgccctccatcaagagcgggaacgacatcgccaactgcctgcggaagaacggcaagcgcgtcatccagctctcccggaagacgttcgacaccgagtaccagaagaccaagaacaacgactgggactacgtggtgaccacggacatcagcgagatgggggcgaacttccgcgccgaccgggtcatcgacccgcgccggtgcctgaagcccgtgatcctgaaggacggccccgagcgcgtcatcctcgccgggcccatgccggtgaccgccgcgtccgccgcccagcggcgcggccggatcggccgcaaccagaacaaggagggggaccagtacatctacatgggccagcccctgaacaacgacgaggaccacgcccactggaccgaggccaagatgctgctcgacaacatcaacacccccgaggggatcatccccgcgctgttcgagccggagcgcgagaagtccgccgccatcgacggcgagtaccggctgcgcggggaggcccggaagacgttcgtggagctcatgcgccggggcgacctgcccgtctggctgtcctacaaggtggccagcgagggcttccagtactccgaccgccggtggtgcttcgacggggagcgcaacaaccaggtgctcgaggagaacatggacgtcgagatctggaccaaggagggcgagcggaagaagctgcgcccccggtggctggacgcgcgcacctacagcgaccccctcgccctgcgggagttcaaggagttcgccgccgggcgccggagcgtgtccggcgacctgatcctcgagatcggcaagctgccgcagcacctgaccctccgcgcccagaacgcgctggacaacctggtgatgctccacaacagcgagcagggcgggaaggcctaccggcacgccatggaggagctgcccgacaccatcgagacgctgatgctcctggccctgatcgcggtcctcaccgggggcgtgaccctgttcttcctgtccgggaagggcctcggcaagaccagcatcgggctgctgtgcgtgatggcctccagcgtcctcctgtggatggcctccgtggagccccactggatcgccgccagcatcatcctggagttcttcctcatggtgctgctgatccccgagccggaccgccagcggacgccccaggacaaccagctcgcgtacgtcgtgatcggcctgctgttcatgatcctcaccgtggccgccaacgagatggggctgctggagaccaccaagaaggacctcggcatcgggcacgtcgtggccgagaaccaccaccacgccacgatgctggacatcgacctgcaccccgcgtccgcctggaccctctacgccgtggccaccaccatcatcacgccgatgatgcgccacaccatcgagaacaccaccgccaacatcagcctgacggcgatcgccaaccaggccgccatcctgatgggcctcgacaagggctggcccatctccaagatggacatcggggtccccctgctggccctcggctgctacagccaggtgaaccccctgaccctgaccgcggccgtgctcatgctggtcgcccactacgccatcatcgggccgggcctgcaggcgaaggccacccgggaggcccagaagcgcacggccgccgggatcatgaagaaccccaccgtggacggcatcgtggcgatcgacctcgaccccgtcgtgtacgacgccaagttcgagaagcagctgggccagatcatgctgctcatcctgtgcacctcccagatcctgctcatgcgcaccacgtgggccctgtgcgagagcatcaccctggccaccgggcccctcaccacgctgtgggagggctccccggggcggttctggaacaccaccatcgccgtgagcatggcgaacatcttccgcggctcctacctggccggcgccgggctcgccttcagcctgatgaagtccctgggcgggggccggcgcgggaccggcgcccagggcgagacgctcggggagaagtggaagcggcagctgaaccagctgagcaagagcgagttcaacacctacaagcgctccggcatcatggaggtcgaccggagcgaggcgaaggaggggctcaagcgcggcgagaccaccaagcacgccgtgtcccgggggacggccaagctgcgctggttcgtggagcggaacctggtcaagcccgagggcaaggtgatcgacctgggctgcgggcgcggcgggtggagctactactgcgccggcctcaagaaggtgaccgaggtcaaggggtacaccaagggcggccccgggcacgaggagcccatcccgatggcgacctacggctggaacatcgtgaagctgcactccgggcgggacgtgttcttcacgccgcccgagaagtgcgacacgctgctctgcgacatcggcgagagctcccccaacccgaccatcgaggaggggcgcaccctgcgggtcctgaagatggtggagccctggctccgcggcaaccagttctgcatcaagatcctgaacccctacatgcccagcgtggtcgagaccctggagcagatgcagcggaagcacggcgggatgctcgtgcgcaacccgctgtcccggaacagcacgcacgagatgtactgggtgtcctgcggcaccgggaacatcgtcagcgccgtgaacatgacctcccgcatgctgctcaaccgcttcaccatgacgcaccggaagcccacctacgagcgcgacgtggacctgggcgccggcacccggcacgtcgccgtggagcccgagatcgccaacctggacatcatcgggcagcgcatcgagaacatcaagaacgagcacaagagcacctggcactacgacgaggacaacccctacaagacgtgggcgtaccacggctcctacgaggtgaagccgagcgggtccgccagctccatggtcaacggcgtggtccggctcctgaccaagccctgggacgtgatccccatggtgacccagatcgccatgaccgacacgacccccttcgggcagcagcgcgtcttcaaggagaaggtggacacccggaccccgcgccccaagcggggcacggcccagatcatggaggtgaccgccaagtggctgtggggcttcctcagccgcaacaagaagccccggatctgcacccgcgaggagttcacccggaaggtccgcagcaacgcggccatcggggccgtgttcgtggacgagaaccagtggaactccgccaaggaggccgtcgaggacgagcggttctgggacctggtgcaccgcgagcgggagctgcacaagcagggcaagtgcgcgacgtgcgtgtacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtcgagggggagggcctgcacaagctcgggtacatcctgcgcgacatcagcaagatcccgggcggcaacatgtacgccgacgacaccgccgggtgggacacccgcatcaccgaggacgacctgcagaacgaggccaagatcacggacatcatggagcccgagcacgccctcctggcgacctccatcttcaagctgacctaccagaacaaggtggtgcgggtccagcgccccgccaagagcggcaccgtgatggacgtgatctcccggcgcgaccagcgggggagcggccaggtcggcacgtacgggctcaacaccttcaccaacatggaggtgcagctgatccgccagatggagtccgagggcatcttcagcccctccgagctggagaacagcaacctcgccgagcgggtgctggactggctggagaagcacggggtcgagcgcctcaagcggatggccatctccggcgacgactgcgtggtgaagccgaccgacgaccgcttcgccacggcgctgaccgccctgaacgacatggggaaggtccggaaggacatcccccagtgggagcccagcaagggctggaacgactggcagcaggtccccttctgctcccaccacttccaccagctcatcatgaaggacggccgcgagatcgtggtcccgtgccggaaccaggacgagctggtggggcgcgcccgggtgagccagggcgccgggtggagcctgcgcgagaccgcctgcctcggcaagtcctacgcgcagatgtggcagctgatgtacttccaccggcgcgacctgcggctcgccgccaacgccatctgcagcgccgtccccgtggactgggtgcccacctcccgcaccacgtggagcatccacgcgcaccaccagtggatgaccaccgaggacatgctgtccgtctggaaccgcgtgtggatcgaggagaacccctggatggaggacaagacccacgtgagctcctgggaggacgtcccgtacctggggaagcgggaggaccagtggtgcggcagcctcatcggcctgacggcccgcgccacctgggccaccaacatccaggtggcgatcaaccaggtgcggcgcctgatcgggaacgagaactacctcgactacatgacctccatgaagcggttcaagaacgagagcgactccgagggcgccctgtggtga

SEQ ID NO: 8916 - RNA, 9879 nt, synthetic construct
  misc_feature 1..9879: note = derived and/or modified CDS sequence (opt1) from DENV-1__JQ692085__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctgacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtcgaggactacggcttcggggtgttcaccaccaacatctggctgaagctccgggactcctacacccagatgtgcgaccaccgcctgatgagcgccgcgatcaaggactccaaggccgtgcacgccgacatgggctactggatcgagagcgagaagaacgagacgtggaagctggcccgggcctccttcatcgaggtcaagacctgcatctggccccgcagccacaccctctggtccaacggcgtgctggagagcgagatgatcatccccaagatctacgggggcccgatctcccagcacaactaccggcccgggtacttcacccagacggcgggcccctggcacctggggaagctcgagctggacttcaacctgtgcgagggcaccaccgtggtcgtggacgagcactgcggcaaccgcgggccgagcctccggaccacgaccgtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggctgctctgcgtgagcatcatgatcgaggaggtgatgcggtcccgctggagccgcaagatgctgatgacgggcaccctggccgtcttcttcctcctgatcatggggcagctgacctggaacgacctcatccggctgtgcatcatggtgggcgccaacgtgtccgaccgcatggggatgggcaccacgtacctggccctcatggcgaccttcaagatgcggccgatgttcgccgtcgggctgctgttccgccggctcaccagccgcgaggtgctgctgctcaccatcgggctgtccctggtcgccagcgtggagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcctggaagaccatggcgatggtgctgtccatcgtcagcctgttccccctctgcctgtccaccacgagccagaagaccacctggctgcccgtgctcctgggctccttcgggtgcaagccgctgaccatgttcctcatcaccgagaacaagatctggggccgcaagagctggcccctgaacgaggggatcatggccgtgggcatcgtctccatcctgctcagcagcctgctgaagaacgacgtgcccctcgccgggcccctgatcgccggcggcatgctgatcgcgtgctacgtgatctccgggagctccgccgacctcagcctggagcgcgccgccgaggtctcctgggaggaggaggccgagcacagcggcgcgtcccacaacatcctggtggaggtgcaggacgacgggacgatgaagatcaaggacgaggagcgggacgacaccctcaccatcctgctgaaggccaccctcctggccgtcagcggcgtgtacccgatgtccatccccgccacgctgttcgtgtggtacttctggcagaagaagaagcagcgcagcggggtcctctgggacacccccagcccgcccgaggtggagcgggccgtgctggacgacggcatctaccgcatcctgcagcggggcctgctcgggcgcagccaggtcggcgtgggggtgttccaggacggcgtcttccacaccatgtggcacgtgacccgcggggcggtgctgatgtaccagggcaagcgcctggagccctcctgggccagcgtcaagaaggacctcatctcctacggcgggggctggcggttccaggggagctggaacacgggcgaggaggtccaggtgatcgccgtcgagcccgggaagaaccccaagaacgtgcagaccacccccggcaccttcaagacgcccgagggcgccgtgggggccatcgcgctggacttcaagcccggcacctccgggagccccatcgtcaaccgcgagggcaagatcgtgggcctgtacgggaacggcgtggtcaccacctccgggacgtacgtgagcgccatcgcccaggccaaggccagccaggagggcccgctccccgagatcgaggacgaggtgttcaagaagcggaacctgaccatcatggacctgcaccccgggtccggcaagacccgccggtacctcccggcgatcgtccgcgaggccatcaagcgcaagctgcggaccctgatcctcgcccccacgcgcgtggtggccagcgagatggcggaggccctgaagggcatgcccatccggtaccagaccaccgccgtcaagtccgagcacaccgggaaggagatcgtggacctgatgtgccacgccacgttcaccatgcgcctcctgagccccgtgcgggtcccgaactacaacatgatcatcatggacgaggcccacttcaccgaccccgcgtccatcgccgcccgcggctacatcagcacccgggtggggatgggcgaggccgccgcgatcttcatgacggccacgccgcccgggtccgtggaggccttcccgcagagcaacgccgtcatccaggacgaggagcgcgacatccccgagcggtcctggaacagcggctacgactggatcaccgacttccccggcaagaccgtgtggttcgtgccctccatcaagagcgggaacgacatcgccaactgcctgcgcaagaacggcaagcgggtcatccagctctcccgcaagacgttcgacaccgagtaccagaagaccaagaacaacgactgggactacgtggtgaccacggacatcagcgagatgggggcgaacttccgggccgaccgcgtcatcgacccgcggcgctgcctgaagcccgtgatcctgaaggacggccccgagcgggtcatcctcgccgggcccatgccggtgaccgccgcgtccgccgcccagcgccggggccgcatcggccgcaaccagaacaaggagggggaccagtacatctacatgggccagcccctgaacaacgacgaggaccacgcccactggaccgaggccaagatgctgctcgacaacatcaacacccccgaggggatcatccccgcgctgttcgagccggagcgggagaagtccgccgccatcgacggcgagtaccgcctgcgcggggaggcccgcaagacgttcgtggagctcatgcggcgcggcgacctgcccgtctggctgtcctacaaggtggccagcgagggcttccagtactccgaccggcgctggtgcttcgacggggagcggaacaaccaggtgctcgaggagaacatggacgtcgagatctggaccaaggagggcgagcgcaagaagctgcggccccgctggctggacgcgcggacctacagcgaccccctcgccctgcgcgagttcaaggagttcgccgccgggcggcgcagcgtgtccggcgacctgatcctcgagatcggcaagctgccgcagcacctgaccctccgggcccagaacgcgctggacaacctggtgatgctccacaacagcgagcagggcgggaaggcctaccgccacgccatggaggagctgcccgacaccatcgagacgctgatgctcctggccctgatcgcggtcctcaccgggggcgtgaccctgttcttcctgtccgggaagggcctcggcaagaccagcatcgggctgctgtgcgtgatggcctccagcgtcctcctgtggatggcctccgtggagccccactggatcgccgccagcatcatcctggagttcttcctcatggtgctgctgatccccgagccggaccggcagcgcacgccccaggacaaccagctcgcgtacgtcgtgatcggcctgctgttcatgatcctcaccgtggccgccaacgagatggggctgctggagaccaccaagaaggacctcggcatcgggcacgtcgtggccgagaaccaccaccacgccacgatgctggacatcgacctgcaccccgcgtccgcctggaccctctacgccgtggccaccaccatcatcacgccgatgatgcggcacaccatcgagaacaccaccgccaacatcagcctgacggcgatcgccaaccaggccgccatcctgatgggcctcgacaagggctggcccatctccaagatggacatcggggtccccctgctggccctcggctgctacagccaggtgaaccccctgaccctgaccgcggccgtgctcatgctggtcgcccactacgccatcatcgggccgggcctgcaggcgaaggccacccgcgaggcccagaagcgcacggccgccgggatcatgaagaaccccaccgtggacggcatcgtggcgatcgacctcgaccccgtcgtgtacgacgccaagttcgagaagcagctgggccagatcatgctgctcatcctgtgcacctcccagatcctgctcatgcggaccacgtgggccctgtgcgagagcatcaccctggccaccgggcccctcaccacgctgtgggagggctccccggggcgcttctggaacaccaccatcgccgtgagcatggcgaacatcttccggggctcctacctggccggcgccgggctcgccttcagcctgatgaagtccctgggcgggggccgccgggggaccggcgcccagggcgagacgctcggggagaagtggaagcgccagctgaaccagctgagcaagagcgagttcaacacctacaagcggtccggcatcatggaggtcgaccgcagcgaggcgaaggaggggctcaagcggggcgagaccaccaagcacgccgtgtcccgcgggacggccaagctgcggtggttcgtggagcgcaacctggtcaagcccgagggcaaggtgatcgacctgggctgcgggcggggcgggtggagctactactgcgccggcctcaagaaggtgaccgaggtcaaggggtacaccaagggcggccccgggcacgaggagcccatcccgatggcgacctacggctggaacatcgtgaagctgcactccgggcgcgacgtgttcttcacgccgcccgagaagtgcgacacgctgctctgcgacatcggcgagagctcccccaacccgaccatcgaggaggggcggaccctgcgcgtcctgaagatggtggagccctggctccggggcaaccagttctgcatcaagatcctgaacccctacatgcccagcgtggtcgagaccctggagcagatgcagcgcaagcacggcgggatgctcgtgcggaacccgctgtcccgcaacagcacgcacgagatgtactgggtgtcctgcggcaccgggaacatcgtcagcgccgtgaacatgacctcccgcatgctgctcaaccggttcaccatgacgcaccgcaagcccacctacgagcgggacgtggacctgggcgccggcacccgccacgtcgccgtggagcccgagatcgccaacctggacatcatcgggcagcggatcgagaacatcaagaacgagcacaagagcacctggcactacgacgaggacaacccctacaagacgtgggcgtaccacggctcctacgaggtgaagccgagcgggtccgccagctccatggtcaacggcgtggtccgcctcctgaccaagccctgggacgtgatccccatggtgacccagatcgccatgaccgacacgacccccttcgggcagcagcgggtcttcaaggagaaggtggacacccgcaccccgcggcccaagcgcggcacggcccagatcatggaggtgaccgccaagtggctgtggggcttcctcagccggaacaagaagccccgcatctgcacccgggaggagttcacccgcaaggtccggagcaacgcggccgtgggggccgtgttcgtcgacgagaaccagtggaactccgccaaggaggccgtggaggacgagcgcttctgggacctggtgcaccgggagcgcgagctgcacaagcagggcaagtgcgcgacgtgcgtctacaacatgatggggaagcgggagaagaagctcggcgagttcgggaaggccaagggcagccgcgccatctggtacatgtggctgggcgcccggttcctggagttcgaggcgctcgggttcatgaacgaggaccactggttctcccgcgagaacagcctgtccggcgtggagggggagggcctgcacaagctcgggtacatcctgcgcgacatcagcaagatcccgggcggcaacatgtacgccgacgacaccgccgggtgggacacccggatcaccgaggacgacctgcagaacgaggccaagatcacggacatcatggagcccgagcacgccctcctggcgacctccatcttcaagctgacctaccagaacaaggtggtccgcgtgcagcggcccgccaagagcggcaccgtgatggacgtcatctcccgccgggaccagcgcgggagcggccaggtgggcacgtacgggctcaacaccttcaccaacatggaggtgcagctgatccggcagatggagtccgagggcatcttcagccccaacgagctggagaactccaacctcgccgagcgcgtcctggactggctggagaagcacggggtggagcggctcaagcgcatggccatcagcggcgacgactgcgtggtcaagccgaccgacgaccggttcgccacggcgctgaccgccctgaacgacatggggaaggtgcgcaaggacatcccccagtgggagccctccaagggctggaacgactggcagcaggtccccttctgcagccaccacttccaccagctcatcatgaaggacggccgggagatcgtcgtgccgtgccgcaaccaggacgagctggtggggcgggcccgcgtctcccagggcgccgggtggagcctgcgggagaccgcctgcctcggcaagagctacgcgcagatgtggcagctgatgtacttccaccgccgggacctgcgcctcgccgccaacgccatctgctccgccgtgcccgtggactgggtccccaccagccgcaccacgtggtccatccacgcgcaccaccagtggatgaccaccgaggacatgctgagcgtgtggaaccgggtgtggatcgaggagaacccctggatggaggacaagacccacgtctccagctgggaggacgtgccgtacctggggaagcgcgaggaccagtggtgcggctccctcatcggcctgacggcccgggccacctgggccaccaacatccaggtggcgatcaaccaggtccgccggctgatcgggaacgagaactacctcgactacatgaccagcatgaagcgcttcaagaacgagtccgacagcgagggcgccctgtggtga

SEQ ID NO: 8917 - RNA, 9879 nt, synthetic construct
  misc_feature 1..9879: note = derived and/or modified CDS sequence (opt1) from DENV-1__JQ917404__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctgacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtcgaggactacggcttcggggtgttcaccaccaacatctggctgaagctccgggactcctacacccagatgtgcgaccaccgcctgatgagcgccgcgatcaaggactccaaggccgtgcacgccgacatgggctactggatcgagagcgagaagaacgagacgtggaagctggcccgggcctccttcatcgaggtcaagacctgcatctggccccgcagccacaccctctggtccaacggcgtgctggagagcgagatgatcatccccaagatctacgggggcccgatctcccagcacaactaccggcccgggtacttcacccagacggcgggcccctggcacctggggaagctcgagctggacttcaacctgtgcgagggcaccaccgtggtcgtggacgagcactgcggcaaccgcgggccgagcctccggaccacgaccgtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggctgctctgcgtgagcatcatgatcgaggaggtgatgcggtcccgctggagccgcaagatgctgatgacgggcaccctggccgtcttcttcctcctgatcatggggcagctgacctggaacgacctcatccggctgtgcatcatggtgggcgccaacgtgtccgaccgcatggggatgggcaccacgtacctggccctcatggcgaccttcaagatgcggccgatgttcgccgtcgggctgctgttccgccggctcaccagccgcgaggtgctgctgctcaccatcgggctgtccctggtcgccagcgtggagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcctggaagaccatggcgatggtgctgtccatcgtcagcctgttccccctctgcctgtccaccacgagccagaagaccacctggctgcccgtgctcctgggctccttcgggtgcaagccgctgaccatgttcctcatcaccgagaacaagatctggggccgcaagagctggcccctgaacgaggggatcatggccgtgggcatcgtctccatcctgctcagcagcctgctgaagaacgacgtgcccctcgccgggcccctgatcgccggcggcatgctgatcgcgtgctacgtgatctccgggagctccgccgacctcagcctggagcgcgccgccgaggtctcctgggaggaggaggccgagcacagcggcgcgtcccacaacatcctggtggaggtgcaggacgacgggacgatgaagatcaaggacgaggagcgggacgacaccctcaccatcctgctgaaggccaccctcctggccgtcagcggcgtgtacccgatgtccatccccgccacgctgttcgtgtggtacttctggcagaagaagaagcagcgcagcggggtcctctgggacacccccagcccgcccgaggtggagcgggccgtgctggacgacggcatctaccgcatcctgcagcggggcctgctcgggcgcagccaggtcggcgtgggggtgttccaggacggcgtcttccacaccatgtggcacgtgacccgcggggcggtgctgatgtaccagggcaagcgcctggagccctcctgggccagcgtcaagaaggacctcatctcctacggcgggggctggcggttccaggggagctggaacacgggcgaggaggtccaggtgatcgccgtcgagcccgggaagaaccccaagaacgtgcagaccacccccggcaccttcaagacgcccgagggcgaggtgggggccatcgccctggacttcaagcccggcacctccgggagccccatcgtcaaccgcgagggcaagatcgtgggcctgtacgggaacggcgtggtcaccacctccgggacgtacgtgagcgcgatcgcccaggccaaggccagccaggagggcccgctccccgagatcgaggacgaggtgttcaagaagcggaacctgaccatcatggacctgcaccccgggtccggcaagacccgccggtacctcccggccatcgtccgcgaggcgatcaagcgcaagctgcggaccctgatcctcgcccccacgcgcgtggtggccagcgagatggccgaggcgctgaagggcatgcccatccggtaccagaccaccgccgtcaagtccgagcacaccgggaaggagatcgtggacctgatgtgccacgccacgttcaccatgcgcctcctgagccccgtgcgggtcccgaactacaacatgatcatcatggacgaggcccacttcaccgaccccgcctccatcgcggcccgcggctacatcagcacccgggtggggatgggcgaggccgccgccatcttcatgacggcgacgccgcccgggtccgtggaggccttcccgcagagcaacgccgtcatccaggacgaggagcgcgacatccccgagcggtcctggaacagcggctacgactggatcaccgacttccccggcaagaccgtgtggttcgtgccctccatcaagagcgggaacgacatcgccaactgcctgcgcaagaacggcaagcgggtcatccagctctcccgcaagacgttcgacaccgagtaccagaagaccaagaacaacgactgggactacgtggtgaccacggacatcagcgagatgggggccaacttccgggcggaccgcgtcatcgacccgcggcgctgcctgaagcccgtgatcctgaaggacggccccgagcgggtcatcctcgccgggcccatgccggtgaccgccgcctccgcggcccagcgccggggccgcatcggccgcaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgggagaagtccgcggccatcgacggcgagtaccgcctgcgcggggaggcccgcaagacgttcgtggagctcatgcggcgcggcgacctgcccgtctggctgtcctacaaggtggccagcgagggcttccagtactccgaccggcgctggtgcttcgacggggagcggaacaaccaggtgctcgaggagaacatggacgtcgagatctggacccgcgagggcgagcggaagaagctgcgcccccggtggctggacgcccgcacctacagcgaccccctcgcgctgcgggagttcaaggagttcgccgccgggcgccggagcgtgtccggcgacctgatcctcgagatcggcaagctgccgcagcacctgaccctccgcgcccagaacgccctggacaacctggtgatgctccacaacagcgagcagggcgggaaggcgtaccggcacgccatggaggagctgcccgacaccatcgagacgctgatgctcctggccctgatcgccgtcctcaccgggggcgtgaccctgttcttcctgtccgggaagggcctcggcaagaccagcatcgggctgctgtgcgtgatggcgtccagcgtcctcctgtggatggcctccgtggagccccactggatcgccgccagcatcatcctggagttcttcctcatggtgctgctgatccccgagccggaccgccagcggacgccccaggacaaccagctcgcctacgtcgtgatcggcctgctgttcatgatcctcaccgtggcggccaacgagatggggctgctggagaccaccaagaaggacctcggcatcgggcacgtcgtggccgagaaccaccaccacgccacgatgctggacatcgacctgcaccccgcctccgcgtggaccctctacgccgtggccaccaccatcatcacgccgatgatgcgccacaccatcgagaacaccaccgccaacatcagcctgacggccatcgcgaaccaggccgccatcctgatgggcctcgacaagggctggcccatctccaagatggacatcggggtccccctgctggccctcggctgctacagccaggtgaaccccctgaccctgaccgccgcggtgctcatgctggtcgcccactacgccatcatcgggccgggcctgcaggccaaggcgacccgcgaggcccagaagcggacggccgccgggatcatgaagaaccccaccgtggacggcatcgtggccatcgacctcgaccccgtcgtgtacgacgcgaagttcgagaagcagctgggccagatcatgctgctcatcctgtgcacctcccagatcctgctcatgcgcaccacgtgggccctgtgcgagagcatcaccctggccaccgggcccctcaccacgctgtgggagggctccccggggcggttctggaacaccaccatcgccgtgagcatggccaacatcttccgcggctcctacctggcgggcgccgggctcgccttcagcctgatgaagtccctgggcgggggccggcgcgggaccggcgcccagggcgagacgctcggggagaagtggaagcggcagctgaaccagctgagcaagagcgagttcaacacctacaagcgctccggcatcatggaggtcgaccggagcgaggccaaggaggggctcaagcgcggcgagaccaccaagcacgcggtgtcccgggggacggccaagctgcgctggttcgtggagcggaacctggtcaagcccgagggcaaggtgatcgacctgggctgcgggcgcggcgggtggagctactactgcgccggcctcaagaaggtgaccgaggtcaaggggtacaccaagggcggccccgggcacgaggagcccatcccgatggccacctacggctggaacatcgtgaagctgcactccgggcgggacgtgttcttcacgccgcccgagaagtgcgacacgctgctctgcgacatcggcgagagctcccccaacccgaccatcgaggaggggcgcaccctgcgggtcctgaagatggtggagccctggctccgcggcaaccagttctgcatcaagatcctgaacccctacatgcccagcgtggtcgagaccctggagcagatgcagcggaagcacggcgggatgctcgtgcgcaacccgctgtcccgcaacagcacgcacgagatgtactgggtgtcctgcggcaccgggaacatcgtcagcgcggtgaacatgacctcccggatgctgctcaaccgcttcaccatggcccaccggaagcccacgtacgagcgcgacgtggacctgggcgccggcacccggcacgtcgccgtggagcccgagatcgccaacctggacatcatcgggcagcgcatcgagaacatcaagaacgagcacaagagcacctggcactacgacgaggacaacccctacaagacctgggcgtaccacggctcctacgaggtgaagccgagcgggtccgccagctccatggtcaacggcgtggtccggctcctgacgaagccctgggacgtgatccccatggtgacccagatcgccatgaccgacaccacgcccttcgggcagcagcgcgtcttcaaggagaaggtggacacccggaccccgcgccccaagcggggcaccgcccagatcatggaggtgacggccaagtggctgtggggcttcctcagccgcaacaagaagccccggatctgcacccgcgaggagttcacccggaaggtccgcagcaacgcggccatcggggccgtgttcgtggacgagaaccagtggaactccgccaaggaggccgtcgaggacgagcggttctgggacctggtgcaccgcgagcgggagctgcacaagcagggcaagtgcgcgacctgcgtgtacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgcgagaacagcctgtccggcgtcgagggggagggcctgcacaagctcgggtacatcctgcgggacatcagcaagatcccgggcggcaacatgtacgccgacgacacggccgggtgggacacccgcatcaccgaggacgacctgcagaacgaggccaagatcaccgacatcatggagcccgagcacgccctcctggcgacgtccatcttcaagctgacctaccagaacaaggtggtgcgggtccagcgccccgccaagagcggcaccgtgatggacgtgatctcccggcgcgaccagcgggggagcggccaggtcggcacctacgggctcaacacgttcaccaacatggaggtgcagctgatccgccagatggagtccgagggcatcttcagcccctccgagctggagaacagcaacctcgccgagcgggtgctggactggctggagaagcacggggtcgagcgcctcaagcggatggccatctccggcgacgactgcgtggtgaagccgaccgacgaccgcttcgccaccgcgctgacggccctgaacgacatggggaaggtccggaaggacatcccccagtgggagcccagcaagggctggaacgactggcagcaggtccccttctgctcccaccacttccaccagctcatcatgaaggacggccgcgagatcgtggtcccgtgccggaaccaggacgagctggtggggcgcgcccgggtgagccagggcgccgggtggagcctgcgcgagaccgcctgcctcggcaagtcctacgcgcagatgtggcagctgatgtacttccaccggcgcgacctgcgcctcgccgccaacgccatctgcagcgccgtccccgtgaactgggtgcccacctcccggaccacctggagcatccacgcgcaccaccagtggatgacgaccgaggacatgctgtccgtctggaaccgcgtgtggatcgaggagaacccctggatggaggacaagacccacgtgagctcctgggaggacgtcccgtacctggggaagcgggaggaccagtggtgcggcagcctcatcggcctgaccgcccgcgccacgtgggccaccaacatccaggtggcgatcaaccaggtgcggcgcctgatcgggaacgagaactacctcgactacatgacctccatgaagcggttcaagaacgagagcgaccccgagggcgccctgtggtga

SEQ ID NO: 8918 - RNA, 9879 nt, synthetic construct
  misc_feature 1..9879: note = derived and/or modified CDS sequence (opt1) from DENV-1__GU370048__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccctcacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctggggctcgagacgcggaccgagacctggatgagctccgagggcgcctggaagcagatccagcgggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcagccgcgacttcgtggaggggctgtccggcgccacgtgggtggacgtcgtgctggagcacgggagctgcgtgaccaccatggccaaggacaagcccaccctcgacatcgagctgctgaagacggaggtcaccaaccccgcggtgctccggaagctgtgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctgatcacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctgaacttcaacgagatggtcctgctcaccatgaaggagaagtcctggctggtgcacaagcagtggttcctggacctcccgctgccctggaccagcggggccagcaccacgcaggagacctggaaccggcaggacctgctcgtgaccttcaagaccgcccacgcgaagaagcaggaggtcgtggtgctgggctcccaggagggcgccatgcacacggccctgaccggggccaccgagatccagaccagcggcacgaccaccatcttcgccgggcacctcaagtgccgcctgaagatggacaagctgaccctcaagggcatgtcctacgtcatgtgcacggggagcttcaagctggagaaggaggtggcggagacccagcacggcaccgtgctggtccagatcaagtacgagggcaccgacgccccctgcaagatccccttctccacgcaggacgagaagggggtgacccagaacggccggctgatcaccgccaacccgatcgtgaccgacaaggagaagcccgtcaacatcgaggccgagccgcccttcggggagagctacatcgtgatcggcgcgggcgagaaggccctcaagctgtcctggttcaagaaggggagctccatcggcaagatgttcgaggccacggcccgcggggcccggcgcatggcgatcctgggcgacaccgcctgggacttcgggagcatcggcggcgtgttcacctccgtcgggaagctcgtgcaccagatcttcggcaccgcctacggggtgctgttcagcggcgtctcctggacgatgaagatcgggatcggcgtgctgctcacctggctgggcctgaacagccgctccaccagcctctccatgacctgcatcgccgtggggctggtcacgctgtacctcggcgtgatggtgcaggccgacagcgggtgcgtcatcaactggaagggccgggagctgaagtgcgggtccggcatcttcgtgaccaacgaggtgcacacctggaccgagcagtacaagttccaggcggacagcccgcgccggctgagcgccgccatcggcaaggcctgggaggagggggtctgcggcatccgctccgccacccggctcgagaacatcatgtggaagcagatcagcaacgagctgaaccacatcctgctcgagaacgacatgaagttcacggtggtggtcggggacgtggcgggcatcctggcccaggggaagaagatgatccgcccccagcccatggagcacaagtactcctggaagtcctggggcaaggccaagatcatcggcgccgacgtgcagaacaccaccttcatcatcgacgggcccaacaccccggagtgccccgacgaccagcgggcgtggaacatctgggaggtcgaggactacggcttcgggatcttcacgaccaacatctggctgaagctccgcgactcctacacccaggtgtgcgaccaccggctgatgagcgccgccatcaaggactccaaggccgtgcacgccgacatgggctactggatcgagagcgagaagaacgagacctggaagctggcgcgcgcctccttcatcgaggtcaagacgtgcatctggcccaagagccacaccctctggtccaacggcgtgctggagagcgagatgatcatccccaagatctacgggggcccgatctcccagcacaactaccggcccgggtacttcacccagaccgccggcccctggcacctggggaagctcgagctggacttcgacctgtgcgagggcacgaccgtggtcgtggacgagcactgcggcaaccgcgggccgagcctccggaccaccacggtgaccggcaagatcatccacgagtggtgctgccgctcctgcaccctgccgcccctgcggttccgcggggaggacggctgctggtacgggatggagatccggcccgtcaaggagaaggaggagaacctcgtcaagagcatggtgtccgccggcagcggcgaggtcgacagcttctccctggggctgctctgcatcagcatcatgatcgaggaggtgatgcgctcccggtggagccgcaagatgctgatcaccggcacgctggccgtgttcttcctcctgatcatggggcaggtcacctggaacgacctgatccgcctctgcatcatggtgggcgcgaacgcctccgaccggatggggatgggcaccacctacctggccctgatggccacgttcaagatgcgcccgatgttcgccgtgggcctcctgttccggcgcctgaccagccgggaggtcctcctgctgaccatcgggctctccctggtggcgagcgtcgagctgcccaactccctcgaggagctgggcgacgggctggccatgggcatcatgatcctcaagctgctgaccgacttccagccccaccagctctgggccacgctgctgagcctcaccttcatcaagaccaccttctccctgcactacgcctggaagacgatggcgatggtgctgagcatcgtgtccctcttccccctgtgcctgagcaccacctcccagaagaccacgtggctcccggtcctgctgggcagcctcgggtgcaagcccctgaccatgttcctgatcgccgagaacaagatctggggccgcaagtcctggcccctcaacgaggggatcatggccgtgggcatcgtgagcatcctgctgtccagcctcctgaagaacgacgtccccctggccgggccgctcatcgccggcggcatgctgatcgcgtgctacgtgatcagcgggtccagcgccgacctgtccctcgagaaggccgccgaggtgagctgggaggaggaggccgagcactccggcgcgagccacaacatcctggtcgaggtgcaggacgacgggaccatgaagatcaaggacgaggagcgggacgacaccctgaccatcctcctgaaggccacgctgctcgccgtgtccggcgtctaccccctgagcatccccgccaccctgttcgtgtggtacttctggcagaagaagaagcagcgctccggggtgctctgggacacccccagcccgcccgaggtcgagcgggccgtgctggacgacggcatctaccgcatcatgcagcggggcctgctggggcgctcccaggtgggcgtcggggtgttccaggagaacgtgttccacaccatgtggcacgtcacgcggggcgcggtgctcatgtaccaggggaagcgcctggagcccagctgggcctccgtgaagaaggacctgatcagctacggcggcgggtggcggctccagggctcctggaacaccggggaggaggtccaggtgatcgccgtggagcccggcaagaacccgaagaacgtccagaccgcccccgggaccttcaagacgcccgagggcgaggtgggcgccatcgcgctggacttcaagcccgggaccagcggctccccgatcgtgaaccgcgaggggaagatcgtcggcctgtacggcaacggggtggtgaccaccagcggcacgtacgtctccgccatcgcccaggccaaggcgagccaggaggggcccctccccgagatcgaggacgaggtgttccggaagcgcaacctgaccatcatggacctgcacccgggcagcgggaagacccggcgctacctccccgccatcgtgcgggaggccatcaagcgcaagctgcgcaccctgatcctcgcccccacgcgggtcgtggcctccgagatggcggaggccctgaagggcatgcccatccgctaccagaccaccgccgtcaagagcgagcacaccggcaaggagatcgtcgacctgatgtgccacgccacgttcaccatgcggctcctgtccccggtgcgcgtgcccaactacaacatgatcatcatggacgaggcccacttcaccgaccccagctccatcgcggcccgggggtacatcagcacccgcgtcggcatgggggaggccgccgccatcttcatgacggcgacgccgcccggctccgtggaggccttcccccagagcaacgccgtgatccaggacgaggagcgggacatccccgagcgctcctggaacagcgggtacgagtggatcaccgacttccccggcaagaccgtctggttcgtgccgtccatcaagagcggcaacgacatcgccaactgcctgcggaagaacgggaagcgcgtgatccagctctcccggaagacgttcgacaccgagtaccagaagaccaagaacaacgactgggactacgtcgtgaccacggacatcagcgagatgggcgcgaacttccgcgccgaccgggtgatcgacccccgccggtgcctgaagcccgtcatcctgaaggacgggcccgagcgcgtgatcctcgccggcccgatgcccgtcaccgtggcctccgccgcgcagcggcgcgggcggatcggccgcaaccacaacaaggagggcgaccagtacatctacatggggcagcccctgaacaacgacgaggaccacgcccactggaccgaggccaagatgctgctcgacaacatcaacacccccgagggcatcatcccggccctgttcgagcccgagcgcgagaagtccgccgcgatcgacggggagtaccggctgcgcggcgaggcccggaagacgttcgtggagctcatgcgccgcggggacctgcccgtctggctgtcctacaaggtggccagcgagggcttccagtactccgaccgccggtggtgcttcgacggcgagcgcaacaaccaggtgctcgaggagaacatggacgtcgagatctggaccaaggagggggagcggaagaagctgcgcccccggtggctggacgcccgcacctacagcgacccgctcgccctgcgggagttcaaggagttcgcggccggccgccggagcgtgtccggggacctgatcctcgagatcggcaagctgccccagcacctgacccagcgcgcccagaacgccctcgacaacctggtgatgctgcacaacagcgagcagggcgggcgggcgtaccgccacgccatggaggagctccccgacacgatcgagaccctgatgctgctcgccctgatcgccgtcctgaccggcggggtgaccctcttcttcctgtccggccgggggctgggcaagaccagcatcggcctcctgtgcgtgatggcctccagcgtcctgctctggatggcgtccgtggagccccactggatcgccgccagcatcatcctggagttcttcctgatggtgctcctgatcccggagcccgaccgccagcggacgccccaggacaaccagctggcctacgtcgtgatcgggctcctgttcatgatcctgaccgtggccgcgaacgagatgggcctcctggagaccaccaagaaggacctggggatcggccacgtcgccgtggagaaccaccaccacgccgccatgctcgacgtggacctgcacccggcctccgcgtggacgctgtacgccgtcgccaccaccatcatcacccccatgatgcgccacacgatcgagaacaccaccgccaacatcagcctcaccgccatcgcgaaccaggccgccatcctgatggggctggacaagggctggcccatctccaagatggacatcggcgtgcccctcctggccctggggtgctacagccaggtgaacccgctcacgctgaccgcggccgtcctgatgctcgtggcccactacgccatcatcggccccgggctgcaggccaaggcgacccgcgaggcccagaagcggaccgccgccggcatcatgaagaaccccacggtggacgggatcgtcgccatcgacctggaccccgtggtgtacgacgcgaagttcgagaagcagctcggccagatcatgctgctgatcctctgcacctcccagatcctgctgatgcgcaccacctgggccctctgcgagagcatcacgctggccaccggcccgctgaccaccctctgggaggggtcccccggcaagttctggaacacgaccatcgccgtcagcatggccaacatcttccgggggtcctacctggcgggcgccggcctggccttcagcctcatgaagtccctcgggggcgggcgccgggggaccggggcccagggcgagaccctgggcgagaagtggaagcgccagctcaaccagctgagcaagagcgagttcaacacgtacaagcggtccgggatcatggaggtggaccgcagcgaggcgaaggagggcctgaagcgcggggagaccaccaagcacgccgtgtcccgcggcaccgccaagctccggtggttcgtcgagcgcaacctggtgaagcccgaggggaaggtgatcgacctgggctgcggccgcggcgggtggagctactactgcgccgggctgaagaaggtcacggaggtgaaggggtacaccaagggcggccccggccacgaggagccgatccccatggccacctacgggtggaacctcgtgaagctgcactccggcaaggacgtcttcttcatcccgcccgagaagtgcgacaccctgctctgcgacatcggggagagctccccgaaccccacgatcgaggagggccgcaccctgcgggtgctgaagatggtggagccctggctccgcgggaaccagttctgcatcaagatcctgaacccctacatgccgagcgtcgtggagaccctggagcagatgcagcggaagcacggcggcatgctcgtgcgcaaccccctgtcccggaacagcacccacgagatgtactgggtctcctgcgggaccggcaacatcgtgagcgcggtgaacatgacgtcccgcatgctgctcaaccgcttcaccatggcccaccggaagcccacctacgagcgcgacgtcgacctgggggccggcacccggcacgtggccgtggagcccgaggtcgccaacctggacatcatcggccagcgcatcgagaacatcaagcacgagcacaagagcacgtggcactacgacgaggacaacccgtacaagacctgggcgtaccacgggtcctacgaggtgaagcccagcggctccgccagctccatggtcaacggggtggtgaagctcctgaccaagccctgggacgtcatccccatggtgacccagatcgccatgacggacaccaccccgttcggccagcagcgggtgttcaaggagaaggtcgacacccgcacgcccaaggccaagcgggggaccgcccagatcatggaggtgaccgcgcgctggctgtggggcttcctcagccggaacaagaagccccgcatctgcacccgggaggagttcacgcgcaaggtgcggagcaacgccgccatcggcgccgtcttcgtggacgagaaccagtggaactccgcgaaggaggccgtggaggacgagcgcttctgggacctggtccaccgggagcgcgagctgcacaagcaggggaagtgcgcgacctgcgtgtacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacaccgccggctgggacacccgcatcacggaggacgacctgcagaacgaggccaagatcaccgacatcatggagcccgagcacgcgctcctggccaaggccatcttcaagctgacctaccagaacaaggtcgtgcgcgtgcagcggcccgccaagaacgggaccgtcatggacgtgatctcccgccgggaccagcgcggcagcggccaggtgggcacgtacggcctcaacaccttcaccaacatggaggcccagctgatccggcagatggagtccgaggggatcttcagcccctccgagctggagaccccgaacctcgcggagcgcgtcctgtactggctggagaagtacggcgtggagcggctcaagcgcatggccatcagcggggacgactgcgtggtcaagcccatcgacgaccggttcgccacggccctgaccgccctgaacgacatgggcaaggtgcgcaaggacatcccccagtgggagccctccaaggggtggaacgactggcagcaggtcccgttctgcagccaccacttccaccagctcatcatgaaggacggccgggagatcgtcgtgccctgccgcaaccaggacgagctggtgggccgggcgcgcgtctcccagggggccggctggagcctgcgggagaccgcctgcctcgggaagtcctacgcccagatgtggcagctgatgtacttccaccgccgggacctgcgcctcgcggccaacgccatctgcagcgccgtgcccgtggactgggtccccaccagccggacgacctggtccatccacgcccaccaccagtggatgaccaccgaggacatgctgagcgtgtggaaccgcgtgtggatcgaggagaacccgtggatggaggacaagacgcacatctccagctgggaggacgtcccctacctgggcaagcgcgaggaccagtggtgcgggtccctcatcggcctgaccgcgcgggccacctgggccaccaacatccaggtggccatcaaccaggtgcgccggctgatcggcaacgagaactacctcgactacatgaccagcatgaagcgcttcaagaacgagtccgaccccgagggggccctgtggtga

SEQ ID NO: 8919 - RNA, 9879 nt, synthetic construct
  misc_feature 1..9879: note = derived and/or modified CDS sequence (opt1) from DENV-1__KM403627__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctgacgcaggggaagaagatgatccggccccagcccatggagcacaagtactcctggaagtcctggggcaaggcgaagatcatcggcgccgacatccagaacaccaccttcatcatcgacgggcccgacaccccggagtgccccgacgaccagcgcgcctggaacatctgggaggtcgaggactacggcttcggggtgttcacgaccaacatctggctgaagctccgggactcctacacccagatgtgcgaccaccgcctgatgagcgccgcgatcaaggactccaaggccgtgcacgccgacatgggctactggatcgagagcgagaagaacgagacctggaagctggcccgggcctccttcatcgaggtcaagacgtgcatctggccccgcagccacaccctctggtccaacggcgtgctggagagcgagatgatcatccccaagatctacgggggcccgatctcccagcacaactaccggcccgggtacttcacccagaccgcgggcccctggcacctggggaagctcgagctggacttcaacctgtgcgagggcacgaccgtggtcgtggacgagcactgcggcaaccgcgggccgagcctccggaccaccacggtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggctgctctgcgtgagcatcatgatcgaggaggtgatgcggtcccgctggagccgcaagatgctgatgaccggcacgctggccgtcttcttcctcctgatcatggggcagctgacctggaacgacctcatccggctgtgcatcatggtgggcgccaacgtgtccgaccgcatggggatgggcaccacctacctggccctcatggcgacgttcaagatgcggccgatgttcgccgtcggcctgctgttccgccggctcaccagccgcgaggtgctgctgctcaccatcgggctgtccctggtcgccagcgtggagctccccaactccctggaggagctgggcgacgggctcgccatgggcatcatgatgctgaagctgctcaccgacttccagagccaccagctgtggacgaccctgctctccctgaccttcatcaagaccacgctgagcctcgactacgcctggaagaccatggcgatggtgctgtccatcgtcagcctgttccccctctgcctgtccaccaccagccagaagacgacctggctgcccgtgctcctgggctccttcgggtgcaagccgctgaccatgttcctcatcaccgagaacaagatctggggccgcaagagctggcccctgaacgaggggatcatggccgtgggcatcgtctccatcctgctcagcagcctgctgaagaacgacgtgcccctcgccgggcccctgatcgccggcggcatgctgatcgcgtgctacgtgatctccgggagctccgccgacctcagcctggagcgcgccgccgaggtctcctgggaggaggaggccgagcacagcggcgcgtcccacaacatcctggtggaggtgcaggacgacgggaccatgaagatcaaggacgaggagcgggacgacacgctcaccatcctgctgaaggccaccctcctggccgtcagcggcgtgtacccgatgtccatccccgccaccctgttcgtgtggtacttctggcagaagaagaagcagcgcagcggggtcctctgggacacgcccagcccgcccgaggtggagcgggccgtgctggacgacggcatctaccgcatcctgcagcggggcctgctcgggcgcagccaggtcggcgtgggggtgttccaggacggcgtcttccacaccatgtggcacgtgacccgcggggccgtgctgatgtaccagggcaagcgcctggagccctcctgggccagcgtcaagaaggacctcatctcctacggcgggggctggcggttccaggggagctggaacaccggcgaggaggtccaggtgatcgccgtcgagcccgggaagaaccccaagaacgtgcagacgacccccggcaccttcaagacccccgagggcgaggtgggggccatcgccctggacttcaagcccggcacgtccgggagccccatcgtcaaccgcgagggcaagatcgtgggcctgtacgggaacggcgtggtcaccacctccgggacctacgtgagcgcgatcgcccaggccaaggccagccaggagggcccgctccccgagatcgaggacgaggtgttcaagaagcggaacctgacgatcatggacctgcaccccgggtccggcaagacccgccggtacctcccggccatcgtccgcgaggcgatcaagcgcaagctgcggaccctgatcctcgcccccacccgcgtggtggccagcgagatggccgaggcgctgaagggcatgcccatccggtaccagacgaccgccgtcaagtccgagcacaccgggaaggagatcgtggacctgatgtgccacgccaccttcacgatgcgcctcctgagccccgtgcgggtcccgaactacaacatgatcatcatggacgaggcccacttcaccgaccccgcctccatcgcggcccgcggctacatcagcacccgggtggggatgggcgaggccgccgccatcttcatgaccgcgacgccgcccgggtccgtggagagcttcccgcagtccaacgccgtcatccaggacgaggagcgcgacatccccgagcggagctggaactccggctacgactggatcaccgacttccccggcaagaccgtgtggttcgtgcccagcatcaagtccgggaacgacatcgccaactgcctgcgcaagaacggcaagcgggtcatccagctcagccgcaagaccttcgacacggagtaccagaagaccaagaacaacgactgggactacgtggtgaccaccgacatctccgagatgggggccaacttccgggccgaccgcgtcatcgacccgcggcgctgcctgaagcccgtgatcctgaaggacggccccgagcgggtcatcctcgcggggcccatgccggtgacggccgccagcgccgcgcagcgccggggccgcatcggccgcaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgggagaagtccgccgcgatcgacggcgagtaccgcctgcgcggggaggcccgcaagaccttcgtggagctcatgcggcgcggcgacctgcccgtctggctgagctacaaggtggcctccgagggcttccagtacagcgaccggcgctggtgcttcgacggggagcggaacaaccaggtgctcgaggagaacatggacgtcgagatctggacgaaggagggcgagcgcaagaagctgcggccccgctggctggacgcccggacctacagcgaccccctcgccctgcgcgagttcaaggagttcgcggccgggcggcgctccgtgagcggcgacctgatcctcgagatcggcaagctgccgcagcacctgaccctccgggcccagaacgccctggacaacctggtgatgctccacaactccgagcagggcgggaaggcctaccgccacgcgatggaggagctgcccgacaccatcgagaccctgatgctcctggccctgatcgccgtcctcaccggcggggtgaccctgttcttcctgagcgggaaggggctcggcaagacctccatcgggctgctgtgcgtgatggccagctccgtcctcctgtggatggcgagcgtggagccccactggatcgccgcctccatcatcctggagttcttcctcatggtgctgctgatccccgagccggaccggcagcgcacgccccaggacaaccagctcgcctacgtcgtgatcggcctgctgttcatgatcctcacggtggccgcgaacgagatggggctgctggagaccaccaagaaggacctcggcatcgggcacgtcgtggccgagaaccaccaccacgccaccatgctggacatcgacctgcaccccgccagcgcctggacgctctacgcggtggccaccaccatcatcaccccgatgatgcggcacacgatcgagaacaccaccgccaacatctccctgaccgccatcgccaaccaggcggccatcctgatgggcctcgacaagggctggcccatcagcaagatggacatcggggtccccctgctggccctcggctgctactcccaggtgaaccccctgacgctgaccgccgccgtgctcatgctggtcgcgcactacgccatcatcgggccgggcctgcaggccaaggccacccgcgaggcgcagaagcgcaccgccgccgggatcatgaagaaccccacggtggacggcatcgtggccatcgacctcgaccccgtcgtgtacgacgccaagttcgagaagcagctgggccagatcatgctgctcatcctgtgcaccagccagatcctgctcatgcggaccacctgggcgctgtgcgagtccatcacgctggccaccgggcccctcaccaccctgtgggagggcagcccggggaagttctggaacacgaccatcgccgtgtccatggccaacatcttccgcggcagctacctggccggcgcggggctcgccttctccctgatgaagtccctgggcgggggccggcgcgggaccggcgcccagggcgagaccctcggggagaagtggaagcggcagctgaaccagctgagcaagtccgagttcaacacgtacaagcgcagcggcatcatggaggtcgaccggtccgaggccaaggaggggctcaagcgcggcgagaccaccaagcacgccgtgagccgggggaccgcgaagctgcgctggttcgtggagcggaacctggtcaagcccgagggcaaggtgatcgacctgggctgcgggcgcggcgggtggtcctactactgcgccggcctcaagaaggtgacggaggtcaaggggtacaccaagggcggccccgggcacgaggagcccatcccgatggccacctacggctggaacatcgtgaagctgcacagcgggcgggacgtgttcttcacgccgcccgagaagtgcgacaccctgctctgcgacatcggcgagtccagccccaacccgacgatcgaggaggggcgcaccctgcgggtcctgaagatggtggagccctggctccgcggcaaccagttctgcatcaagatcctgaacccctacatgccctccgtggtcgagaccctggagcagatgcagcggaagcacggcgggatgctcgtgcgcaacccgctgagccggaactccacccacgagatgtactgggtgagctgcggcacggggaacatcgtctccgccgtgaacatgaccagccgcatgctgctcaaccgcttcaccatggcgcaccggaagcccacctacgagcgcgacgtggacctgggcgccggcacgcggcacgtcgccgtggagcccgagatcgccaacctggacatcatcgggcagcgcatcgagaacatcaagaacgagcacaagtccacctggcactacgacgaggacaacccctacaagacctgggcctaccacggcagctacgaggtgaagccgtccgggagcgcgtccagcatggtcaacggcgtggtccggctcctgaccaagccctgggacgtgatccccatggtgacgcagatcgccatgaccgacaccacccccttcgggcagcagcgcgtcttcaaggagaaggtggacacgcggaccccgcgccccaagcggggcaccgcccagatcatggaggtgaccgccaagtggctgtggggcttcctcagccgcaacaagaagccccggatctgcacgcgcgaggagttcacccggaaggtccgctccaacgccgcgatcggggccgtgttcgtggacgagaaccagtggaacagcgccaaggaggccgtcgaggacgagcggttctgggacctggtgcaccgcgagcgggagctgcacaagcagggcaagtgcgcgacctgcgtgtacaacatgatggggaagcgcgagaagaagctcggcgagttcgggaaggcgaagggctcccgggccatctggtacatgtggctgggcgcccgcttcctggagttcgaggccctcgggttcatgaacgaggaccactggttcagccgggagaactccctgagcggcgtcgagggggagggcctgcacaagctcgggtacatcctgcgcgacatctccaagatcccgggcggcaacatgtacgcggacgacaccgccgggtgggacacgcgcatcaccgaggacgacctgcagaacgaggccaagatcaccgacatcatggagcccgagcacgccctcctggccaccagcatcttcaagctgacgtaccagaacaaggtggtgcgggtccagcgccccgcgaagtccggcaccgtgatggacgtgatcagccggcgcgaccagcgggggtccggccaggtcggcacctacgggctcaacaccttcacgaacatggaggtgcagctgatccgccagatggagagcgagggcatcttctcccccagcgagctggagaactccaacctcgccgagcgggtgctggactggctggagaagcacggggtcgagcgcctcaagcggatggccatcagcggcgacgactgcgtggtgaagccgaccgacgaccgcttcgccaccgccctgaccgcgctgaacgacatggggaaggtccggaaggacatcccccagtgggagccctccaagggctggaacgactggcagcaggtccccttctgcagccaccacttccaccagctcatcatgaaggacggccgcgagatcgtggtcccgtgccggaaccaggacgagctggtggggcgcgcccgggtgagccagggcgccgggtggtccctgcgcgagacggcctgcctcggcaagagctacgcccagatgtggcagctgatgtacttccaccggcgcgacctgcggctcgcggccaacgccatctgctccgccgtccccgtgaactgggtgcccaccagccgcaccacctggtccatccacgcccaccaccagtggatgaccacggaggacatgctgagcgtctggaaccgcgtgtggatcgaggagaacccctggatggaggacaagacccacgtgtccagctgggaggacgtcccgtacctggggaagcgggaggaccagtggtgcggctccctcatcggcctgaccgcgcgcgccacctgggccacgaacatccaggtggccatcaaccaggtgcggcgcctgatcgggaacgagaactacctcgactacatgaccagcatgaagcggttcaagaacgagtccgaccccgagggcgcgctgtggtga

SEQ ID NO: 8920 - RNA, 9879 nt, synthetic construct
  misc_feature 1..9879: note = derived and/or modified CDS sequence (opt1) from DENV-1__KM403584__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgaggtccagctgaccgactacggggccctcaccctggactgcagcccccggaccggcctggacttcaacgagatggtgctcctgacgatgaaggagaagtcctggctggtgcacaagcagtggttcctcgacctgccgctgccctggacctccggggccagcaccagccaggagacctggaaccggcaggacctcctggtcacgttcaagaccgcccacgcgaagaagcaggaggtggtggtcctgggctcccaggagggcgccatgcacaccgccctcaccggggccacggagatccagaccagcggcaccaccacgatcttcgccgggcacctgaagtgccgcctgaagatggacaagctcaccctgaagggcgtgtcctacgtgatgtgcaccgggagcttcaagctggagaaggaggtcgcggagacccagcacggcacggtgctggtgcaggtcaagtacgagggcaccgacgccccctgcaagatccccatctccacccaggacgagaagggggtgacccagaacggccggctcatcacggccaacccgatcgtgaccgacaaggagaagcccgtcaacatcgagaccgagccgcccttcggggagagctacatcgtgatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtcgggaagctggtgcaccaggtgttcggcaccgcctacggggtcctgttcagcggcgtgtcctggaccatgaagatcgggatcggcatcctcctgacgtggctgggcctcaacagccgctccaccagcctgtccatgacctgcatcgccgtggggatggtcaccctgtacctcggcgtgatggtgcaggccgacagcgggtgcgtcatcaactggaagggccgggagctgaagtgcgggtccggcatcttcgtgacgaacgaggtgcacacctggaccgagcagtacaagttccaggccgacagcccgaagcgcctgagcgcggccatcggcaaggcctgggaggagggggtctgcggcatccggtccgccacccgcctcgagaacatcatgtggaagcagatcagcaacgagctgaaccacatcctgctcgagaacgacatgaagttcaccgtggtggtcggggacgcctacggcatcctgacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtggaggactacggcttcggggtgttcaccaccaacatctggctgaagctccgggactcctacacccagatgtgcgaccaccgcctgatgagcgccgcgatcaaggactccaaggccgtccacgccgacatgggctactggatcgagagcgagaagaacgagacgtggaagctggcccgggcctccttcatcgaggtgaagacctgcatctggccccgcagccacaccctctggtccaacggcgtgctggagagcgagatgatcatccccaagatctacgggggcccgatctcccagcacaactaccggcccgggtacttcacccagacggcgggcccctggcacctggggaagctcgagctggacttcaacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggctgctctgcgtgagcatcatgatcgaggaggtcatgcggtcccgctggagccgcaagatgctgatgacgggcaccctggccgtgttcttcctcctgatcatggggcagctgacctggaacgacctcatccggctgtgcatcatggtgggcgccaacgtctccgaccgcatggggatgggcaccacgtacctggccctcatggcgaccttcaagatgcggccgatgttcgccgtggggctgctgttccgccggctcaccagccgcgaggtcctgctgctcaccatcgggctgtccctggtggccagcgtggagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcctggaagaccatggcgatggtcctgtccatcgtgagcctgttccccctctgcctgtccaccacgagccagaagaccacctggctgcccgtgctcctgggctccttcgggtgcaagccgctgaccatgttcctcatcaccgagaacaagatctggggccgcaagagctggcccctgaacgaggggatcatggccgtcggcatcgtgtccatcctgctcagcagcctgctgaagaacgacgtgcccctcgccgggcccctgatcgccggcggcatgctgatcgcgtgctacgtcatctccgggagctccgccgacctcagcctggagcgcgccgccgaggtgtcctgggaggaggaggccgagcacagcggcgcgtcccacaacatcctggtggaggtccaggacgacgggacgatgaagatcaaggacgaggagcgggacgacaccctcaccatcctgctgaaggccaccctcctggccgtgagcggcgtgtacccgatgtccatccccgccacgctgttcgtctggtacttctggcagaagaagaagcagcgcagcggggtgctctgggacacccccagcccgcccgaggtggagcgggccgtcctggacgacggcatctaccgcatcctgcagcggggcctgctcgggcgcagccaggtgggcgtgggggtcttccaggacggcgtgttccacaccatgtggcacgtgacccgcggggcggtcctgatgtaccagggcaagcgcctggagccctcctgggccagcgtgaagaaggacctcatctcctacggcgggggctggcggttccaggggagctggaacacgggcgaggaggtgcaggtcatcgccgtggagcccgggaagaaccccaagaacgtgcagaccacccccggcaccttcaagacgcccgagggcgaggtcggggccatcgccctggacttcaagcccggcacctccgggagccccatcgtgaaccgcgagggcaagatcgtgggcctgtacgggaacggcgtcgtgaccacctccgggacgtacgtgagcgcgatcgcccaggccaaggccagccaggagggcccgctccccgagatcgaggacgaggtcttcaagaagcggaacctgaccatcatggacctgcaccccgggtccggcaagacccgccggtacctcccggccatcgtgcgcgaggcgatcaagcgcaagctgcggaccctgatcctcgcccccacgcgcgtggtcgccagcgagatggccgaggcgctgaagggcatgcccatccggtaccagaccaccgccgtgaagtccgagcacaccgggaaggagatcgtggacctgatgtgccacgccacgttcaccatgcgcctcctgagccccgtccgggtgccgaactacaacatgatcatcatggacgaggcccacttcaccgaccccgcctccatcgcggcccgcggctacatcagcacccgggtggggatgggcgaggccgccgccatcttcatgacggcgacgccgcccgggtccgtcgaggccttcccgcagagcaacgccgtgatccaggacgaggagcgcgacatccccgagcggtcctggaacagcggctacgactggatcaccgacttccccggcaagaccgtgtggttcgtcccctccatcaagagcgggaacgacatcgccaactgcctgcgcaagaacggcaagcgggtgatccagctctcccgcaagacgttcgacaccgagtaccagaagaccaagaacaacgactgggactacgtggtcaccacggacatcagcgagatgggggccaacttccgggcggaccgcgtgatcgacccgcggcgctgcctgaagcccgtcatcctgaaggacggccccgagcgggtgatcctcgccgggcccatgccggtgaccgccgcctccgcggcccagcgccggggccgcatcggccgcaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgggagaagtccgcggccatcgacggcgagtaccgcctgcgcggggaggcccgcaagacgttcgtcgagctcatgcggcgcggcgacctgcccgtgtggctgtcctacaaggtggccagcgagggcttccagtactccgaccggcgctggtgcttcgacggggagcggaacaaccaggtcctcgaggagaacatggacgtggagatctggaccaaggagggcgagcgcaagaagctgcggccccgctggctggacgcccggacctacagcgaccccctcgcgctgcgcgagttcaaggagttcgccgccgggcggcgcagcgtgtccggcgacctgatcctcgagatcggcaagctgccgcagcacctgaccctccgggcccagaacgccctggacaacctggtcatgctccacaacagcgagcagggcgggaaggcgtaccgccacgccatggaggagctgcccgacaccatcgagacgctgatgctcctggccctgatcgccgtgctcaccgggggcgtgaccctgttcttcctgtccgggaagggcctcggcaagaccagcatcgggctgctgtgcgtcatggcgtccagcgtgctcctgtggatggcctccgtggagccccactggatcgccgccagcatcatcctggagttcttcctcatggtcctgctgatccccgagccggaccggcagcgcacgccccaggacaaccagctcgcctacgtggtgatcggcctgctgttcatgatcctcaccgtcgcggccaacgagatggggctgctggagaccaccaagaaggacctcggcatcgggcacgtggtggccgagaaccaccaccacgccacgatgctggacatcgacctgcaccccgcctccgcgtggaccctctacgccgtcgccaccaccatcatcacgccgatgatgcggcacaccatcgagaacaccaccgccaacatcagcctgacggccatcgcgaaccaggccgccatcctgatgggcctcgacaagggctggcccatctccaagatggacatcggggtgcccctgctggccctcggctgctacagccaggtgaaccccctgaccctgaccgccgcggtcctcatgctggtggcccactacgccatcatcgggccgggcctgcaggccaaggcgacccgcgaggcccagaagcgcacggccgccgggatcatgaagaaccccaccgtggacggcatcgtcgccatcgacctcgaccccgtggtgtacgacgcgaagttcgagaagcagctgggccagatcatgctgctcatcctgtgcacctcccagatcctgctcatgcggaccacgtgggccctgtgcgagagcatcaccctggccaccgggcccctcaccacgctgtgggagggctccccggggcgcttctggaacaccaccatcgccgtcagcatggccaacatcttccggggctcctacctggcgggcgccgggctcgccttcagcctgatgaagtccctgggcgggggccgccgggggaccggcgcccagggcgagacgctcggggagaagtggaagcgccagctgaaccagctgagcaagagcgagttcaacacctacaagcggtccggcatcatggaggtggaccgcagcgaggccaaggaggggatgaagcggggcgagaccaccaagcacgcggtgtcccgcgggacggccaagctccggtggttcgtcgagcgcaacctggtgaagcccgagggcaaggtgatcgacctgggctgcgggcggggcgggtggagctactactgcgccggcctgaagaaggtcaccgaggtgaaggggtacaccaagggcggccccgggcacgaggagcccatcccgatggccacctacggctggaacatcgtgaagctccactccgggcgcgacgtcttcttcacgccgcccgagaagtgcgacacgctgctgtgcgacatcggcgagagctcccccaacccgaccatcgaggaggggcggaccctccgcgtgctgaagatggtggagccctggctgcggggcaaccagttctgcatcaagatcctcaacccctacatgcccagcgtcgtggagaccctggagcagatgcagcgcaagcacggcgggatgctggtgcggaacccgctctcccgcaacagcacgcacgagatgtactgggtctcctgcggcaccgggaacatcgtgagcgcggtgaacatgacctcccgcatgctgctgaaccggttcaccatggcccaccgcaagcccacgtacgagcgggacgtcgacctcggcgccggcacccgccacgtggccgtggagcccgagatcgccaacctggacatcatcgggcagcggatcgagaacatcaagaacgagcacaagagcacctggcactacgacgaggacaacccctacaagacctgggcgtaccacggctcctacgaggtcaagccgagcgggtccgccagctccatggtgaacggcgtcgtgcgcctgctcacgaagccctgggacgtgatccccatggtcacccagatcgccatgaccgacaccacgcccttcgggcagcagcgggtgttcaaggagaaggtggacacccgcaccccgcggcccaagcgcggcaccgcccagatcatggaggtcacggccaagtggctgtggggcttcctgagccggaacaagaagccccgcatctgcacccgggaggagttcacccgcaaggtgcggagcaacgcggccatcggggccgtgttcgtcgacgagaaccagtggaactccgccaaggaggccgtggaggacgagcgcttctgggacctcgtgcaccgggagcgcgagctgcacaagcagggcaagtgcgcgacctgcgtctacaacatgatggggaagcgggagaagaagctgggcgagttcgggaaggccaagggcagccgcgccatctggtacatgtggctcggcgcccggttcctggagttcgaggcgctggggttcatgaacgaggaccactggttctcccgcgagaacagcctctccggcgtggagggggagggcctgcacaagctggggtacatcctccgcgacatcagcaagatcccgggcggcaacatgtacgccgacgacacggccgggtgggacacccggatcaccgaggacgacctgcagaacgaggccaagatcaccgacatcatggagcccgagcacgccctgctcgcgacgtccatcttcaagctgacctaccagaacaaggtggtccgcgtgcagcggcccgccaagagcggcaccgtgatggacgtcatctcccgccgggaccagcgcgggagcggccaggtgggcacctacgggctgaacacgttcaccaacatggaggtgcagctcatccggcagatggagtccgagggcatcttcagcccctccgagctggagaacagcaacctggccgagcgcgtcctcgactggctggagaagcacggggtggagcggctgaagcgcatggccatctccggcgacgactgcgtggtcaagccgaccgacgaccggttcgccaccgcgctcacggccctgaacgacatggggaaggtgcgcaaggacatcccccagtgggagcccagcaagggctggaacgactggcagcaggtccccttctgctcccaccacttccaccagctgatcatgaaggacggccgggagatcgtcgtgccgtgccgcaaccaggacgagctcgtggggcgggcccgcgtcagccagggcgccgggtggagcctgcgggagaccgcctgcctgggcaagtcctacgcgcagatgtggcagctcatgtacttccaccgccgggacctgcgcctggccgccaacgccatctgcagcgccgtgcccgtgaactgggtccccacctcccgcaccacctggagcatccacgcgcaccaccagtggatgacgaccgaggacatgctctccgtgtggaaccgggtgtggatcgaggagaacccctggatggaggacaagacccacgtcagctcctgggaggacgtgccgtacctggggaagcgcgaggaccagtggtgcggcagcctgatcggcctcaccgcccgggccacgtgggccaccaacatccaggtggcgatcaaccaggtccgccggctgatcgggaacgagaactacctggactacatgacctccatgaagcgcttcaagaacgagagcgaccccgagggcgccctctggtga

SEQ ID NO: 8921 - RNA, 9879 nt, synthetic construct
  misc_feature 1..9879: note = derived and/or modified CDS sequence (opt1) from DENV-1__KM403633__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgcgggagaagtcctggctggtgcacaagcagtggttcctcgacctgccgctgccctggacctccggggccagcaccagccaggagacctggaaccgccaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccggctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccgcctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccgccgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccggtccaccagcctgtccatgacctgcatcgccgtggggatggtgaccctgtacctcggcgtcatggtgcaggccgacagcgggtgcgtgatcaactggaagggccgcgagctgaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcaccgtcgtggtgggggacgccaacggcatcctgacgcaggggaagaagatgatccgcccccagcccatggagcacaagtactcctggaagtcctggggcaaggcgaagatcatcggcgccgacacccagaacaccaccttcatcatcgacgggcccgacacgccggagtgccccgacgaccagcgggcctggaacatctgggaggtcgaggactacggcttcggggtgttcaccaccaacatctggctgaagctccgcgactcctacacccagatgtgcgaccaccggctgatgagcgccgcgatcaaggactccaaggccgtgcacgccgacatgggctactggatcgagagcgagaagaacgagacgtggaagctggcccgcgcctccttcatcgaggtcaagacctgcatctggccccggagccacaccctctggtccaacggcgtgctggagagcgagatgatcatccccaagatctacgggggcccgatctcccagcacaactaccgccccgggtacttcacccagacggcgggcccctggcacctggggaagctcgagctggacttcaacctgtgcgagggcaccaccgtggtcgtggacgagcactgcggcaaccgggggccgagcctccgcaccacgaccgtgaccggcaagatcatccacgagtggtgctgccggtcctgcaccctgccgcccctgcgcttccgcggggaggacggctgctggtacgggatggagatccgccccgtcaaggagaaggaggagaacctcgtgcggagcatggtgtccgccggcagcggcgaggtcgacagcttctccctggggctgctctgcgtgagcatcatgatcgaggaggtgatgcgctcccgctggagccggaagatgctgatgacgggcaccctggccgtcttcttcctcctgatcatggggcagctgacctggaacgacctcatccgcctgtgcatcatggtgggcgccaacgtgtccgaccggatggggatgggcaccacgtacctggccctcatggcgaccttcaagatgcgcccgatgttcgccgtcgggctgctgttccggcgcctcaccagccgggaggtgctgctgctcaccatcgggctgtccctggtcgccagcgtggagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcctggaagaccatggcgatggtgctgtccatcgtcagcctgttccccctctgcctgtccaccacgagccagaagaccacctggctgcccgtgctcctgggctccttcgggtgcaagccgctgaccatgttcctcatcaccgagaacaagatctggggccgcaagagctggcccctgaacgaggggatcatggccgtgggcatcgtctccatcctgctcagcagcctgctgaagaacgacgtgcccctcgccgggcccctgatcgccggcggcatgctgatcgcgtgctacgtgatctccgggagctccgccgacctcagcctggagcgggccgccgaggtctcctgggaggaggaggccgagcacagcggcgcgtcccacaacatcctggtggaggtgcaggacgacgggacgatgaagatcaaggacgaggagcgcgacgacaccctcaccatcctgctgaaggccaccctcctggccgtcagcggcgtgtacccgatgtccatccccgccacgctgttcgtgtggtacttctggcagaagaagaagcagcggagcggggtcctctgggacacccccagcccgcccgaggtggagcgcgccgtgctggacgacggcatctaccggatcctgcagcgcggcctgctcgggcggagccaggtcggcgtgggggtgttccaggacggcgtcttccacaccatgtggcacgtgacccgcggggcggtgctgatgtaccagggcaagcggctggagccctcctgggccagcgtcaagaaggacctcatctcctacggcgggggctggcgcttccaggggagctggaacacgggcgaggaggtccaggtgatcgccgtcgagcccgggaagaaccccaagaacgtgcagaccacccccggcaccttcaagacgcccgagggcgaggtgggggccatcgccctggacttcaagcccggcacctccgggagccccatcgtcaaccgggagggcaagatcgtgggcctgtacgggaacggcgtggtcaccacctccgggacgtacgtgagcgcgatcgcccaggccaaggccagccaggagggcccgctccccgagatcgaggacgaggtgttcaagaagcgcaacctgaccatcatggacctgcaccccgggtccggcaagacccggcgctacctcccggccatcgtccgcgaggcgatcaagcggaagctgcgcaccctgatcctcgcccccacgcgggtggtggccagcgagatggccgaggcgctgaagggcatgcccatccgctaccagaccaccgccgtcaagtccgagcacaccgggaaggagatcgtggacctgatgtgccacgccacgttcaccatgcggctcctgagccccgtgcgcgtcccgaactacaacatgatcatcatggacgaggcccacttcaccgaccccgcctccatcgcggcccggggctacatcagcacccgcgtggggatgggcgaggccgccgccatcttcatgacggcgacgccgcccgggtccgtggaggccttcccgcagagcaacgccgtcatccaggacgaggagcgggacatccccgagcgctcctggaacagcggctacgactggatcaccgacttccccggcaagaccgtgtggttcgtgccctccatcaagagcgggaacgacatcgccaactgcctgcggaagaacggcaagcgcgtcatccagctctcccggaagacgttcgacaccgagtaccagaagaccaagaacaacgactgggactacgtggtgaccacggacatcagcgagatgggggccaacttccgcgcggaccgggtcatcgacccgcgccggtgcctgaagcccgtgatcctgaaggacggccccgagcgcgtcatcctcgccgggcccatgccggtgaccgccgcctccgcggcccagcggcgcggccgcatcggccggaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgcgagaagtccgcggccatcgacggcgagtaccggctgcgcggggaggcccggaagacgttcgtggagctcatgcgccggggcgacctgcccgtctggctgtcctacaaggtggccagcgagggcttccagtactccgaccgccggtggtgcttcgacggggagcgcaacaaccaggtgctcgaggagaacatggacgtcgagatctggaccaaggagggcgagcggaagaagctgcgcccccggtggctggacgcccgcacctacagcgaccccctcgcgctgcgggagttcaaggagttcgccgccgggcgccggagcgtgtccggcgacctgatcctcgagatcggcaagctgccgcagcacctgaccctccgcgcccagaacgccctggacaacctggtgatgctccacaacagcgagcagggcgggaaggcgtaccggcacgccatggaggagctgcccgacaccatcgagacgctgatgctcctggccctgatcgccgtcctcaccgggggcgtgaccctgttcttcctgtccgggaagggcctcggcaagaccagcatcgggctgctgtgcgtgatggcgtccagcgtcctcctgtggatggcctccgtggagccccactggatcgccgccagcatcatcctggagttcttcctcatggtgctgctgatccccgagccggaccgccagcggacgccccaggacaaccagctcgcctacgtcgtgatcggcctgctgttcatgatcctcaccgtggcggccaacgagatggggctgctggagaccaccaagaaggacctcggcatcgggcacgtcgtggccgagaaccaccaccacgccacgatgctggacatcgacctgcaccccgcctccgcgtggaccctctacgccgtggccaccaccatcatcacgccgatgatgcgccacaccatcgagaacaccaccgccaacatcagcctgacggccatcgcgaaccaggccgccatcctgatgggcctcgacaagggctggcccatctccaagatggacatcggggtccccctgctggccctcggctgctacagccaggtgaaccccctgaccctgaccgccgcggtgctcatgctggtcgcccactacgccatcatcgggccgggcctgcaggccaaggcgacccgcgaggcccagaagcggacggccgccgggatcatgaagaaccccaccgtggacggcatcgtggccatcgacctcgaccccgtcgtgtacgacgcgaagttcgagaagcagctgggccagatcatgctgctcatcctgtgcacctcccagatcctgctcatgcgcaccacgtgggccctgtgcgagagcatcaccctggccaccgggcccctcaccacgctgtgggagggctccccggggaagttctggaacaccaccatcgccgtgagcatggccaacatcttccggggctcctacctggcgggcgccgggctcgccttcagcctgatgaagtccctgggcgggggccgccgggggaccggcgcccagggcgagacgctcggggagaagtggaagcgccagctgaaccagctgagcaagagcgagttcaacacctacaagcggtccggcatcatggaggtcgaccgcagcgaggccaaggaggggctcaagcggggcgagaccaccaagcacgcggtgtcccgcgggacggccaagctgcggtggttcgtggagcgcaacctggtcaagcccgagggcaaggtgatcgacctgggctgcgggcggggcgggtggagctactactgcgccggcctcaagaaggtgaccgaggtcaaggggtacaccaagggcggccccgggcacgaggagcccatcccgatggccacctacggctggaacatcgtgaagctgcactccgggcgcgacgtgttcttcacgccgcccgagaagtgcgacacgctgctctgcgacatcggcgagagctcccccaacccgaccatcgaggaggggcggaccctgcgcgtcctgaagatggtggagccctggctccggggcaaccagttctgcatcaagatcctgaacccctacatgcccagcgtggtcgagaccctggagcagatgcagcgcaagcacggcgggatgctcgtgcggaacccgctgtcccgcaacagcacgcacgagatgtactgggtgtcctgcggcaccgggaacatcgtcagcgcggtgaacatgacctcccgcatgctgctcaaccggttcaccatggcccaccgcaagcccacgtacgagcgggacgtggacctgggcgccggcacccgccacgtcgccgtggagcccgagatcgccaacctggacatcatcgggcagcggatcgagaacatcaagaacgagcacaagagcacctggcactacgacgaggacaacccctacaagacctgggcgtaccacggctcctacgaggtgaagccgagcgggtccgccagctccatggtcaacggcgtggtccgcctcctgacgaagccctgggacgtgatccccatggtgacccagatcgccatgaccgacaccacgcccttcgggcagcagcgggtcttcaaggagaaggtggacacccgcaccccgcggcccaagcgcggcaccgcccagatcatggaggtgacggccaagtggctgtggggcttcctcagccggaacaagaagccccgcatctgcacccgggaggagttcacccgcaaggtccggagcaacgcggccatcggggccgtgttcgtggacgagaaccagtggaactccgccaaggaggccgtcgaggacgagcgcttctgggacctggtgcaccgggagcgcgagctgcacaagcagggcaagtgcgcgacctgcgtgtacaacatgatggggaagcgggagaagaagctcggcgagttcgggaaggccaagggcagccgcgccatctggtacatgtggctgggcgcccggttcctggagttcgaggcgctcgggttcatgaacgaggaccactggttctcccgcgagaacagcctgtccggcgtcgagggggagggcctgcacaagctcgggtacatcctgcgcgacatcagcaagatcccgggcggcaacatgtacgccgacgacacggccgggtgggacacccggatcaccgaggacgacctgcagaacgaggccaagatcaccgacatcatggagcccgagcacgccctcctggcgacgtccatcttcaagctgacctaccagaacaaggtggtgcgcgtccagcggcccgccaagagcggcaccgtgatggacgtgatctcccgccgggaccagcgcgggagcggccaggtcggcacctacgggctcaacacgttcaccaacatggaggtgcagctgatccggcagatggagtccgagggcatcttcagcccctccgagctggagaacagcaacctcgccgagcgcgtgctggactggctggagaagcacggggtcgagcggctcaagcgcatggccatctccggcgacgactgcgtggtgaagccgaccgacgaccggttcgccaccgcgctgacggccctgaacgacatggggaaggtccgcaaggacatcccccagtgggagcccagcaagggctggaacgactggcagcaggtccccttctgctcccaccacttccaccagctcatcatgaaggacggccgggagatcgtggtcccgtgccgcaaccaggacgagctggtggggcgggcccgcgtgagccagggcgccgggtggagcctgcgggagaccgcctgcctcggcaagtcctacgcgcagatgtggcagctgatgtacttccaccgccgggacctgcgcctcgccgccaacgccatctgcagcgccgtccccgtgaactgggtgcccacctcccgcaccacctggagcatccacgcgcaccaccagtggatgacgaccgaggacatgctgtccgtctggaaccgggtgtggatcgaggagaacccctggatggaggacaagacccacgtgagctcctgggaggacgtcccgtacctggggaagcgcgaggaccagtggtgcggcagcctcatcggcctgaccgcccgggccacgtgggccaccaacatccaggtggcgatcaaccaggtgcgccggctgatcgggaacgagaactacctcgactacatgacctccatgaagcgcttcaagaacgagagcgaccccgagggcgccctgtggtga

SEQ ID NO: 8922 - RNA, 9879 nt, synthetic construct
  misc_feature 1..9879: note = derived and/or modified CDS sequence (opt1) from DENV-1__KM403592__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgccggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggcggcagatccagaaggtcgagacctgggccctgcgccaccccgggttcaccgtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcgcccagaacggccggctcatcaccgccaacccgatcgtgacggacaaggagaagcccgtgaacatcgagaccgagccgcccttcggggagagctacatcgtcatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtggggaagctggtccaccaggtgttcggcaccgcctacggggtgctgttcagcggcgtctcctggaccatgaagatcgggatcggcatcctcctgacctggctgggcctcaacagccgctccacgagcctgtccatgacctgcatcgccgtggggatggtgaccctgtacctcggcgtcatggtgcaggccgacagcgggtgcgtgatcaactggaagggccgggagctgaagtgcgggtccggcatcttcgtcaccaacgaggtgcacacgtggaccgagcagtacaagttccaggcggacagcccgaagcgcctgagcgccgccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgcgaacggcatcctgacccaggggaagaagatgatccggccccagcccatggagcacaagtactcctggaagtcctggggcaaggccaagatcatcggcgccgacacgcagaacaccaccttcatcatcgacgggcccgacaccccggagtgccccgacgaccagcgcgcctggaacatctgggaggtcgaggactacggcttcggggtgttcacgaccaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtcaagacgtgcatctggccccgcagccacaccctctggtccaacggcgtgctggagagcgagatgatcatccccaagatctacgggggcccgatctcccagcacaactaccggcccgggtacttcacccagaccgccggcccctggcacctggggaagctcgagctggacttcaacctgtgcgagggcacgaccgtggtcgtggacgagcactgcggcaaccgcgggccgagcctccggaccaccacggtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggctgctctgcgtgagcatcatgatcgaggaggtgatgcggtcccgctggagccgcaagatgctgatgaccggcacgctggccgtcttcttcctcctgatcatggggcagctgacctggaacgacctcgtgcggctgtgcatcatggtgggcgccaacgtctccgaccgcatggggatgggcaccacctacctggcgctcatggccacgttcaagatgcggccgatgttcgccgtggggctgctgttccgccggctcaccagccgcgaggtcctgctgctcaccatcgggctgtccctggtggccagcgtggagctccccaactccctggaggagctgggcgacgggctcgccatgggcatcatgatgctgaagctgctcaccgacttccagagccaccagctgtggacgaccctgctctccctgaccttcatcaagaccacgctgagcctcgactacgcgtggaagaccatggccatggtcctgtccatcgtgagcctgttccccctctgcctgtccaccaccagccagaagacgacctggctgcccgtgctcctgggctccttcgggtgcaagccgctgaccatgttcctcatcaccgagaacaagatctggggccgcaagagctggcccctgaacgaggggatcatggccgtcggcatcgtgtccatcctgctcagcagcctgctgaagaacgacgtgcccctcgccgggcccctgatcgcgggcggcatgctgatcgcctgctacgtcatctccgggagctccgccgacctcagcctggagcgcgccgccgaggtgtcctgggaggaggaggcggagcacagcggcgcctcccacaacatcctggtggaggtccaggacgacgggaccatgaagatcaaggacgaggagcgggacgacacgctcaccatcctgctgaaggccaccctcctggccgtgagcggcgtgtacccgatgtccatccccgccaccctgttcgtctggtacttctggcagaagaagaagcagcgcagcggggtgctctgggacacgcccagcccgcccgaggtggagcgggcggtcctggacgacggcatctaccgcatcctgcagcggggcctgctcgggcgcagccaggtgggcgtgggggtcttccaggacggcgtgttccacaccatgtggcacgtgacccgcggggccgtcctgatgtaccagggcaagcgcctggagccctcctgggccagcgtgaagaaggacctcatctcctacggcgggggctggcggttccaggggagctggaacaccggcgaggaggtgcaggtcatcgccgtggagcccgggaagaaccccaagaacgtgcagacgatgcccggcaccttcaagacccccgagggcgaggtcggggccatcgcgctggacttcaagcccggcacctccgggagccccatcgtgaaccgcgagggcaagatcgtgggcctgtacgggaacggcgtcgtgacgacctccgggacctacgtgagcgccatcgcccaggccaaggccagccaggagggcccgctccccgagatcgaggacgaggtcttcaagaagcggaacctgaccatcatggacctgcaccccgggtccggcaagacgcgccggtacctcccggcgatcgtgcgcgaggccatcaagcgcaagctgcggaccctgatcctcgcccccacccgcgtggtcgccagcgagatggcggaggccctgaagggcatgcccatccggtaccagaccacggccgtgaagtccgagcacaccgggaaggagatcgtggacctgatgtgccacgccaccttcaccatgcgcctcctgagccccgtccgggtgccgaactacaacatgatcatcatggacgaggcccacttcacggaccccgcgtccatcgccgcccgcggctacatcagcacccgggtggggatgggcgaggccgccgcgatcttcatgaccgccacgccgcccgggtccgtcgaggccttcccgcagagcaacgccgtgatccaggacgaggagcgcgacatccccgagcggtcctggaacagcggctacgactggatcacggacttccccggcaagaccgtgtggttcgtcccctccatcaagagcgggaacgacatcgccaactgcctgcgcaagaacggcaagcgggtgatccagctctcccgcaagaccttcgacaccgagtaccagaagacgaagaacaacgactgggactacgtggtcaccaccgacatcagcgagatgggggcgaacttccgggccgaccgcgtgatcgacccgcggcgctgcctgaagcccgtcatcctgaaggacggccccgagcgggtgatcctcgccgggcccatgccggtgaccgccgcgtccgccgcccagcgccggggccgcatcggccgcaaccagaacaaggagggggaccagtacatctacatgggccagcccctgaacaacgacgaggaccacgcccactggacggaggccaagatgctgctcgacaacatcaacacccccgaggggatcatccccgcgctgttcgagccggagcgggagaagtccgccgccatcgacggcgagtaccgcctgcgcggggaggcccgcaagaccttcgtcgagctcatgcggcgcggcgacctgcccgtgtggctgtcctacaaggtggccagcgagggcttccagtactccgaccggcgctggtgcttcgacggggagcggaacaaccaggtcctcgaggagaacatggacgtggagatctggaccaaggagggcgagcgcaagaagctgcggccccgctggctggacgcgcggacgtacagcgaccccctcgccctgcgcgagttcaaggagttcgccgccgggcggcgcagcgtgtccggcgacctgatcctcgagatcggcaagctgccgcagcacctgaccctccgggcccagaacgcgctggacaacctggtcatgctccacaacagcgagcagggcgggaaggcctaccgccacgccatggaggagctgcccgacaccatcgagaccctgatgctcctggccctgatcgcggtgctcaccgggggcgtgacgctgttcttcctgtccgggaagggcctcggcaagaccagcatcgggctgctgtgcgtcatggcctccagcgtgctcctgtggatggcctccgtggagccccactggatcgccgccagcatcatcctggagttcttcctcatggtcctgctgatccccgagccggaccggcagcgcacgccccaggacaaccagctcgcgtacgtggtgatcggcctgctgttcatgatcctcaccgtcgccgccaacgagatggggctgctggagacgaccaagaaggacctcggcatcgggcacgtggtggccgagaaccaccaccacgccaccatgctggacatcgacctgcaccccgcgtccgcctggaccctctacgccgtcgccacgaccatcatcaccccgatgatgcggcacaccatcgagaacacgaccgccaacatcagcctgaccgcgatcgccaaccaggccgccatcctgatgggcctcgacaagggctggcccatctccaagatggacatcggggtgcccctgctggccctcggctgctacagccaggtgaaccccctgaccctgacggcggccgtcctcatgctggtggcccactacgccatcatcgggccgggcctgcaggcgaaggccacccgcgaggcccagaagcgcaccgccgccgggatcatgaagaaccccaccgtggacggcatcgtcgcgatcgacctcgaccccgtggtgtacgacgccaagttcgagaagcagctgggccagatcatgctgctcatcctgtgcacgtcccagatcctgctcatgcggaccacctgggccctgtgcgagagcatcaccctggccacggggcccctcaccaccctgtgggagggctccccggggaagttctggaacaccacgatcgccgtcagcatggcgaacatcttccgcggctcctacctggccggcgccgggctcgccttcagcctgatgaagtccctgggcgggggccggcgcgggaccggcgcccagggcgagaccctcggggagaagtggaagcggcagctgaaccagctgagcaagagcgagttcaacacctacaagcgctccggcatcatggaggtggaccggagcgaggcgaaggaggggctcaagcgcggcgagacgaccaagcacgccgtgtcccgggggaccgccaagctgcgctggttcgtcgagcggaacctggtgaagcccgagggcaaggtgatcgacctgggctgcgggcgcggcgggtggagctactactgcgccggcctcaagaaggtcaccgaggtgaaggggtacacgaagggcggccccgggcacgaggagcccatcccgatggcgacctacggctggaacatcgtgaagctgcactccgggcgggacgtcttcttcacgccgcccgagaagtgcgacaccctgctctgcgacatcggcgagagctcccccaacccgaccatcgaggaggggcgcacgctgcgggtgctgaagatggtggagccctggctccgcggcaaccagttctgcatcaagatcctgaacccctacatgcccagcgtcgtggagaccctggagcagatgcagcggaagcacggcgggatgctcgtgcgcaacccgctgtcccggaacagcacccacgagatgtactgggtctcctgcggcaccgggaacatcgtgagcgccgtgaacatgacgtcccgcatgctgctcaaccgcttcaccatggcccaccggaagcccacctacgagcgcgacgtcgacctgggcgccggcacccggcacgtggccgtggagcccgagatcgcgaacctggacatcatcgggcagcgcatcgagaacatcaagaacgagcacaagagcacgtggcactacgacgaggacaacccctacaagacctgggcctaccacggctcctacgaggtcaagccgagcgggtccgccagctccatggtgaacggcgtcgtgcggctcctgaccaagccctgggacgtgatccccatggtcacccagatcgccatgacggacaccacccccttcgggcagcagcgcgtgttcaaggagaaggtggacacccggacgccgcgccccaagcggggcaccgcccagatcatggaggtcaccgcgaagtggctgtggggcttcctcagccgcaacaagaagccccggatctgcacccgcgaggagttcacgcggaaggtgcgcagcaacgccgccatcggggccgtgttcgtcgacgagaaccagtggaactccgccaaggaggcggtggaggacgagcggttctgggacctggtgcaccgcgagcgggagctgcacaagcagggcaagtgcgcgacctgcgtctacaacatgatggggaagcgcgagaagaagctcggcgagttcgggaaggccaagggcagccgggccatctggtacatgtggctgggcgcgcgcttcctggagttcgaggccctcgggttcatgaacgaggaccactggttctcccgggagaacagcctgtccggcgtggagggggagggcctgcacaagctcgggtacatcctgcgcgacatcagcaagatcccgggcggcaacatgtacgccgacgacaccgccgggtgggacacccgcatcacggaggacgacctgcagaacgaggccaagatcaccgacatcatggagcccgagcacgcgctcctggccacctccatcttcaagctgacctaccagaacaaggtggtccgggtgcagcgccccgccaagagcggcacggtgatggacgtcatctcccggcgcgaccagcgggggagcggccaggtgggcacctacgggctcaacaccttcaccaacatggaggtgcagctgatccgccagatggagtccgagggcatcttcagcccctccgagctggagaacagcaacctcgccgagcgggtcctggactggctggagaagcacggggtggagcgcctcaagcggatggccatctccggcgacgactgcgtggtcaagccgacggacgaccgcttcgcgaccgccctgaccgccctgaacgacatggggaaggtgcggaaggacatcccccagtgggagcccagcaagggctggaacgactggcagcaggtccccttctgctcccaccacttccaccagctcatcatgaaggacggccgcgagatcgtcgtgccgtgccggaaccaggacgagctggtggggcgcgcccgggtcagccagggcgccgggtggagcctgcgcgagaccgcgtgcctcggcaagtcctacgcccagatgtggcagctgatgtacttccaccggcgcgacctgcggctcgccgccaacgccatctgcagcgcggtgcccgtgaactgggtccccacgtcccgcaccacctggagcatccacgcccaccaccagtggatgaccaccgaggacatgctgtccgtgtggaaccgcgtgtggatcgaggagaacccctggatggaggacaagacgcacgtcagctcctgggaggacgtgccgtacctggggaagcgggaggaccagtggtgcggcagcctcatcggcctgaccgcccgcgccacctgggcgaccaacatccaggtggccatcaaccaggtccggcgcctgatcgggaacgagaactacctcgactacatgacgtccatgaagcggttcaagaacgagagcgaccccgagggcgccctgtggtga

SEQ ID NO: 8923 - RNA, 9879 nt, synthetic construct
  misc_feature 1..9879: note = derived and/or modified CDS sequence (opt1) from DENV-1__KM403593__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgccggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcgcccagaacggccggctcatcaccgccaacccgatcgtgacggacaaggagaagcccgtgaacatcgagaccgagccgcccttcggggagagctacatcgtcatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtggggaagctggtccaccaggtgttcggcaccgcctacggggtgctgttcagcggcgtctcctggaccatgaagatcgggatcggcatcctcctgacctggctgggcctcaacagccgctccacgagcctgtccatgacctgcatcgccgtggggatggtgaccctgtacctcggcgtcatggtgcaggccgacagcgggtgcgtgatcaactggaagggccgggagctgaagtgcgggtccggcatcttcgtcaccaacgaggtgcacacgtggaccgagcagtacaagttccaggcggacagcccgaagcgcctgagcgccgccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgcgaacggcatcctgacccaggggaagaagatgatccggccccagcccatggagcacaagtactcctggaagtcctggggcaaggccaagatcatcggcgccgacacgcagaacaccaccttcatcatcgacgggcccgacaccccggagtgccccgacgaccagcgcgcctggaacatctgggaggtcgaggactacggcttcggggtgttcacgaccaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtcaagacgtgcatctggccccgcagccacaccctctggtccaacggcgtgctggagagcgagatgatcatccccaagatctacgggggcccgatctcccagcacaactaccggcccgggtacttcacccagaccgccggcccctggcacctggggaagctcgagctggacttcaacctgtgcgagggcacgaccgtggtcgtggacgagcactgcggcaaccgcgggccgagcctccggaccaccacggtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggctgctctgcgtgagcatcatgatcgaggaggtgatgcggtcccgctggagccgcaagatgctgatgaccggcacgctggccgtcttcttcctcctgatcatggggcagctgacctggaacgacctcatccggctgtgcatcatggtgggcgccaacgtgtccgaccgcatggggatgggcaccacctacctggcgctcatggccacgttcaagatgcggccgatgttcgccgtcggcctgctgttccgccggctcaccagccgcgaggtgctgctgctcaccatcgggctgtccctggtcgccagcgtggagctccccaactccctggaggagctgggcgacgggctcgccatgggcatcatgatgctgaagctgctcaccgacttccagagccaccagctgtggacgaccctgctctccctgaccttcatcaagaccacgctgagcctcgactacgcgtggaagaccatggccatggtgctgtccatcgtcagcctgttccccctctgcctgtccaccaccagccagaagacgacctggctgcccgtgctcctgggctccttcgggtgcaagccgctgaccatgttcctcatcaccgagaacaagatctggggccgcaagagctggcccctgaacgaggggatcatggccgtgggcatcgtctccatcctgctcagcagcctgctgaagaacgacgtgcccctcgccgggcccctgatcgcgggcggcatgctgatcgcctgctacgtgatctccgggagctccgccgacctcagcctggagcgcgccgccgaggtctcctgggaggaggaggcggagcacagcggcgcctcccacaacatcctggtggaggtgcaggacgacgggaccatgaagatcaaggacgaggagcgggacgacacgctcaccatcctgctgaaggccaccctcctggccgtcagcggcgtgtacccgatgtccatccccgccaccctgttcgtgtggtacttctggcagaagaagaagcagcgcagcggggtcctctgggacacgcccagcccgcccgaggtggagcgggcggtgctggacgacggcatctaccgcatcctgcagcggggcctgctcgggcgcagccaggtcggcgtgggggtgttccaggacggcgtcttccacaccatgtggcacgtgacccgcggggccgtgctgatgtaccagggcaagcgcctggagccctcctgggccagcgtcaagaaggacctcatctcctacggcgggggctggcggttccaggggagctggaacaccggcgaggaggtccaggtgatcgccgtcgagcccgggaagaaccccaagaacgtgcagacgacccccggcaccttcaagacccccgagggcgaggtgggggccatcgcgctggacttcaagcccggcacgtccgggagccccatcgtcaaccgcgagggcaagatcgtgggcctgtacgggaacggcgtggtcaccacctccgggacctacgtgagcgccatcgcccaggccaaggccagccaggagggcccgctccccgagatcgaggacgaggtgttcaagaagcggaacctgacgatcatggacctgcaccccgggtccggcaagacccgccggtacctcccggcgatcgtccgcgaggccatcaagcgcaagctgcggaccctgatcctcgcccccacccgcgtggtggccagcgagatggcggaggccctgaagggcatgcccatccggtaccagacgaccgccgtcaagtccgagcacaccgggaaggagatcgtggacctgatgtgccacgccaccttcacgatgcgcctcctgagccccgtgcgggtcccgaactacaacatgatcatcatggacgaggcccacttcaccgaccccgcgtccatcgccgcccgcggctacatcagcacccgggtggggatgggcgaggccgccgcgatcttcatgaccgccacgccgcccgggtccgtggaggccttcccgcagagcaacgccgtcatccaggacgaggagcgcgacatccccgagcggtcctggaacagcggctacgactggatcaccgacttccccggcaagaccgtgtggttcgtgccctccatcaagagcgggaacgacatcgccaactgcctgcgcaagaacggcaagcgggtcatccagctctcccgcaagaccttcgacacggagtaccagaagaccaagaacaacgactgggactacgtggtgaccaccgacatcagcgagatgggggcgaacttccgggccgaccgcgtcatcgacccgcggcgctgcctgaagcccgtgatcctgaaggacggccccgagcgggtcatcctcgccgggcccatgccggtgacggccgcgtccgccgcccagcgccggggccgcatcggccgcaaccagaacaaggagggggaccagtacatctacatgggccagcccctgaacaacgacgaggaccacgcccactggaccgaggccaagatgctgctcgacaacatcaacacccccgaggggatcatccccgcgctgttcgagccggagcgggagaagtccgccgccatcgacggcgagtaccgcctgcgcggggaggcccgcaagaccttcgtggagctcatgcggcgcggcgacctgcccgtctggctgtcctacaaggtggccagcgagggcttccagtactccgaccggcgctggtgcttcgacggggagcggaacaaccaggtgctcgaggagaacatggacgtcgagatctggacgaaggagggcgagcgcaagaagctgcggccccgctggctggacgcgcggacctacagcgaccccctcgccctgcgcgagttcaaggagttcgccgccgggcggcgcagcgtgtccggcgacctgatcctcgagatcggcaagctgccgcagcacctgaccctccgggcccagaacgcgctggacaacctggtgatgctccacaacagcgagcagggcgggaaggcctaccgccacgccatggaggagctgcccgacaccatcgagaccctgatgctcctggccctgatcgcggtcctcaccggcggggtgaccctgttcttcctgtccgggaaggggctcggcaagaccagcatcgggctgctgtgcgtgatggcctccagcgtcctcctgtggatggcctccgtggagccccactggatcgccgccagcatcatcctggagttcttcctcatggtgctgctgatccccgagccggaccggcagcgcacgccccaggacaaccagctcgcgtacgtcgtgatcggcctgctgttcatgatcctcacggtggccgccaacgagatggggctgctggagaccaccaagaaggacctcggcatcgggcacgtcgtggccgagaaccaccaccacgccaccatgctggacatcgacctgcaccccgcgtccgcctggacgctctacgccgtggccaccaccatcatcaccccgatgatgcggcacacgatcgagaacaccaccgccaacatcagcctgaccgcgatcgccaaccaggccgccatcctgatgggcctcgacaagggctggcccatctccaagatggacatcggggtccccctgctggccctcggctgctacagccaggtgaaccccctgacgctgaccgcggccgtgctcatgctggtcgcccactacgccatcatcgggccgggcctgcaggcgaaggccacccgcgaggcccagaagcgcaccgccgccgggatcatgaagaaccccacggtggacggcatcgtggcgatcgacctcgaccccgtcgtgtacgacgccaagttcgagaagcagctgggccagatcatgctgctcatcctgtgcacctcccagatcctgctcatgcggaccacctgggccctgtgcgagagcatcacgctggccaccgggcccctcaccaccctgtgggagggctccccggggaagttctggaacacgaccatcgccgtgagcatggcgaacatcttccgcggctcctacctggccggcgccgggctcgccttcagcctgatgaagtccctgggcgggggccggcgcgggaccggcgcccagggcgagaccctcggggagaagtggaagcggcagctgaaccagctgagcaagagcgagttcaacacgtacaagcgctccggcatcatggaggtcgaccggagcgaggcgaaggaggggctcaagcgcggcgagaccaccaagcacgccgtgtcccgggggaccgccaagctgcgctggttcgtggagcggaacctggtcaagcccgagggcaaggtgatcgacctgggctgcgggcgcggcgggtggagctactactgcgccggcctcaagaaggtgacggaggtcaaggggtacaccaagggcggccccgggcacgaggagcccatcccgatggcgacctacggctggaacatcgtgaagctgcactccgggcgggacgtgttcttcacgccgcccgagaagtgcgacaccctgctctgcgacatcggcgagagctcccccaacccgacgatcgaggaggggcgcaccctgcgggtcctgaagatggtggagccctggctccgcggcaaccagttctgcatcaagatcctgaacccctacatgcccagcgtggtcgagaccctggagcagatgcagcggaagcacggcgggatgctcgtgcgcaacccgctgtcccggaacagcacccacgagatgtactgggtgtcctgcggcacggggaacatcgtcagcgccgtgaacatgacctcccgcatgctgctcaaccgcttcaccatggcccaccggaagcccacctacgagcgcgacgtggacctgggcgccggcacgcggcacgtcgccgtggagcccgagatcgcgaacctggacatcatcgggcagcgcatcgagaacatcaagaacgagcacaagagcacctggcactacgacgaggacaacccctacaagacctgggcctaccacggctcctacgaggtgaagccgagcgggtccgccagctccatggtcaacggcgtggtccggctcctgaccaagccctgggacgtgatccccatggtgacgcagatcgccatgaccgacaccacccccttcgggcagcagcgcgtcttcaaggagaaggtggacacgcggaccccgcgccccaagcggggcaccgcccagatcatggaggtgaccgcgaagtggctgtggggcttcctcagccgcaacaagaagccccggatctgcacgcgcgaggagttcacccggaaggtccgcagcaacgccgccatcggggccgtgttcgtggacgagaaccagtggaactccgccaaggaggcggtcgaggacgagcggttctgggacctggtgcaccgcgagcgggagctgcacaagcagggcaagtgcgcgacctgcgtgtacaacatgatggggaagcgcgagaagaagctcggcgagttcgggaaggccaagggcagccgggccatctggtacatgtggctgggcgcgcgcttcctggagttcgaggccctcgggttcatgaacgaggaccactggttctcccgggagaacagcctgtccggcgtcgagggggagggcctgcacaagctcgggtacatcctgcgcgacatcagcaagatcccgggcggcaacatgtacgccgacgacaccgccgggtgggacacgcgcatcaccgaggacgacctgcagaacgaggccaagatcaccgacatcatggagcccgagcacgcgctcctggccacctccatcttcaagctgacgtaccagaacaaggtggtgcgggtccagcgccccgccaagagcggcaccgtgatggacgtgatctcccggcgcgaccagcgggggagcggccaggtcggcacctacgggctcaacaccttcacgaacatggaggtgcagctgatccgccagatggagtccgagggcatcttcagcccctccgagctggagaacagcaacctcgccgagcgggtgctggactggctggagaagcacggggtcgagcgcctcaagcggatggccatctccggcgacgactgcgtggtgaagccgaccgacgaccgcttcgcgaccgccctgaccgccctgaacgacatggggaaggtccggaaggacatcccccagtgggagcccagcaagggctggaacgactggcagcaggtccccttctgctcccaccacttccaccagctcatcatgaaggacggccgcgagatcgtggtcccgtgccggaaccaggacgagctggtggggcgcgcccgggtgagccagggcgccgggtggagcctgcgcgagacggcgtgcctcggcaagtcctacgcccagatgtggcagctgatgtacttccaccggcgcgacctgcggctcgccgccaacgccatctgcagcgcggtccccgtgaactgggtgcccacctcccgcaccacctggagcatccacgcccaccaccagtggatgaccacggaggacatgctgtccgtctggaaccgcgtgtggatcgaggagaacccctggatggaggacaagacccacgtgagctcctgggaggacgtcccgtacctggggaagcgggaggaccagtggtgcggcagcctcatcggcctgaccgcccgcgccacctgggcgacgaacatccaggtggccatcaaccaggtgcggcgcctgatcgggaacgagaactacctcgactacatgacctccatgaagcggttcaagaacgagagcgaccccgagggcgccctgtggtga

SEQ ID NO: 8924 - RNA, 9879 nt, synthetic construct
  misc_feature 1..9879: note = derived and/or modified CDS sequence (opt1) from DENV-1__KM403603__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctgacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtcgaggactacggcttcggggtgttcaccaccaacatctggctgaagctccgggactcctacacccagatgtgcgaccaccgcctgatgagcgccgcgatcaaggactccaaggccgtgcacgccgacatgggctactggatcgagagcgagaagaacgagacgtggaagctggcccgggcctccttcatcgaggtcaagacctgcatctggccccgcagccacaccctctggtccaacggcgtgctggagagcgagatgatcatccccaagatctacgggggcccgatctcccagcacaactaccggcccgggtacttcacccagacggcgggcccctggcacctggggaagctcgagctggacttcaacctgtgcgagggcaccaccgtggtcgtggacgagcactgcggcaaccgcgggccgagcctccggaccacgaccgtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggctgctctgcgtgagcatcatgatcgaggaggtgatgcggtcccgctggagccgcaagatgctgatgacgggcaccctggccgtcttcttcctcctgatcatggggcagctgacctggaacgacctcatccggctgtgcatcatggtgggcgccaacgtgtccgaccgcatggggatgggcaccacgtacctggccctcatggcgaccttcaagatgcggccgatgttcgccgtcgggctgctgttccgccggctcaccagccgcgaggtgctgctgctcaccatcgggctgtccctggtcgccagcgtggagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcctggaagaccatggcgatggtgctgtccatcgtcagcctgttccccctctgcctgtccaccacgagccagaagaccacctggctgcccgtgctcctgggctccttcgggtgcaagccgctgaccatgttcctcatcaccgagaacaagatctggggccgcaagagctggcccctgaacgaggggatcatggccgtgggcatcgtctccatcctgctcagcagcctgctgaagaacgacgtgcccctcgccgggcccctgatcgccggcggcatgctgatcgcgtgctacgtgatctccgggagctccgccgacctcagcctggagcgcgccgccgaggtctcctgggaggaggaggccgagcacagcggcgcgtcccacaacatcctggtggaggtgcaggacgacgggacgatgaagatcaaggacgaggagcgggacgacaccctcaccatcctgctgaaggccaccctcctggccgtcagcggcgtgtacccgatgtccatccccgccacgctgttcgtgtggtacttctggcagaagaagaagcagcgcagcggggtcctctgggacacccccagcccgcccgaggtggagcgggccgtgctggacgacggcatctaccgcatcctgcagcggggcctgctcgggcgcagccaggtcggcgtgggggtgttccaggacggcgtcttccacaccatgtggcacgtgacccgcggggcggtgctgatgtaccagggcaagcgcctggagccctcctgggccagcgtcaagaaggacctcatctcctacggcgggggctggcggttccaggggagctggaacacgggcgaggaggtccaggtgatcgccgtcgagcccgggaagaaccccaagaacgtgcagaccacccccggcaccttcaagacgcccgagggcgaggtgggggccatcgccctggacttcaagcccggcacctccgggagccccatcgtcaaccgcgagggcaagatcgtgggcctgtacgggaacggcgtggtcaccacctccgggacgtacgtgagcgcgatcgcccaggccaaggccagccaggagggcccgctccccgagatcgaggacgaggtgttcaagaagcggaacctgaccatcatggacctgcaccccgggtccggcaagacccgccggtacctcccggccatcgtccgcgaggcgatcaagcgcaagctgcggaccctgatcctcgcccccacgcgcgtggtggccagcgagatggccgaggcgctgaagggcatgcccatccggtaccagaccaccgccgtcaagtccgagcacaccgggaaggagatcgtggacctgatgtgccacgccacgttcaccatgcgcctcctgagccccgtgcgggtcccgaactacaacatgatcatcatggacgaggcccacttcaccgaccccgcctccatcgcggcccgcggctacatcagcacccgggtggggatgggcgaggccgccgccatcttcatgacggcgacgccgcccgggtccgtggaggccttcccgcagagcaacgccgtcatccaggacgaggagcgcgacatccccgagcggtcctggaacagcggctacgactggatcaccgacttccccggcaagaccgtgtggttcgtgccctccatcaagagcgggaacgacatcgccaactgcctgcgcaagaacggcaagcgggtcatccagctctcccgcaagacgttcgacaccgagtaccagaagaccaagaacaacgactgggactacgtggtgaccacggacatcagcgagatgggggccaacttccgggcggaccgcgtcatcgacccgcggcgctgcctgaagcccgtgatcctgaaggacggccccgagcgggtcatcctcgccgggcccatgccggtgaccgccgcctccgcggcccagcgccggggccgcatcggccgcaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgggagaagtccgcggccatcgacggcgagtaccgcctgcgcggggaggcccgcaagacgttcgtggagctcatgcggcgcggcgacctgcccgtctggctgtcctacaaggtggccagcgagggcttccagtactccgaccggcgctggtgcttcgacggggagcggaacaaccaggtgctcgaggagaacatggacgtcgagatctggaccaaggagggcgagcgcaagaagctgcggccccgctggctggacgcccggacctacagcgaccccctcgcgctgcgcgagttcaaggagttcgccgccgggcggcgcagcgtgtccggcgacctgatcctcgagatcggcaagctgccgcagcacctgaccctccgggcccagaacgccctggacaacctggtgatgctccacaacagcgagcagggcgggaaggcgtaccgccacgccatggaggagctgcccgacaccatcgagacgctgatgctcctggccctgatcgccgtcctcaccgggggcgtgaccctgttcttcctgtccgggaagggcctcggcaagaccagcatcgggctgctgtgcgtgatggcgtccagcgtcctcctgtggatggcctccgtggagccccactggatcgccgccagcatcatcctggagttcttcctcatggtgctgctgatccccgagccggaccggcagcgcacgccccaggacaaccagctcgcctacgtcgtgatcggcctgctgttcatgatcctcaccgtggcggccaacgagatggggctgctggagaccaccaagaaggacctcggcatcgggcacgtcgtggccgagaaccaccaccacgccacgatgctggacatcgacctgcaccccgcctccgcgtggaccctctacgccgtggccaccaccatcatcacgccgatgatgcggcacaccatcgagaacaccaccgccaacatcagcctgacggccatcgcgaaccaggccgccatcctgatgggcctcgacaagggctggcccatctccaagatggacatcggggtccccctgctggccctcggctgctacagccaggtgaaccccctgaccctgaccgccgcggtgctcatgctggtcgcccactacgccatcatcgggccgggcctgcaggccaaggcgacccgcgaggcccagaagcgcacggccgccgggatcatgaagaaccccaccgtggacggcatcgtggccatcgacctcgaccccgtcgtgtacgacgcgaagttcgagaagcagctgggccagatcatgctgctcatcctgtgcacctcccagatcctgctcatgcggaccacgtgggccctgtgcgagagcatcaccctggccaccgggcccctcaccacgctgtgggagggctccccggggaagttctggaacaccaccatcgccgtgagcatggccaacatcttccgcggctcctacctggcgggcgccgggctcgccttcagcctgatgaagaccctgggcgggggccggcgcgggacgggcgcccagggcgagaccctcggggagaagtggaagcggcagctgaaccagctgtccaagagcgagttcaacacctacaagcgcagcggcatcatggaggtcgaccggtccgaggccaaggaggggctcaagcgcggcgagaccacgaagcacgcggtgagccgggggaccgccaagctgcgctggttcgtggagcggaacctggtcaagcccgagggcaaggtgatcgacctgggctgcgggcgcggcgggtggtcctactactgcgccggcctcaagaaggtgaccgaggtcaaggggtacaccaagggcggccccgggcacgaggagcccatcccgatggccacctacggctggaacatcgtgaagctgcacagcgggcgggacgtgttcttcacgccgcccgagaagtgcgacaccctgctctgcgacatcggcgagtccagccccaacccgaccatcgaggaggggcgcaccctgcgggtcctgaagatggtggagccctggctccgcggcaaccagttctgcatcaagatcctgaacccctacatgccctccgtggtcgagacgctggagcagatgcagcggaagcacggcgggatgctcgtgcgcaacccgctgagccggaactccacccacgagatgtactgggtgagctgcggcaccgggaacatcgtctccgcggtgaacatgaccagccgcatgctgctcaaccgcttcacgatggcccaccggaagcccacctacgagcgcgacgtggacctgggcgccggcacccggcacgtcgccgtggagcccgagatcgccaacctggacatcatcgggcagcgcatcgagaacatcaagaacgagcacaagtccacctggcactacgacgaggacaacccctacaagacgtgggcgtaccacggcagctacgaggtgaagccgtccgggagcgcctccagcatggtcaacggcgtggtccggctcctgaccaagccctgggacgtgatccccatggtgacccagatcgccatgaccgacacgacccccttcgggcagcagcgcgtcttcaaggagaaggtggacacccggaccccgcgccccaagcggggcacggcccagatcatggaggtgaccgccaagtggctgtggggcttcctctcccgcaacaagaagccccggatctgcacccgcgaggagttcacccggaaggtccgcagcaacgcggccatcggggccgtgttcgtggacgagaaccagtggaacagcgccaaggaggccgtcgaggacgagcggttctgggacctggtgcaccgcgagcgggagctgcacaagcagggcaagtgcgcgacgtgcgtgtacaacatgatggggaagcgcgagaagaagctcggcgagttcgggaaggccaagggctcccgggccatctggtacatgtggctgggcgcccgcttcctggagttcgaggcgctcgggttcatgaacgaggaccactggttcagccgggagaactccctgagcggcgtcgagggggagggcctgcacaagctcgggtacatcctgcgcgacatctccaagatcccgggcggcaacatgtacgccgacgacaccgccgggtgggacacccgcatcaccgaggacgacctgcagaacgaggccaagatcacggacatcatggagcccgagcacgccctcctggcgaccagcatcttcaagctgacctaccagaacaaggtggtgcgggtccagcgccccgccaagtccggcaccgtgatggacgtgatcagccggcgcgaccagcgggggtccggccaggtcggcacgtacgggctcaacaccttcaccaacatggaggtgcagctgatccgccagatggagagcgagggcatcttctcccccagcgagctggagaactccaacctcgccgagcgggtgctggactggctggagaagcacggggtcgagcgcctcaagcggatggccatcagcggcgacgactgcgtggtgaagccgaccgacgaccgcttcgccacggcgctgaccgccctgaacgacatggggaaggtccggaaggacatcccccagtgggagccctccaagggctggaacgactggcagcaggtccccttctgcagccaccacttccaccagctcatcatgaaggacggccgcgagatcgtggtcccgtgccggaaccaggacgagctggtggggcgcgcccgggtgtcccagggcgccgggtggagcctgcgcgagaccgcctgcctcggcaagagctacgcgcagatgtggcagctgatgtacttccaccggcgcgacctgcggctcgccgccaacgccatctgctccgccgtccccgtgaactgggtgcccaccagccgcaccacgtggtccatccacgcgcaccaccagtggatgaccaccgaggacatgctgagcgtctggaaccgcgtgtggatcgaggagaacccctggatggaggacaagacccacgtgtccagctgggaggacgtcccgtacctggggaagcgggaggaccagtggtgcggctccctcatcggcctgacggcccgcgccacctgggccaccaacatccaggtggcgatcaaccaggtgcggcgcctgatcgggaacgagaactacctcgactacatgaccagcatgaagcggttcaagaacgagtccgaccccgagggcgccctgtggtga

SEQ ID NO: 8925 - RNA, 9879 nt, synthetic construct
  misc_feature 1..9879: note = derived and/or modified CDS sequence (opt1) from DENV-1__KM403585__SS-prME
  source 1..9879: mol_type = other RNA
agcgtgaccatgctgctcatgctgctgcccaccgccctcgccttccacctgaccacccggggcggggagccccacatgatcgtcagcaagcaggagcggggcaagagcctcctgttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggccgcatcgtccagtacgagaacctgaagtactccgtgatcgtgaccgtccacaccggcgaccagcaccaggtggggaacgagacgaccgagcacggcaccatcgcgaccatcacgccccaggcccccacgagcgaggtccagctgaccgactacggggccctcaccctggactgcagcccccggaccggcctggacttcaacgagatggtgctcctgacgatgaaggagaagtcctggctggtgcacaagcagtggttcctcgacctgccgctgccctggacctccggggccagcaccagccaggagacctggaaccgccaggacctcctggtcacgttcaagaccgcccacgcgaagaagcaggaggtggtggtcctgggctcccaggagggcgccatgcacaccgccctcaccggggccacggagatccagaccagcggcaccaccacgatcttcgccgggcacctgaagtgccggctgaagatggacaagctcaccctgaagggcgtgtcctacgtgatgtgcaccgggagcttcaagctggagaaggaggtcgcggagacccagcacggcacggtgctggtgcaggtcaagtacgagggcaccgacgccccctgcaagatccccatctccacccaggacgagaagggggtgacccagaacggccgcctcatcacggccaacccgatcgtgaccgacaaggagaagcccgtcaacatcgagaccgagccgcccttcggggagagctacatcgtgatcggcgccggcgagaaggcgctgaagctgtcctggttcaagaaggggagctccatcggcaagatgttcgaggccaccgcccgcggggcccgccgcatggccatcctcggcgacacggcgtgggacttcgggagcatcggcggcgtgttcacctccgtcgggaagctggtgcaccaggtgttcggcaccgcctacggggtcctgttcagcggcgtgtcctggaccatgaagatcgggatcggcatcctcctgacgtggctgggcctcaacagccggtccaccagcctgtccatgacctgcatcgccgtggggatggtcaccctgtacctcggcgtgatggtgcaggccgacagcgggtgcgtcatcaactggaagggccgcgagctgaagtgcgggtccggcatcttcgtgacgaacgaggtgcacacctggaccgagcagtacaagttccaggccgacagcccgaagcggctgagcgcggccatcggcaaggcctgggaggagggggtctgcggcatccgctccgccacccggctcgagaacatcatgtggaagcagatcagcaacgagctgaaccacatcctgctcgagaacgacatgaagttcaccgtggtggtcggggacgcctacggcatcctgacgcaggggaagaagatgatccgcccccagcccatggagcacaagtactcctggaagtcctggggcaaggcgaagatcatcggcgccgacacccagaacaccaccttcatcatcgacgggcccgacacgccggagtgccccgacgaccagcgggcctggaacatctgggaggtggaggactacggcttcggggtgttcaccaccaacatctggctgaagctccgcgactcctacacccagatgtgcgaccaccggctgatgagcgccgcgatcaaggactccaaggccgtccacgccgacatgggctactggatcgagagcgagaagaacgagacgtggaagctggcccgcgcctccttcatcgaggtgaagacctgcatctggccccggagccacaccctctggtccaacggcgtgctggagagcgagatgatcatccccaagatctacgggggcccgatctcccagcacaactaccgccccgggtacttcacccagacggcgggcccctggcacctggggaagctcgagctggacttcaacctgtgcgagggcaccaccgtcgtggtggacgagcactgcggcaaccgggggccgagcctccgcaccacgaccgtcaccggcaagatcatccacgagtggtgctgccggtcctgcaccctgccgcccctgcgcttccgcggggaggacggctgctggtacgggatggagatccgccccgtgaaggagaaggaggagaacctcgtgcggagcatggtctccgccggcagcggcgaggtggacagcttctccctggggctgctctgcgtgagcatcatgatcgaggaggtcatgcgctcccgctggagccggaagatgctgatgacgggcaccctggccgtgttcttcctcctgatcatggggcagctgacctggaacgacctcatccgcctgtgcatcatggtgggcgccaacgtctccgaccggatggggatgggcaccacgtacctggccctcatggcgaccttcaagatgcgcccgatgttcgccgtggggctgctgttccggcgcctcaccagccgggaggtcctgctgctcaccatcgggctgtccctggtggccagcgtggagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcctggaagaccatggcgatggtcctgtccatcgtgagcctgttccccctctgcctgtccaccacgagccagaagaccacctggctgcccgtgctcctgggctccttcgggtgcaagccgctgaccatgttcctcatcaccgagaacaagatctggggccgcaagagctggcccctgaacgaggggatcatggccgtcggcatcgtgtccatcctgctcagcagcctgctgaagaacgacgtgcccctcgccgggcccctgatcgccggcggcatgctgatcgcgtgctacgtcatctccgggagctccgccgacctcagcctggagcgggccgccgaggtgtcctgggaggaggaggccgagcacagcggcgcgtcccacaacatcctggtggaggtccaggacgacgggacgatgaagatcaaggacgaggagcgcgacgacaccctcaccatcctgctgaaggccaccctcctggccgtgagcggcgtgtacccgatgtccatccccgccacgctgttcgtctggtacttctggcagaagaagaagcagcggagcggggtgctctgggacacccccagcccgcccgaggtggagcgcgccgtcctggacgacggcatctaccggatcctgcagcgcggcctgctcgggcggagccaggtgggcgtgggggtcttccaggacggcgtgttccacaccatgtggcacgtgacccgcggggcggtcctgatgtaccagggcaagcggctggagccctcctgggccagcgtgaagaaggacctcatctcctacggcgggggctggcgcttccaggggagctggaacacgggcgaggaggtgcaggtcatcgccgtggagcccgggaagaaccccaagaacgtgcagaccacccccggcaccttcaagacgcccgagggcgaggtcggggccatcgccctggacttcaagcccggcacctccgggagccccatcgtgaaccgggagggcaagatcgtgggcctgtacgggaacggcgtcgtgaccacctccgggacgtacgtgagcgcgatcgcccaggccaaggccagccaggagggcccgctccccgagatcgaggacgaggtcttcaagaagcgcaacctgaccatcatggacctgcaccccgggtccggcaagacccggcgctacctcccggccatcgtgcgcgaggcgatcaagcggaagctgcgcaccctgatcctcgcccccacgcgggtggtcgccagcgagatggccgaggcgctgaagggcatgcccatccgctaccagaccaccgccgtgaagtccgagcacaccgggaaggagatcgtggacctgatgtgccacgccacgttcaccatgcggctcctgagccccgtccgcgtgccgaactacaacatgatcatcatggacgaggcccacttcaccgaccccgcctccatcgcggcccggggctacatcagcacccgcgtggggatgggcgaggccgccgccatcttcatgacggcgacgccgcccgggtccgtcgaggccttcccgcagagcaacgccgtgatccaggacgaggagcgggacatccccgagcgctcctggaacagcggctacgactggatcaccgacttccccggcaagaccgtgtggttcgtcccctccatcaagagcgggaacgacatcgccaactgcctgcggaagaacggcaagcgcgtgatccagctctcccggaagacgttcgacaccgagtaccagaagaccaagaacaacgactgggactacgtggtcaccacggacatcagcgagatgggggccaacttccgcgcggaccgggtgatcgacccgcgccggtgcctgaagcccgtcatcctgaaggacggccccgagcgcgtgatcctcgccgggcccatgccggtgaccgccgcctccgcggcccagcggcgcggccgcatcggccggaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgcgagaagtccgcggccatcgacggcgagtaccggctgcgcggggaggcccggaagacgttcgtcgagctcatgcgccggggcgacctgcccgtgtggctgtcctacaaggtggccagcgagggcttccagtactccgaccgccggtggtgcttcgacggggagcgcaacaaccaggtcctcgaggagaacatggacgtggagatctggaccaaggagggcgagcggaagaagctgcgcccccggtggctggacgcccgcacctacagcgaccccctcgcgctgcgggagttcaaggagttcgccgccgggcgccggagcgtgtccggcgacctgatcctcgagatcggcaagctgccgcagcacctgaccctccgcgcccagaacgccctggacaacctggtcatgctccacaacagcgagcagggcgggaaggcgtaccggcacgccatggaggagctgcccgacaccatcgagacgctgatgctcctggccctgatcgccgtgctcaccgggggcgtgaccctgttcttcctgtccgggaagggcctcggcaagaccagcatcgggctgctgtgcgtcatggcgtccagcgtgctcctgtggatggcctccgtggagccccactggatcgccgccagcatcatcctggagttcttcctcatggtcctgctgatccccgagccggaccgccagcggacgccccaggacaaccagctcgcctacgtggtgatcggcctgctgttcatgatcctcaccgtcgcggccaacgagatggggctgctggagaccaccaagaaggacctcggcatcgggcacgtggtggccgagaaccaccaccacgccacgatgctggacatcgacctgcaccccgcctccgcgtggaccctctacgccgtcgccaccaccatcatcacgccgatgatgcgccacaccatcgagaacaccaccgccaacatcagcctgacggccatcgcgaaccaggccgccatcctgatgggcctcgacaagggctggcccatctccaagatggacatcggggtgcccctgctggccctcggctgctacagccaggtgaaccccctgaccctgaccgccgcggtcctcatgctggtggcccactacgccatcatcgggccgggcctgcaggccaaggcgacccgcgaggcccagaagcggacggccgccgggatcatgaagaaccccaccgtggacggcatcgtcgccatcgacctcgaccccgtggtgtacgacgcgaagttcgagaagcagctgggccagatcatgctgctcatcctgtgcacctcccagatcctgctcatgcgcaccacgtgggccctgtgcgagagcatcaccctggccaccgggcccctcaccacgctgtgggagggctccccggggcggttctggaacaccaccatcgccgtcagcatggccaacatcttccgcggctcctacctggcgggcgccgggctcgccttcagcctgatgaagtccctgggcgggggccggcgcgggaccggcgcccagggcgagacgctcggggagaagtggaagcggcagctgaaccagctgagcaagagcgagttcaacacctacaagcgctccggcatcgtggaggtggaccggagcgaggccaaggaggggatgaagcgcggcgagaccaccaagcacgcggtctcccgggggacggccaagctccgctggttcgtggagcggaacctggtgaagcccgagggcaaggtcatcgacctgggctgcgggcgcggcgggtggagctactactgcgccggcctgaagaaggtgaccgaggtgaaggggtacaccaagggcggccccgggcacgaggagcccatcccgatggccacctacggctggaacatcgtcaagctccactccgggcgggacgtgttcttcacgccgcccgagaagtgcgacacgctgctgtgcgacatcggcgagagctcccccaacccgaccatcgaggaggggcgcaccctccgggtgctgaagatggtcgagccctggctgcgcggcaaccagttctgcatcaagatcctcaacccctacatgcccagcgtggtggagaccctggagcagatgcagcggaagcacggcgggatgctggtccgcaacccgctctcccgcaacagcacgcacgagatgtactgggtgtcctgcggcaccgggaacatcgtgagcgcggtcaacatgacctcccggatgctgctgaaccgcttcaccatggcccaccggaagcccacgtacgagcgcgacgtggacctcggcgccggcacccggcacgtggccgtcgagcccgagatcgccaacctggacatcatcgggcagcgcatcgagaacatcaagaacgagcacaagagcacctggcactacgacgaggacaacccctacaagacctgggcgtaccacggctcctacgaggtgaagccgagcgggtccgccagctccatggtcaacggcgtggtgcggctgctcacgaagccctgggacgtcatccccatggtgacccagatcgccatgaccgacaccacgcccttcgggcagcagcgcgtgttcaaggagaaggtcgacacccggaccccgcgccccaagcggggcaccgcccagatcatggaggtgacggccaagtggctgtggggcttcctgagccgcaacaagaagccccggatctgcacccgcgaggagttcacccggaaggtgcgcagcaacgcggccatcggggccgtcttcgtggacgagaaccagtggaactccgccaaggaggccgtggaggacgagcggttctgggacctcgtccaccgcgagcgggagctgcacaagcagggcaagtgcgcgacctgcgtgtacaacatgatggggaagcgcgagaagaagctgggcgagttcgggaaggccaagggcagccgggccatctggtacatgtggctcggcgcccgcttcctggagttcgaggcgctggggttcatgaacgaggaccactggttctcccgcgagaacagcctctccggcgtggagggggagggcctgcacaagctggggtacatcctccgggacatcagcaagatcccgggcggcaacatgtacgccgacgacacggccgggtgggacacccgcatcaccgaggacgacctgcagaacgaggccaagatcaccgacatcatggagcccgagcacgccctgctcgcgacgtccatcttcaagctgacctaccagaacaaggtcgtgcgggtgcagcgccccgccaagagcggcaccgtcatggacgtgatctcccggcgcgaccagcgggggagcggccaggtgggcacctacgggctgaacacgttcaccaacatggaggtccagctcatccgccagatggagtccgagggcatcttcagcccctccgagctggagaacagcaacctggccgagcgggtgctcgactggctggagaagcacggggtggagcgcctgaagcggatggccatctccggcgacgactgcgtcgtgaagccgaccgacgaccgcttcgccaccgcgctcacggccctgaacgacatggggaaggtgcggaaggacatcccccagtgggagcccagcaagggctggaacgactggcagcaggtccccttctgctcccaccacttccaccagctgatcatgaaggacggccgcgagatcgtggtgccgtgccggaaccaggacgagctcgtcgggcgcgcccgggtgagccagggcgccgggtggagcctgcgcgagaccgcctgcctgggcaagtcctacgcgcagatgtggcagctcatgtacttccaccggcgcgacctgcgcctggccgccaacgccatctgcagcgccgtgcccgtcaactgggtgcccacctcccggaccacctggagcatccacgcgcaccaccagtggatgacgaccgaggacatgctctccgtgtggaaccgcgtctggatcgaggagaacccctggatggaggacaagacccacgtgagctcctgggaggacgtgccgtacctggggaagcgggaggaccagtggtgcggcagcctgatcggcctcaccgcccgcgccacgtgggccaccaacatccaggtcgcgatcaaccaggtgcggcgcctgatcgggaacgagaactacctggactacatgacctccatgaagcggttcaagaacgagagcgaccccgagggcgccctctggtga

SEQ ID NO: 8926 - RNA, 9879 nt, synthetic construct
  misc_feature 1..9879: note = derived and/or modified CDS sequence (opt1) from DENV-1__KM403595__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtcacctacgggacctgcagccagaccggcgagcaccggcgcgaccggcgctccgtggccctggcgccccacgtgggcctggggctcgagacgcggaccgagacctggatgagctccgagggcgcctggcgccagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctcatcacggccaacccgatcgtgaccgacaaggagaagcccgtgaacatcgagatcgagccgcccttcggggagagctacatcgtcatcggcgccggcgagaaggcgctgaagctgtcctggttcaagaaggggagctccatcggcaagatgttcgaggccaccgcccgcggggcccgccggatggccatcctcggcgacaccgcgtgggacttcgggagcatcggcggcgtgttcacgtccgtggggaagctggtccaccaggtgttcggcaccgcctacggggtgctgttcagcggcgtctcctggaccatgaagatcgggatcggcatcctcctgacctggctgggcctcaacagccgctccacgagcctgtccatgacctgcatcgccgtggggatggtgaccctgtacctcggcgtcatggtgcaggccgacagcgggtgcgtgatcaactggaagggccgggagctgaagtgcgggtccggcatcttcgtcaccaacgaggtgcacacgtggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctgacccaggggaagaagatgatccggccccagcccatggagcacaagtactcctggaagtcctggggcaaggcgaagatcatcggcgccgacacgcagaacaccaccttcatcatcgacgggcccgacaccccggagtgccccgacgaccagcgcgcctggaacatctgggaggtcgaggactacggcttcggggtgttcacgaccaacatctggctgaagctccgggactcctacacccagatgtgcgaccaccgcctgatgagcgccgcgatcaaggactccaaggccgtgcacgccgacatgggctactggatcgagagcgagaagaacgagacctggaagctggcccgggcctccttcatcgaggtcaagacgtgcatctggccccgcagccacaccctctggtccaacggcgtgctggagagcgagatgatcatccccaagatctacgggggcccgatctcccagcacaactaccggcccgggtacttcacccagaccgcgggcccctggcacctggggaagctcgagctggacttcaacctgtgcgagggcacgaccgtggtcgtggacgagcactgcggcaaccgcgggccgagcctccggaccaccacggtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggctgctctgcgtgagcatcatgatcgaggaggtgatgcgctcccggtggagccgcaagatgctgatgaccggcacgctggccatcttcttcctcctgatcatggggcagctgacctggaacgacctcatccggctgtgcatcatggtcggcgccaacgtgtccgaccgcatggggatgggcaccacctacctggccctcatggcgacgttcaagatgcggccgatgttcgccgtgggcctgctgttccgccggctcaccagccgcgaggtcctgctgctcaccatcgggctgtccctggtggccagcgtcgagctccccaactccctggaggagctgggcgacgggctcgccatgggcatcatgatgctgaagctgctcaccgacttccagagccaccagctgtggacgaccctgctctccctgaccttcatcaagaccacgctgagcctcgactacgcctggaagaccatggcgatggtgctgtccatcgtgagcctgttccccctctgcctgtccaccaccagccagaagacgacctggctgcccgtcctcctgggctccttcgggtgcaagccgctgaccatgttcctcatcaccgagaacaagatctggggccgcaagagctggcccctgaacgaggggatcatggccgtgggcatcgtgtccatcctgctcagcagcctgctgaagaacgacgtccccctcgccgggcccctgatcgccggcggcatgctgatcgcgtgctacgtgatctccgggagctccgccgacctcagcctggagcgcgccgccgaggtgtcctgggaggaggaggccgagcacagcggcgcgtcccacaacatcctggtcgaggtgcaggacgacgggaccatgaagatcaaggacgaggagcgggacgacacgctcaccatcctgctgaaggccaccctcctggccgtgagcggcgtctacccgatgtccatccccgccaccctgttcgtgtggtacttctggcagaagaagaagcagcgcagcggggtgctctgggacacgcccagcccgcccgaggtcgagcgggccgtgctggacgacggcatctaccgcatcctgcagcggggcctgctcgggcgcagccaggtgggcgtcggggtgttccaggacggcgtgttccacaccatgtggcacgtcacccgcggggcggtgctgatgtaccagggcaagcgcctggagccctcctgggccagcgtgaagaaggacctcatctcctacggcgggggctggcggttccaggggagctggaacaccggcgaggaggtccaggtgatcgccgtggagcccgggaagaaccccaagaacgtccagacgacccccggcaccttcaagacccccgagggcgaggtgggggccatcgccctggacttcaagcccggcacgtccgggagccccatcgtgaaccgcgagggcaagatcgtcggcctgtacgggaacggcgtggtgaccacctccgggacctacgtcagcgcgatcgcccaggccaaggccagccaggagggcccgctccccgagatcgaggacgaggtgttcaagaagcggaacctgacgatcatggacctgcaccccgggtccggcaagacccgccgctacctcccggccatcgtgcgggaggcgatcaagcgcaagctgcggaccctgatcctcgcccccacccgcgtcgtggccagcgagatggccgaggcgctgaagggcatgcccatccggtaccagacgaccgccgtgaagtccgagcacaccgggaaggagatcgtcgacctgatgtgccacgccaccttcacgatgcgcctcctgagccccgtgcgggtgccgaactacaacatgatcatcatggacgaggcccacttcaccgaccccgcctccatcgcggcccgcggctacatcagcacccgggtcgggatgggcgaggccgccgccatcttcatgaccgcgacgccgcccgggtccgtggaggccttcccgcagagcaacgccgtgatccaggacgaggagcgcgacatccccgagcggtcctggaacagcggctacgactggatcaccgacttccccggcaagaccgtctggttcgtgccctccatcaagagcgggaacgacatcgccaactgcctgcgcaagaacggcaagcgggtgatccagctctcccgcaagaccttcgacacggagtaccagaagaccaagaacaacgactgggactacgtcgtgaccaccgacatcagcgagatgggggccaacttccgggcggaccgcgtgatcgacccgcggcgctgcctgaagcccgtcatcctgaaggacggccccgagcgggtgatcctcgccgggcccatgccggtcacggccgcctccgcggcccagcgccgcggccggatcggccgcaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgggagaagtccgcggccatcgacggcgagtaccgcctgcgcggggaggcccgcaagaccttcgtggagctcatgcggcgcggcgacctgcccgtgtggctgtcctacaaggtcgccagcgagggcttccagtactccgaccggcgctggtgcttcgacggggagcggaacaaccaggtgctcgaggagaacatggacgtggagatctggacgaaggagggcgagcgcaagaagctgcggccccgctggctggacgcccggacctacagcgaccccctcgcgctgcgcgagttcaaggagttcgccgccgggcggcgcagcgtctccggcgacctgatcctcgagatcggcaagctgccgcagcacctgaccctccgggcccagaacgccctggacaacctggtgatgctccacaacagcgagcagggcgggaaggcgtaccgccacgccatggaggagctgcccgacaccatcgagaccctgatgctcctggccctgatcgccgtgctcaccggcggggtcaccctgttcttcctgtccgggaaggggctcggcaagaccagcatcgggctgctgtgcgtgatggcgtccagcgtgctcctgtggatggcctccgtcgagccccactggatcgccgccagcatcatcctggagttcttcctcatggtgctgctgatccccgagccggaccggcagcgcacgccccaggacaaccagctcgcctacgtggtcatcggcctgctgttcatgatcctcacggtggcggccaacgagatggggctgctggagaccaccaagaaggacctcggcatcgggcacgtggtcgccgagaaccaccaccacgccaccatgctggacatcgacctgcaccccgcctccgcgtggacgctctacgccgtggccaccaccatcatcaccccgatgatgcgccacacgatcgagaacaccaccgccaacatcagcctgaccgccatcgcgaaccaggccgccatcctgatgggcctcgacaagggctggcccatctccaagatggacatcggggtgcccctgctggccctcggctgctacagccaggtcaaccccctgacgctgaccgccgcggtgctcatgctggtggcccactacgccatcatcgggccgggcctgcaggccaaggcgacccgggaggcccagaagcgcaccgccgccgggatcatgaagaaccccacggtcgacggcatcgtggccatcgacctcgaccccgtggtctacgacgcgaagttcgagaagcagctgggccagatcatgctgctcatcctgtgcacctcccagatcctgctcatgcggaccacctgggccctgtgcgagagcatcacgctggccaccgggcccctcaccaccctgtgggagggctccccggggaagttctggaacacgaccatcgccgtgagcatggccaacatcttccgcggctcctacctggcgggcgccgggctcgccttcagcctgatgaagtccctgggcgggggccggcgcgggaccggcgcccagggcgagaccctcggggagaagtggaagcggcagctgaaccagctgagcaagagcgagttcaacacgtacaagcgctccggcatcatggaggtggaccggagcgaggccaaggaggggctcaagcgcggcgagaccaccaagcacgcggtctcccgggggaccgccaagctgcgctggttcgtggagcggaacctggtgaagcccgagggcaaggtcatcgacctgggctgcgggcgcggcgggtggagctactactgcgccggcctcaagaaggtgacggaggtgaaggggtacaccaagggcggccccgggcacgaggagcccatcccgatggccacctacggctggaacatcgtcaagctgcactccgggcgggacgtgttcttcacgccgcccgagaagtgcgacaccctgctctgcgacatcggcgagagctcccccaacccgacgatcgaggaggggcgcaccctgcgggtgctgaagatggtcgagccctggctccgcggcaaccagttctgcatcaagatcctgaacccctacatgcccagcgtggtggagaccctggagcagatgcagcggaagcacggcgggatgctcgtccgcaacccgctgtcccgcaacagcacccacgagatgtactgggtgtcctgcggcacggggaacatcgtgagcgcggtcaacatgacctcccggatgctgctcaaccgcttcaccatggcccaccggaagcccacctacgagcgcgacgtggacctgggcgccggcacgcggcacgtggccgtcgagcccgagaccgccaacctggacatcatcgggcagcgcatcgagaacatcaagaacgagcacaagagcacctggcactacgacgaggacaacccctacaagacctgggcgtaccacggctcctacgaggtgaagccgagcgggtccgccagctccatggtgaacggcgtcgtgcggctcctgacgaagccctgggacgtcatccccatggtgacccagatcgccatgaccgacaccacgcccttcgggcagcagcgcgtgttcaaggagaaggtcgacacccggaccccgcgccccaagcggggcaccgcccagatcatggaggtgacggccaagtggctgtggggcttcctcagccgcaacaagaagccccggatctgcacccgcgaggagttcacccggaaggtgcgcagcaacgcggccatcggggccgtcttcgtggacgagaaccagtggaactccgccaaggaggccgtggaggacgagcggttctgggacctggtccaccgcgagcgggagctgcacaagcagggcaagtgcgcgacctgcgtgtacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgcgagaacagcctgtccggcgtggagggggagggcctgcacaagctcgggtacatcctgcgggacatcagcaagatcccgggcggcaacatgtacgccgacgacacggccgggtgggacacccgcatcaccgaggacgacctgcagaacgaggccaagatcaccgacatcatggagcccgagcacgccctcctggcgacgtccatcttcaagctgacctaccagaacaaggtcgtgcgggtgcagcgccccgccaagagcggcaccgtcatggacgtgatctcccggcgcgaccagcgggggagcggccaggtgggcacctacgggctcaacacgttcaccaacatggaggtccagctgatccgccagatggagtccgagggcatcttcagcccctccgagctggagaacagcaacctcgccgagcgggtgctggactggctggagaagcacggggtggagcgcctcaagcggatggccatctccggcgacgactgcgtcgtgaagccgaccgacgaccgcttcgccaccgcgctgacggccctgaacgacatggggaaggtgcggaaggacatcccccagtgggagcccagcaagggctggaacgactggcagcaggtccccttctgctcccaccacttccaccagctcatcatgaaggacggccgcgagatcgtggtgccgtgccggaaccaggacgagctggtcgggcgcgcccgggtgagccagggcgccgggtggagcctgcgcgagaccgcctgcctcggcaagtcctacgcgcagatgtggcagctgatgtacttccaccggcgcgacctgcgcctcgccgccaacgccatctgcagcgccgtgcccgtcaactgggtgcccacctcccggaccacctggagcatccacgcgcaccaccagtggatgacgaccgaggacatgctgtccgtgtggaaccgcgtctggatcgaggagaacccctggatggaggacaagacccacgtgagctcctgggaggacgtgccgtacctggggaagcgggaggaccagtggtgcggcagcctcatcggcctgaccgcccgcgccacgtgggccaccaacatccaggtcgcgatcaaccaggtgcggcgcctgatcgggaacgagaactacctcgactacatgacctccatgaagcggttcaagaacgagagcgaccccgagggcgccctgtggtga

SEQ ID NO: 8927 - RNA, 9879 nt, synthetic construct
  misc_feature 1..9879: note = derived and/or modified CDS sequence (opt1) from DENV-1__KM403604__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcagggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctgacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtcgaggactacggcttcggggtgttcaccaccaacatctggctgaagctccgggactcctacacccagatgtgcgaccaccgcctgatgagcgccgcgatcaaggactccaaggccgtgcacgccgacatgggctactggatcgagagcgagaagaacgagacgtggaagctggcccgggcctccttcatcgaggtcaagacctgcatctggccccgcagccacaccctctggtccaacggcgtgctggagagcgagatgatcatccccaagatctacgggggcccgatctcccagcacaactaccggcccgggtacttcacccagacggcgggcccctggcacctggggaagctcgagctggacttcaacctgtgcgagggcaccaccgtggtcgtggacgagcactgcggcaaccgcgggccgagcctccggaccacgaccgtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggctgctctgcgtgagcatcatgatcgaggaggtgatgcggtcccgctggagccgcaagatgctgatgacgggcaccctggccgtcttcttcctcctgatcatggggcagctgacctggaacgacctcatccggctgtgcatcatggtgggcgccaacgtgtccgaccgcatggggatgggcaccacgtacctggccctcatggcgaccttcaagatgcggccgatgttcgccgtcgggctgctgttccgccggctcaccagccgcgaggtgctgctgctcaccatcgggctgtccctggtcgccagcgtggagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcctggaagaccatggcgatggtgctgtccatcgtcagcctgttccccctctgcctgtccaccacgagccagaagaccacctggctgcccgtgctcctgggctccttcgggtgcaagccgctgaccatgttcctcatcaccgagaacaagatctggggccgcaagagctggcccctgaacgaggggatcatggccgtgggcatcgtctccatcctgctcagcagcctgctgaagaacgacgtgcccctcgccgggcccctgatcgccggcggcatgctgatcgcgtgctacgtgatctccgggagctccgccgacctcagcctggagcgcgccgccgaggtctcctgggaggaggaggccgagcacagcggcgcgtcccacaacatcctggtggaggtgcaggacgacgggacgatgaagatcaaggacgaggagcgggacgacaccctcaccatcctgctgaaggccaccctcctggccgtcagcggcgtgtacccgatgtccatccccgccacgctgttcgtgtggtacttctggcagaagaagaagcagcgcagcggggtcctctgggacacccccagcccgcccgaggtggagcgggccgtgctggacgacggcatctaccgcatcctgcagcggggcctgctcgggcgcagccaggtcggcgtgggggtgttccaggacggcgtcttccacaccatgtggcacgtgacccgcggggcggtgctgatgtaccagggcaagcgcctggagccctcctgggccagcgtcaagaaggacctcatctcctacggcgggggctggcggttccaggggagctggaacacgggcgaggaggtccaggtgatcgccgtcgagcccgggaagaaccccaagaacgtgcagaccacccccggcaccttcaagacgcccgagggcgaggtgggggccatcgccctggacttcaagcccggcacctccgggagccccatcgtcaaccgcgagggcaagatcgtgggcctgtacgggaacggcgtggtcaccacctccgggacgtacgtgagcgcgatcgcccaggccaaggccagccaggagggcccgctccccgagatcgaggacgaggtgttcaagaagcggaacctgaccatcatggacctgcaccccgggtccggcaagacccgccggtacctcccggccatcgtccgcgaggcgatcaagcgcaagctgcggaccctgatcctcgcccccacgcgcgtggtggccagcgagatggccgaggcgctgaagggcatgcccatccggtaccagaccaccgccgtcaagtccgagcacaccgggaaggagatcgtggacctgatgtgccacgccacgttcaccatgcgcctcctgagccccgtgcgggtcccgaactacaacatgatcatcatggacgaggcccacttcaccgaccccgcctccatcgcggcccgcggctacatcagcacccgggtggggatgggcgaggccgccgccatcttcatgacggcgacgccgcccgggtccgtggaggccttcccgcagagcaacgccgtcatccaggacgaggagcgcgacatccccgagcggtcctggaacagcggctacgactggatcaccgacttccccggcaagaccgtgtggttcgtgccctccatcaagagcgggaacgacatcgccaactgcctgcgcaagaacggcaagcgggtcatccagctctcccgcaagacgttcgacaccgagtaccagaagaccaagaacaacgactgggactacgtggtgaccacggacatcagcgagatgggggccaacttccgggcggaccgcgtcatcgacccgcggcgctgcctgaagcccgtgatcctgaaggacggccccgagcgggtcatcctcgccgggcccatgccggtgaccgccgcctccgcggcccagcgccggggccgcatcggccgcaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgggagaagtccgcggccatcgacggcgagtaccgcctgcgcggggaggcccgcaagacgttcgtggagctcatgcggcgcggcgacctgcccgtctggctgtcctacaaggtggccagcgagggcttccagtactccgaccggcgctggtgcttcgacggggagcggaacaaccaggtgctcgaggagaacatggacgtcgagatctggaccaaggagggcgagcgcaagaagctgcggccccgctggctggacgcccggacctacagcgaccccctcgcgctgcgcgagttcaaggagttcgccgccgggcggcgcagcgtgtccggcgacctgatcctcgagatcggcaagctgccgcagcacctgaccctccgggcccagaacgccctggacaacctggtgatgctccacaacagcgagcagggcgggaaggcgtaccgccacgccatggaggagctgcccgacaccatcgagacgctgatgctcctggccctgatcgccgtcctcaccgggggcgtgaccctgttcttcctgtccgggaagggcctcggcaagaccagcatcgggctgctgtgcgtgatggcgtccagcgtcctcctgtggatggcctccgtggagccccactggatcgccgccagcatcatcctggagttcttcctcatggtgctgctgatccccgagccggaccggcagcgcacgccccaggacaaccagctcgcctacgtcgtgatcggcctgctgttcatgatcctcaccgtggcggccaacgagatggggctgctggagaccaccaagaaggacctcggcatcgggcacgtcgtggccgagaaccaccaccacgccacgatgctggacatcgacctgcaccccgcctccgcgtggaccctctacgccgtggccaccaccatcatcacgccgatgatgcggcacaccatcgagaacaccaccgccaacatcagcctgacggccatcgcgaaccaggccgccatcctgatgggcctcgacaagggctggcccatctccaagatggacatcggggtccccctgctggccctcggctgctacagccaggtgaaccccctgaccctgaccgccgcggtgctcatgctggtcgcccactacgccatcatcgggccgggcctgcaggccaaggcgacccgcgaggcccagaagcgcacggccgccgggatcatgaagaaccccaccgtggacggcatcgtggccatcgacctcgaccccgtcgtgtacgacgcgaagttcgagaagcagctgggccagatcatgctgctcatcctgtgcacctcccagatcctgctcatgcggaccacgtgggccctgtgcgagagcatcaccctggccaccgggcccctcaccacgctgtgggagggctccccggggaagttctggaacaccaccatcgccgtgagcatggccaacatcttccgcggctcctacctggcgggcgccgggctcgccttcagcctgatgaagtccctgggcgggggccggcgcgggaccggcgcccagggcgagacgctcggggagaagtggaagcggcagctgaaccagctgagcaagagcgagttcaacacctacaagcgctccggcatcatggaggtcgaccggagcgaggccaaggaggggctcaagcgcggcgagaccaccaagcacgcggtgtcccgggggacggccaagctgcgctggttcgtggagcggaacctggtcaagcccgagggcaaggtgatcgacctgggctgcgggcgcggcgggtggagctactactgcgccggcctcaagaaggtgaccgaggtcaaggggtacaccaagggcggccccgggcacgaggagcccatcccgatggccacctacggctggaacatcgtgaagctgcactccgggcgggacgtgttcttcacgccgcccgagaagtgcgacacgctgctctgcgacatcggcgagagctcccccaacccgaccatcgaggaggggcgcaccctgcgggtcctgaagatggtggagccctggctccgcggcaaccagttctgcatcaagatcctgaacccctacatgcccagcgtggtcgagaccctggagcagatgcagcggaagcacggcgggatgctcgtgcgcaacccgctgtcccggaacagcacgcacgagatgtactgggtgtcctgcggcaccgggaacatcgtcagcgcggtgaacatgacctcccgcatgctgctcaaccgcttcaccatggcccaccggaagcccacgtacgagcgcgacgtggacctgggcgccggcacccggcacgtcgccgtggagcccgagatcgccaacctggacatcatcgggcagcgcatcgagaacatcaagaacgagcacaagagcacctggcactacgacgaggacaacccctacaagacctgggcgtaccacggctcctacgaggtgaagccgagcgggtccgccagctccatggtcaacggcgtggtccggctcctgacgaagccctgggacgtgatccccatggtgacccagatcgccatgaccgacaccacgcccttcgggcagcagcgcgtcttcaaggagaaggtggacacccggaccccgcgccccaagcggggcaccgcccagatcatggaggtgacggccaagtggctgtggggcttcctcagccgcaacaagaagccccggatctgcacccgcgaggagttcacccggaaggtccgcagcaacgcggccatcggggccgtgttcgtggacgagaaccagtggaactccgccaaggaggccgtcgaggacgagcggttctgggacctggtgcaccgcgagcgggagctgcacaagcagggcaagtgcgcgacctgcgtgtacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtcgagggggagggcctgcacaagctcgggtacatcctgcgcgacatcagcaagatcccgggcggcaacatgtacgccgacgacacggccgggtgggacacccgcatcaccgaggacgacctgcagaacgaggccaagatcaccgacatcatggagcccgagcacgccctcctggcgacgtccatcttcaagctgacctaccagaacaaggtggtgcgggtccagcgccccgccaagagcggcaccgtgatggacgtgatctcccggcgcgaccagcgggggagcggccaggtcggcacctacgggctcaacacgttcaccaacatggaggtgcagctgatccgccagatggagtccgagggcatcttcagcccctccgagctggagaacagcaacctcgccgagcgggtgctggactggctggagaagcacggggtcgagcgcctcaagcggatggccatctccggcgacgactgcgtggtgaagccgaccgacgaccgcttcgccaccgcgctgatcgccctgaacgacatggggaaggtccggaaggacatcccccagtgggagcccagcaagggctggaacgactggcagcaggtccccttctgctcccaccacttccaccagctcatcatgaaggacggccgcgagatcgtggtcccgtgccggaaccaggacgagctggtggggcgcgcccgggtgagccagggcgccgggtggagcctgcgcgagacggcctgcctcggcaagtcctacgcgcagatgtggcagctgatgtacttccaccggcgcgacctgcggctcgccgccaacgccatctgcagcgccgtccccgtgaactgggtgcccacctcccgcaccacctggagcatccacgcgcaccaccagtggatgaccacggaggacatgctgtccgtctggaaccgcgtgtggatcgaggagaacccctggatggaggacaagacccacgtgagctcctgggaggacgtcccgtacctggggaagcgggaggaccagtggtgcggcagcctcatcggcctgaccgcccgcgccacctgggccacgaacatccaggtggcgatcaaccaggtgcggcgcctgatcgggaacgagaactacctcgactacatgacctccatgaagcggttcaagaacgagagcgaccccgagggcgccctgtggtga

SEQ ID NO: 8928 - RNA, 9879 nt, synthetic construct
  misc_feature 1..9879: note = derived and/or modified CDS sequence (opt1) from DENV-1__KM403588__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagacctccgccggggtgaacatgtgcaccctgatcgccatggacctgggcgagctctgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatgggcaagctcaccctgaagggggtctcctacgtgatgtgcaccggcagcttcaagctggagaaggaggtggcggagacccagcacggcacggtcctggtccaggtgaagtacgaggggaccgacgccccctgcaagatccccatctccacccaggacgagaagggcgtcacccagaacgggcggctcatcacggccaacccgatcgtgaccgacaaggagaagcccgtgaacatcgagaccgagccgcccttcggcgagagctacatcgtcatcggcgccggggagaaggcgctgaagctgtcctggttcaagaagggcagctccatcgggaagatgttcgaggccaccgcccgcggcgcccggcgcatggccatcctcggggacatcgcgtgggacttcggcagcatcggcggggtgttcacgtccgtgggcaagctggtccaccaggtgttcgggaccgcctacggcgtgctgttcagcggggtctcctggaccatgaagatcggcatcggcatcctcctgacctggctggggctcaacagccgctccacgagcctgtccatgacctgcatcgccgtgggcatggtgaccctgtacctcggggtcatggtgcaggccgacagcggctgcgtgatcaactggaaggggcgggagctgaagtgcggctccggcatcttcgtcaccaacgaggtgcacacgtggaccgagcagtacaagttccaggccgacagcccgaagcgcctgagcgcggccatcgggaaggcctgggaggagggcgtgtgcgggatccggtccgccacccgcctcgagaacatcatgtggaagcagatcagcaacgagctgaaccacatcctgctcgagaacgacatgaagttcaccgtcgtggtgggcgacgccaacgggatcctgacccagggcaagaagatgatccggccccagcccatggagcacaagtactcctggaagtcctggggcaaggcgaagatcatcggggccgacacgcagaacaccaccttcatcatcgacggccccgacaccccggagtgccccgacgaccagcgcgcctggaacatctgggaggtcgaggactacgggttcggcgtgttcacgaccaacatctggctgaagctccgggactcctacacccagatgtgcgaccaccgcctgatgagcgccgcgatccgggactccaaggccgtgcacgccgacatgggctactggatcgagagcgagaagaacgagacctggaagctggcccgcgcctccttcatcgaggtcaagacgtgcatctggccccggagccacaccctctggtccaacggggtgctggagagcgagatgatcatccccaagatctacggcgggccgatctcccagcacaactaccgccccggctacttcacccagaccgcggggccctggcacctgggcaagctcgagctggacttcaacctgtgcgagggcacgaccgtggtcgtggacgagcactgcgggaaccggggcccgagcctccgcaccaccacggtgaccgggaagatcatccacgagtggtgctgccggtcctgcaccctgccgcccctgcgcttccggggcgaggacgggtgctggtacggcatggagatccgccccgtcaaggagaaggaggagaacctcgtgcggagcatggtgtccgccggcagcggggaggtcgacagcttctccctgggcctgctctgcgtgagcatcatgatcgaggaggtgatgcgctcccgctggagccggaagatgctgatgaccgggacgctggccgtcttcttcctcctgatcatgggccagctgacctggaacgacctcatccgcctgtgcatcatggtgggggccaacgtgtccgaccggatgggcatgggcaccacctacctggccctcatggcgacgttcaagatgcgcccgatgttcgccgtcgggctgctgttccggcgcctcaccagccgggaggtgctgctgctcaccatcggcctgtccctggtcgccagcgtggagctccccaactccctggaggagctgggggacggcctcgccatgggcatcatgatgctgaagctgctcaccgacttccagagccaccagctgtggacgaccctgctctccctgaccttcatcaagaccacgctgagcctcgactacgcctggaagaccatggcgatggtgctgtccatcgtcagcctgttccccctctgcctgtccaccaccagccagaagacgacctggctgcccgtgctcctggggtccttcggctgcaagccgctgaccatgttcctcatcaccgagaacaagatctgggggcgcaagagctggcccctgaacgagggcatcatggccgtggggatcgtctccatcctgctcagcagcctgctgaagaacgacgtgcccctcgccggccccctgatcgccggcgggatgctgatcgcgtgctacgtgatctccggcagctccgccgacctcagcctggagcgggccgccgaggtctcctgggaggaggaggccgagcacagcggggcgtcccacaacatcctggtggaggtgcaggacgacggcaccatgaagatcaaggacgaggagcgcgacgacacgctcaccatcctgctgaaggccaccctcctggccgtcagcggggtgtacccgatgtccatccccgccaccctgttcgtgtggtacttctggcagaagaagaagcagcggagcggcgtcctctgggacacgcccagcccgcccgaggtggagcgcgccgtgctggacgacggcatctaccggatcctgcagcgcgggctgctcggccggagccaggtcggggtgggcgtgttccaggacggggtcttccacaccatgtggcacgtgacccgcggcgcggtgctgatgtaccagggcaagcggctggagccctcctgggccagcgtcaagaaggacctcatctcctacgggggcgggtggcgcttccagggcagctggaacaccggggaggaggtccaggtgatcgccgtcgagcccggcaagaaccccaagaacgtgcagacgacccccggcaccttcaagacccccgagggggaggtgggcgccatcgccctggacttcaagcccgggacgtccggcagccccatcgtcaaccgggagggcaagatcgtggggctgtacggcaacggggtggtcaccacctccggcacctacgtgagcgcgatcgcccaggccaaggccagccaggaggggccgctccccgagatcgaggacgaggtgttcaagaagcgcaacctgacgatcatggacctgcaccccggctccggcaagacccggcgctacctcccggccatcgtccgcgaggcgatcaagcggaagctgcgcaccctgatcctcgcccccacccgggtggtggccagcgagatggccgaggcgctgaaggggatgcccatccgctaccagacgaccgccgtcaagtccgagcacaccggcaaggagatcgtggacctgatgtgccacgccaccttcacgatgcggctcctgagccccgtgcgcgtcccgaactacaacatgatcatcatggacgaggcccacttcaccgaccccgcctccatcgcggcccgggggtacatcagcacccgcgtgggcatgggggaggccgccgccatcttcatgaccgcgacgccgcccggctccgtggaggccttcccgcagagcaacgccgtcatccaggacgaggagcgggacatccccgagcgctcctggaacagcggctacgactggatcaccgacttccccgggaagaccgtgtggttcgtgccctccatcaagagcggcaacgacatcgccaactgcctgcggaagaacgggaagcgcgtcatccagctctcccggaagaccttcgacacggagtaccagaagaccaagaacaacgactgggactacgtggtgaccaccgacatcagcgagatgggcgccaacttccgcgcggaccgggtcatcgacccgcgccggtgcctgaagcccgtgatcctgaaggacgggcccgagcgcgtcatcctcgccggccccatgccggtggccgccgcgtccgccgcccagcggcgcggccgcatcgggcggaaccagaacaaggagggcgaccagtacatctacatggggcagcccctgaacaacgacgaggaccacgcccactggacggaggccaagatgctgctcgacaacatcaacacccccgagggcatcatccccgcgctgttcgagccggagcgcgagaagtccgccgccatcgacggggagtaccggctgcgcggcgaggcccggaagaccttcgtggagctcatgcgccggggcgacctgcccgtctggctgtcctacaaggtggccagcgaggggttccagtactccgaccgccggtggtgcttcgacggcgagcgcaacaaccaggtgctcgaggagaacatggacgtcgagatctggaccaaggagggggagcggaagaagctgcgcccccggtggctggacgcgcgcacgtacagcgaccccctcgccctgcgggagttcaaggagttcgccgccggccgccggagcgtgtccggcgacctgatcctcgagatcgggaagctgccgcagcacctgaccctccgcgcccagaacgcgctggacaacctggtgatgctccacaacagcgagcagggcgggaaggcctaccggcacgccatggaggagctgcccgacaccatcgagaccctgatgctcctggccctgatcgcggtcctcaccggcggggtgacgctgttcttcctgtccggcaagggcctcgggaagaccagcatcggcctgctgtgcgtgatggcctccagcgtcctcctgtggatggcctccgtggagccccactggatcgccgccagcatcatcctggagttcttcctcatggtgctgctgatccccgagccggaccgccagcggacgccccaggacaaccagctcgcgtacgtcgtgatcgggctgctgttcatgatcctcaccgtggccgccaacgagatgggcctgctggagacgaccaagaaggacctcgggatcggccacgtcgtggccgagaaccaccaccacgccaccatgctggacatcgacctgcaccccgcgtccgcctggaccctctacgccgtggccacgaccatcatcaccccgatgatgcgccacaccatcgagaacacgaccgccaacatcagcctgaccgcgatcgccaaccaggccgccatcctgatgggcctcgacaaggggtggcccatctccaagatggacatcggcgtccccctgctggccctcgggtgctacagccaggtgaaccccctgaccctgacggcggccgtgctcatgctggtcgcccactacgccatcatcggcccggggctgcaggcgaaggccacccgcgaggcccagaagcggaccgccgccggcatcatgaagaaccccaccgtggacggcatcgtggcgatcgacctcgaccccgtcgtgtacgacgccaagttcgagaagcagctggggcagatcatgctgctcatcctgtgcacgtcccagatcctgctcatgcgcaccacctgggccctgtgcgagagcatcaccctggccacgggccccctcaccaccctgtgggaggggtccccgggcaagttctggaacaccacgatcgccgtgagcatggcgaacatcttccggggctcctacctggccggggccggcctcgccttcagcctgatgaagtccctcgggggcgggcgccgggggaccggcgcccagggggagaccctcggcgagaagtggaagcgccagctgaaccagctgagcaagagcgagttcaacacctacaagcggtccgggatcatggaggtcgaccgcagcgaggcgaaggagggcctcaagcgcggggagacgaccaagcacgccgtgtcccgcggcaccgccaagctgcggtggttcgtggagcgcaacctggtcaagcccgagggcaaggtgatcgacctggggtgcggccgcgggggctggagctactactgcgccgggctcaagaaggtgaccgaggtcaagggctacacgaagggcgggcccggccacgaggagcccatcccgatggcgacctacgggtggaacatcgtgaagctgcactccggccgcgacgtgttcttcacgccgcccgagaagtgcgacaccctgctctgcgacatcggggagagctcccccaacccgaccatcgaggagggccggacgctgcgcgtcctgaagatggtggagccctggctccggggcaaccagttctgcatcaagatcctgaacccctacatgcccagcgtggtcgagaccctggagcagatgcagcgcaagcacgggggcatgctcgtgcggaacccgctgtcccgcaacagcacccacgagatgtactgggtgtcctgcgggaccggcaacatcgtcagcgccgtgaacatgacgtcccgcatgctgctcaaccggttcaccatggcccaccgcaagcccacctacgagcgggacgtggacctgggcgccgggacccgccacgtcgccgtggagcccgagatcgcgaacctggacatcatcggccagcggatcgagaacatcaagaacgagcacaagagcacgtggcactacgacgaggacaacccctacaagacctgggcctaccacgggtcctacgaggtgaagccgagcggctccgccagctccatggtcaacggggtggtccgcctcctgaccaagccctgggacgtgatccccatggtgacccagatcgccatgacggacaccacccccttcggccagcagcgggtcttcaaggagaaggtggacacccgcacgccgcggcccaagcgcggcaccgcccagatcatggaggtgaccgcgaagtggctgtgggggttcctcagccggaacaagaagccccgcatctgcacccgggaggagttcacgcgcaaggtccggagcaacgccgccatcggcgccgtgttcgtggacgagaaccagtggaactccgccaaggaggcggtcgaggacgagcgcttctgggacctggtgcaccgggagcgcgagctgcacaagcaggggaagtgcgcgacctgcgtgtacaacatgatgggcaagcgggagaagaagctcggggagttcggcaaggccaagggcagccgcgccatctggtacatgtggctgggggcgcggttcctggagttcgaggccctcggcttcatgaacgaggaccactggttctcccgcgagaacagcctgtccggggtcgagggcgaggggctgcacaagctcggctacatcctgcgcgacatcagcaagatcccgggcgggaacatgtacgccgacgacaccgccggctgggacacccggatcacggaggacgacctgcagaacgaggccaagatcaccgacatcatggagcccgagcacgcgctcctggccacctccatcttcaagctgacctaccagaacaaggtggtgcgcgtccagcggcccgccaagagcgggacggtgatggacgtgatctcccgccgggaccagcgcggcagcggccaggtcgggacctacggcctcaacaccttcaccaacatggaggtgcagctgatccggcagatggagtccgaggggatcttcagcccctccgagctggagaacagcaacctcgccgagcgcgtgctggactggctggagaagcacggcgtcgagcggctcaagcgcatggccatctccggggacgactgcgtggtgaagccgacggacgaccggttcgcgaccgccctgaccgccctgaacgacatgggcaaggtccgcaaggacatcccccagtgggagcccagcaagggctggaacgactggcagcaggtccccttctgctcccaccacttccaccagctcatcatgaaggacgggcgggagatcgtggtcccgtgccgcaaccaggacgagctggtgggccgggcccgcgtgagccagggggccggctggagcctgcgggagaccgcgtgcctcgggaagtcctacgcccagatgtggcagctgatgtacttccaccgccgggacctgcgcctcgccgccaacgccatctgcagcgcggtccccgtgaactgggtgcccacgtcccgcaccacctggagcatccacgcccaccaccagtggatgaccaccgaggacatgctgtccgtctggaaccgggtgtggatcgaggagaacccctggatggaggacaagacgcacgtgagctcctgggaggacgtcccgtacctgggcaagcgcgaggaccagtggtgcggcagcctcatcgggctgaccgcccgggccacctgggcgaccaacatccaggtggccatcaaccaggtgcgccggctgatcggcaacgagaactacctcgactacatgacgtccatgaagcgcttcaagaacgagagcgaccccgagggggccctgtggtga

SEQ ID NO: 8929 - RNA, 9879 nt, synthetic construct
  misc_feature 1..9879: note = derived and/or modified CDS sequence (opt1) from DENV-1__KM403605__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggcggcagatccagaaggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccatccaggacgagaagggggtcacccagaacggccggctcatcaccgccaacccgatcgtgacggacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccggcgcatggccatcctcggcgacaccgcgtgggacttcgggagcatcggcggcgtgttcacgtccgtggggaagctggtccaccaggtgttcggcaccgcctacggggtgctgttcagcggcgtctcctggaccatgaagatcgggatcggcatcctcctgacctggctgggcctcaacagccgctccacgagcctgtccatgacctgcatcgccgtggggatggtgaccctgtacctcggcgtcatggtgcaggccgacagcgggtgcgtgatcaactggaagggccgggagctgaagtgcgggtccggcatcttcgtcaccaacgaggtgcacacgtggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctgacccaggggaagaagatgatccggccccagcccatggagcacaagtactcctggaagtcctggggcaaggcgaagatcatcggcgccgacacgcagaacaccaccttcatcatcgacgggcccgacaccccggagtgccccgacgaccagcgcgcctggaacatctgggaggtcgaggactacggcttcggggtgttcacgaccaacatctggctgaagctccgggactcctacacccagatgtgcgaccaccgcctgatgagcgccgcgatcaaggactccaaggccgtgcacgccgacatgggctactggatcgagagcgagaagaacgagacctggaagctggcccgggcctccttcatcgaggtcaagacgtgcatctggccccgcagccacaccctctggtccaacggcgtgctggagagcgagatgatcatccccaagatctacgggggcccgatctcccagcacaactaccggcccgggtacttcacccagaccgcgggcccctggcacctggggaagctcgagctggacttcaacctgtgcgagggcacgaccgtggtcgtggacgagcactgcggcaaccgcgggccgagcctccggaccaccacggtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggctgctctgcgtgagcatcatgatcgaggaggtgatgcggtcccgctggagccgcaagatgctgatgaccggcacgctggccgtcttcttcctcctgatcatggggcagctgacctggaacgacctcatccggctgtgcatcatggtgggcgccaacgtgtccgaccgcatggggatgggcaccacctacctggccctcatggcgacgttcaagatgcggccgatgttcgccgtcggcctgctgttccgccggctcaccagccgcgaggtgctgctgctcaccatcgggctgtccctggtcgccagcgtggagctccccaactccctggaggagctgggcgacgggctcgccatgggcatcatgatgctgaagctgctcaccgacttccagagccaccagctgtggacgaccctgctctccctgaccttcatcaagaccacgctgagcctcgactacgcctggaagaccatggcgatggtgctgtccatcgtcagcctgttccccctctgcctgtccaccaccagccagaagacgacctggctgcccgtgctcctgggctccttcgggtgcaagccgctgaccatgttcctcatcaccgagaacaagatctggggccgcaagagctggcccctgaacgaggggatcatggccgtgggcatcgtctccatcctgctcagcagcctgctgaagaacgacgtgcccctcgccgggcccctgatcgccggcggcatgctgatcgcgtgctacgtgatctccgggagctccgccgacctcagcctggagcgcgccgccgaggtctcctgggaggaggaggccgagcacagcggcgcgtcccacaacatcctggtggaggtgcaggacgacgggaccatgaagatcaaggacgaggagcgggacgacacgctcaccatcctgctgaaggccaccctcctggccgtcagcggcgtgtacccgatgtccatccccgccaccctgttcgtgtggtacttctggcagaagaagaagcagcgcagcggggtcctctgggacacgcccagcccgcccgaggtggagcgggccgtgctggacgacggcatctaccgcatcctgcagcggggcctgctcgggcgcagccaggtcggcgtgggggtgttccaggacggcgtcttccacaccatgtggcacgtgacccgcggggcggtgctgatgtaccagggcaagcgcctggagccctcctgggccagcgtcaagaaggacctcatctcctacggcgggggctggcggttccaggggagctggaacaccggcgaggaggtccaggtgatcgccgtcgagcccgggaagaaccccaagaacgtgcagacgacccccggcaccttcaagacccccgagggcgaggtgggggccatcgccctggacttcaagcccggcacgtccgggagccccatcgtcaaccgcgagggcaagatcgtgggcctgtacgggaacggcgtggtcaccacctccgggacctacgtgagcgcgatcgcccaggccaaggccagccaggagggcccgctccccgagatcgaggacgaggtgttcaagaagcggaacctgacgatcatggacctgcaccccgggtccggcaagacccgccggtacctcccggccatcgtccgcgaggcgatcaagcgcaagctgcggaccctgatcctcgcccccacccgcgtggtggccagcgagatggccgaggcgctgaagggcatgcccatccggtaccagacgaccgccgtcaagtccgagcacaccgggaaggagatcgtggacctgatgtgccacgccaccttcacgatgcgcctcctgagccccgtgcgggtcccgaactacaacatgatcatcatggacgaggcccacttcaccgaccccgcctccatcgcggcccgcggctacatcagcacccgggtggggatgggcgaggccgccgccatcttcatgaccgcgacgccgcccgggtccgtggaggccttcccgcagagcaacgccgtcatccaggacgaggagcgcgacatccccgagcggtcctggaacagcggctacgactggatcaccgacttccccggcaagaccgtgtggttcgtgccctccatcaagagcgggaacgacatcgccaactgcctgcgcaagaacggcaagcgggtcatccagctctcccgcaagaccttcgacacggagtaccagaagaccaagaacaacgactgggactacgtggtgaccaccgacatcagcgagatgggggccaacttccgggcggaccgcgtcatcgacccgcggcgctgcctgaagcccgtgatcctgaaggacggccccgagcgggtcatcctcgccgggcccatgccggtgacggccgcctccgcggcccagcgccggggccgcatcggccgcaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgggagaagtccgcggccatcgacggcgagtaccgcctgcgcggggaggcccgcaagaccttcgtggagctcatgcggcgcggcgacctgcccgtctggctgtcctacaaggtggccagcgagggcttccagtactccgaccggcgctggtgcttcgacggggagcggaacaaccaggtgctcgaggagaacatggacgtcgagatctggacgaaggagggcgagcgcaagaagctgcggccccgctggctggacgcccggacctacagcgaccccctcgcgctgcgcgagttcaaggagttcgccgccgggcggcgcagcgtgtccggcgacctgatcctcgagatcggcaagctgccgcagcacctgaccctccgggcccagaacgccctggacaacctggtgatgctccacaacagcgagcagggcgggaaggcgtaccgccacgccatggaggagctgcccgacaccatcgagaccctgatgctcctggccctgatcgccgtcctcaccggcggggtgaccctgttcttcctgtccgggaaggggctcggcaagaccagcatcgggctgctgtgcgtgatggcgtccagcgtcctcctgtggatggcctccgtggagccccactggatcgccgccagcatcatcctggagttcttcctcatggtgctgctgatccccgagccggaccggcagcgcacgccccaggacaaccagctcgcctacgtcgtgatcggcctgctgttcatgatcctcacggtggcggccaacgagatggggctgctggagaccaccaagaaggacctcggcatcgggcacgtcgtggccgagaaccaccaccacgccaccatgctggacatcgacctgcaccccgcctccgcgtggacgctctacgccgtggccaccaccatcatcaccccgatgatgcggcacacgatcgagaacaccaccgccaacatcagcctgaccgccatcgcgaaccaggccgccatcctgatgggcctcgacaagggctggcccatctccaagatggacatcggggtccccctgctggccctcggctgctacagccaggtgaaccccctgacgctgaccgccgcggtgctcatgctggtcgcccactacgccatcatcgggccgggcctgcaggccaaggcgacccgcgaggcccagaagcgcaccgccgccgggatcatgaagaaccccacggtggacggcatcgtggccatcgacctcgaccccgtcgtgtacgacgcgaagttcgagaagcagctgggccagatcatgctgctcatcctgtgcacctcccagatcctgctcatgcggaccacctgggccctgtgcgagagcatcacgctggccaccgggcccctcaccaccctgtgggagggctccccggggaagttctggaacacgaccatcgccgtgagcatggccaacatcttccgcggctcctacctggcgggcgccgggctcgccttcagcctgatgaagaccctgggcgggggccggcgcgggaccggcgcccagggcgagacgctcggggagaagtggaagcggcagctgaaccagctgtccaagagcgagttcaacacctacaagcgcagcggcatcatggaggtcgaccggtccgaggccaaggaggggctcaagcgcggcgagaccaccaagcacgcggtgagccgggggacggccaagctgcgctggttcgtggagcggaacctggtcaagcccgagggcaaggtgatcgacctgggctgcgggcgcggcgggtggtcctactactgcgccggcctcaagaaggtgaccgaggtcaaggggtacaccaagggcggccccgggcacgaggagcccatcccgatggccacctacggctggaacatcgtgaagctgcacagcgggcgggacgtgttcttcacgccgcccgagaagtgcgacacgctgctctgcgacatcggcgagtccagccccaacccgaccatcgaggaggggcgcaccctgcgggtcctgaagatggtggagccctggctccgcggcaaccagttctgcatcaagatcctgaacccctacatgccctccgtggtcgagaccctggagcagatgcagcggaagcacggcgggatgctcgtgcgcaacccgctgagccggaactccacgcacgagatgtactgggtgagctgcggcaccgggaacatcgtctccgcggtgaacatgaccagccgcatgctgctcaaccgcttcaccatggcccaccggaagcccacgtacgagcgcgacgtggacctgggcgccggcacccggcacgtcgccgtggagcccgagatcgccaacctggacatcatcgggcagcgcatcgagaacatcaagaacgagcacaagtccacctggcactacgacgaggacaacccctacaagacctgggcgtaccacggcagctacgaggtgaagccgtccgggagcgcctccagcatggtcaacggcgtggtccggctcctgacgaagccctgggacgtgatccccatggtgacccagatcgccatgaccgacaccacgcccttcgggcagcagcgcgtcttcaaggagaaggtggacacccggaccccgcgccccaagcggggcaccgcccagatcatggaggtgacggccaagtggctgtggggcttcctctcccgcaacaagaagccccggatctgcacccgcgaggagttcacccggaaggtccgcagcaacgcggccatcggggccgtgttcgtggacgagaaccagtggaacagcgccaaggaggccgtcgaggacgagcggttctgggacctggtgcaccgcgagcgggagctgcacaagcagggcaagtgcgcgacctgcgtgtacaacatgatggggaagcgcgagaagaagctcggcgagttcgggaaggccaagggctcccgggccatctggtacatgtggctgggcgcccgcttcctggagttcgaggcgctcgggttcatgaacgaggaccactggttcagccgggagaactccctgagcggcgtcgagggggagggcctgcacaagctcgggtacatcctgcgcgacatctccaagatcccgggcggcaacatgtacgccgacgacacggccgggtgggacacccgcatcaccgaggacgacctgcagaacgaggccaagatcaccgacatcatggagcccgagcacgccctcctggcgacgagcatcttcaagctgacctaccagaacaaggtggtgcgggtccagcgccccgccaagtccggcaccgtgatggacgtgatcagccggcgcgaccagcgggggtccggccaggtcggcacctacgggctcaacacgttcaccaacatggaggtgcagctgatccgccagatggagagcgagggcatcttctcccccagcgagctggagaactccaacctcgccgagcgggtgctggactggctggagaagcacggggtcgagcgcctcaagcggatggccatcagcggcgacgactgcgaggtgaagccgaccgacgaccgcttcgccaccgcgctgacggccctgaacgacatggggaaggtgcggaaggacatcccccagtgggagccctccaagggctggaacgactggcagcaggtccccttctgcagccaccacttccaccagctcatcatgaaggacggccgcgagatcgtggtgccgtgccggaaccaggacgagctggtcgggcgcgcccgggtgtcccagggcgccgggtggagcctgcgcgagaccgcctgcctcggcaagagctacgcgcagatgtggcagctgatgtacttccaccggcgcgacctgcggctcgccgccaacgccatctgctccgccgtgcccgtcaactgggtgcccaccagccgcaccacctggtccatccacgcgcaccaccagtggatgacgaccgaggacatgctgagcgtgtggaaccgcgtctggatcgaggagaacccctggatggaggacaagacccacgtgtccagctgggaggacgtgccgtacctggggaagcgggaggaccagtggtgcggctccctcatcggcctgaccgcccgcgccacgtgggccaccaacatccaggtcgcgatcaaccaggtgcggcgcctgatcgggaacgagaactacctcgactacatgaccagcatgaagcggttcaagaacgagtccgaccccgagggcgccctgtggtga

SEQ ID NO: 8930 - RNA, 9879 nt, synthetic construct
  misc_feature 1..9879: note = derived and/or modified CDS sequence (opt1) from DENV-1__KM403606__SS-prME
  source 1..9879: mol_type = other RNA
agcgtgaccatgctgctcatgctgctgcccaccgccctcgccttccacctgacgacccggggcggggagccccacatgatcgtgtccaagcaggagcggggcaagagcctcctgttcaagacctccgcgggggtgaacatgtgcaccctgatcgccatggacctgggcgagctctgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctggggctcgagacgcgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtgggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctgttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgctggagatccagctcaccgactacggggccctgaccctggactgcagcccccgcaccggcctcgacttcaacgagatggtcctgctgacgatgaaggagaagtcctggctcgtgcacaagcagtggttcctggacctgccgctcccctggaccagcggggcctccaccagccaggagacctggaaccggcaggacctgctggtgacgttcaagaccgcccacgcgaagaagcaggaggtcgtggtgctcggcagccaggagggcgccatgcacaccgccctgaccggggccacggagatccagacctccggcaccaccacgatcttcgccgggcacctgaagtgccgcctcaagatggacaagctgaccctgaagggcgtcagctacgtgatgtgcaccgggtccttcaagctggagaaggaggtggcggagacccagcacggcacggtcctcgtccaggtgaagtacgagggcaccgacgccccctgcaagatccccatcagcacccaggacgagaagggggtcacccagaacggccggctgatcacggccaacccgatcgtgaccgacaaggagaagcccgtgaacatcgagaccgagccgcccttcggggagtcctacatcgtcatcggcgccggcgagaaggcgctgaagctcagctggttcaagaaggggtccagcatcggcaagatgttcgaggccaccgcccgcggggcccggcgcatggccatcctgggcgacacggcgtgggacttcgggtccatcggcggcgtgttcaccagcgtggggaagctggtccaccaggtgttcggcaccgcctacggggtcctgttctccggcgtcagctggaccatgaagatcgggatcggcatcctgctgacgtggctcggcctgaactcccgcagcacctccctgagcatgacctgcatcgccgtggggatggtgaccctctacctgggcgtcatggtgcaggccgactccgggtgcgtgatcaactggaagggccgggagctgaagtgcgggagcggcatcttcgtcacgaacgaggtgcacacctggaccgagcagtacaagttccaggccgactccccgaagcgcctcagcgcggccatcggcaaggcctgggaggagggggtgtgcggcatccggagcgccacccgcctggagaacatcatgtggaagcagatctccaacgagctgaaccacatcctcctggagaacgacatgaagttcaccgtcgtggtgggggacgccaacggcatcctgacgcaggggaagaagatgatccggccccagcccatggagcacaagtacagctggaagtcctggggcaaggcgaagatcatcggcgccgacacccagaacaccaccttcatcatcgacgggcccgacacgccggagtgccccgacgaccagcgcgcctggaacatctgggaggtcgaggactacggcttcggggtgttcaccaccaacatctggctcaagctgcgggacagctacacccagatgtgcgaccaccgcctgatgtccgccgcgatcaaggacagcaaggccgtgcacgccgacatgggctactggatcgagtccgagaagaacgagacgtggaagctcgcccgggccagcttcatcgaggtcaagacctgcatctggccccgctcccacaccctgtggagcaacggcgtgctggagtccgagatgatcatccccaagatctacgggggcccgatcagccagcacaactaccggcccgggtacttcacccagacggcgggcccctggcacctcgggaagctggagctggacttcaacctctgcgagggcaccaccgtggtcgtggacgagcactgcggcaaccgcgggccgtccctgcggaccacgaccgtgaccggcaagatcatccacgagtggtgctgccgcagctgcaccctgccgcccctccggttccgcggggaggacggctgctggtacgggatggagatccggcccgtcaaggagaaggaggagaacctggtgcgctccatggtgagcgccggctccggcgaggtcgacagcttcagcctggggctcctgtgcgtgtccatcatgatcgaggaggtgatgcggagccgctggtcccgcaagatgctgatgacgggcaccctcgccgtcttcttcctgctgatcatggggcagctcacctggaacgacctgatccggctgtgcatcatggtgggcgccaacgtgagcgaccgcatggggatgggcaccacgtacctcgccctgatggcgaccttcaagatgcggccgatgttcgccgtcgggctcctcttccgccggctgacctcccgcgaggtgctgctcctgaccatcgggctgagcctcgtcgcctccgtggagctgcccaacagcctggaggagctcggcgacgggctggccatgggcatcatgatgctgaagctcctgacggacttccagtcccaccagctgtggaccaccctcctgagcctgaccttcatcaagacgaccctctccctggactacgcctggaagaccatggcgatggtgctgagcatcgtctccctcttccccctgtgcctgagcaccacgtcccagaagaccacctggctccccgtgctgctgggcagcttcgggtgcaagccgctcaccatgttcctgatcaccgagaacaagatctggggccggaagtcctggcccctgaacgaggggatcatggccgtgggcatcgtcagcatcctcctgtccagcctgctcaagaacgacgtgcccctggccgggcccctgatcgccggcggcatgctcatcgcgtgctacgtgatcagcgggtccagcgccgacctgtccctggagcgcgccgccgaggtcagctgggaggaggaggccgagcactccggcgcgagccacaacatcctcgtggaggtgcaggacgacgggacgatgaagatcaaggacgaggagcgggacgacaccctgaccatcctgctcaaggccaccctgctggccgtctccggcgtgtacccgatgagcatccccgccaccctcttcgtgtggtacttctggcagaagaagaagcagcgctccggggtcctgtgggacacccccagcccgcccgaggtggagcgggccgtgctggacgacggcatctaccgcatcctgcagcggggcctcctggggcgctcccaggtcggcgtgggggtgttccaggacggcgtcttccacaccatgtggcacgtgacccgcggggcggtgctgatgtaccagggcaagcgcctcgagcccagctgggcctccgtcaagaaggacctgatcagctacggcgggggctggcggttccaggggtcctggaacacgggcgaggaggtccaggtgatcgccgtcgagcccgggaagaaccccaagaacgtgcagaccacccccggcaccttcaagacgcccgagggcgaggtgggggccatcgccctggacttcaagcccggcaccagcgggtcccccatcgtcaaccgcgagggcaagatcgtgggcctctacgggaacggcgtggtcaccaccagcgggacgtacgtgtccgcgatcgcccaggccaaggccagccaggagggcccgctgcccgagatcgaggacgaggtgttcaagaagcggaacctgaccatcatggacctccaccccgggagcggcaagacccgccggtacctgccggccatcgtccgcgaggcgatcaagcgcaagctgcggaccctcatcctggcccccacgcgcgtggtggcctccgagatggccgaggcgctgaagggcatgcccatccggtaccagaccaccgccgtcaagagcgagcacaccgggaaggagatcgtggacctcatgtgccacgccacgttcaccatgcgcctgctgtcccccgtgcgggtcccgaactacaacatgatcatcatggacgaggcccacttcaccgaccccgccagcatcgcggcccgcggctacatctccacccgggtggggatgggcgaggccgccgccatcttcatgacggcgacgccgcccgggagcgtggaggccttcccgcagtccaacgccgtcatccaggacgaggagcgcgacatccccgagcggagctggaactccggctacgactggatcaccgacttccccggcaagaccgtgtggttcgtgcccagcatcaagtccgggaacgacatcgccaactgcctccgcaagaacggcaagcgggtcatccagctgagccgcaagacgttcgacaccgagtaccagaagaccaagaacaacgactgggactacgtggtgaccacggacatctccgagatgggggccaacttccgggcggaccgcgtcatcgacccgcggcgctgcctgaagcccgtgatcctcaaggacggccccgagcgggtcatcctggccgggcccatgccggtgaccgccgccagcgcggcccagcgccggggccgcatcggccgcaaccagaacaaggagggggaccagtacatctacatgggccagcccctgaacaacgacgaggaccacgcccactggaccgaggccaagatgctcctggacaacatcaacacccccgaggggatcatccccgccctgttcgagccggagcgggagaagtccgcggccatcgacggcgagtaccgcctccgcggggaggcccgcaagacgttcgtggagctgatgcggcgcggcgacctgcccgtctggctcagctacaaggtggcctccgagggcttccagtacagcgaccggcgctggtgcttcgacggggagcggaacaaccaggtgctggaggagaacatggacgtcgagatctggaccaaggagggcgagcgcaagaagctgcggccccgctggctcgacgcccggacctactccgaccccctggcgctgcgcgagttcaaggagttcgccgccgggcggcgcagcgtgagcggcgacctcatcctggagatcggcaagctgccgcagcacctcaccctgcgggcccagaacgccctggacaacctcgtgatgctgcacaactccgagcagggcgggaaggcgtaccgccacgccatggaggagctgcccgacaccatcgagacgctcatgctgctggccctcatcgccgtcctgaccgggggcgtgaccctgttcttcctcagcgggaagggcctgggcaagacctccatcgggctgctctgcgtgatggcgagctccgtcctgctgtggatggccagcgtggagccccactggatcgccgcctccatcatcctcgagttcttcctgatggtgctgctcatccccgagccggaccggcagcgcacgccccaggacaaccagctggcctacgtcgtgatcggcctcctcttcatgatcctgaccgtggcggccaacgagatggggctgctcgagaccaccaagaaggacctgggcatcgggcacgtcgtggccgagaaccaccaccacgccacgatgctggacatcgacctccaccccgccagcgcgtggaccctgtacgccgtggccaccaccatcatcacgccgatgatgcggcacaccatcgagaacaccaccgccaacatctccctgacggccatcgcgaaccaggccgccatcctcatgggcctggacaagggctggcccatcagcaagatggacatcggggtccccctgctcgccctgggctgctactcccaggtgaaccccctgaccctcaccgccgcggtgctgatgctggtcgcccactacgccatcatcgggccgggcctccaggccaaggcgacccgcgaggcccagaagcgcacggccgccgggatcatgaagaaccccaccgtggacggcatcgtggccatcgacctggaccccgtcgtgtacgacgcgaagttcgagaagcagctgggccagatcatgctcctgatcctgtgcaccagccagatcctcctgatgcggaccacgtgggccctgtgcgagtccatcaccctcgccaccgggcccctgaccacgctgtgggagggcagcccggggaagttctggaacaccaccatcgccgtgtccatggccaacatcttccgcggcagctacctcgcgggcgccgggctggccttctccctgatgaagaccctcggcgggggccggcgcgggacgggcgcccagggcgagaccctgggggagaagtggaagcggcagctgaaccagctcagcaagtccgagttcaacacctacaagcgcagcggcatcatggaggtcgaccggagcgaggccaaggaggggctgaagcgcggcgagaccacgaagcacgcggtgtcccgggggaccgccaagctgcgctggttcgtggagcggaacctggtcaagcccgagggcaaggtgatcgacctcggctgcgggcgcggcgggtggagctactactgcgccggcctgaagaaggtgaccgaggtcaaggggtacaccaagggcggccccgggcacgaggagcccatcccgatggccacctacggctggaacatcgtgaagctgcactccgggcgggacgtgttcttcacgccgcccgagaagtgcgacaccctcctgtgcgacatcggcgagagctcccccaacccgaccatcgaggaggggcgcaccctgcgggtcctcaagatggtggagccctggctgcgcggcaaccagttctgcatcaagatcctgaacccctacatgcccagcgtggtcgagacgctcgagcagatgcagcggaagcacggcgggatgctggtgcgcaacccgctgtcccggaacagcacccacgagatgtactgggtgtcctgcggcaccgggaacatcgtcagcgcggtgaacatgacctcccgcatgctcctgaaccgcttcacgatggcccaccggaagcccacctacgagcgcgacgtggacctgggcgccggcacccggcacgtcgccgtggagcccgagatcgccaacctcgacatcatcgggcagcgcatcgagaacatcaagaacgagcacaagagcacctggcactacgacgaggacaacccctacaagacgtgggcgtaccacggctcctacgaggtgaagccgagcgggtccgccagctccatggtcaacggcgtggtccggctgctgaccaagccctgggacgtgatccccatggtgacccagatcgccatgaccgacacgacccccttcgggcagcagcgcgtcttcaaggagaaggtggacacccggaccccgcgccccaagcggggcacggcccagatcatggaggtgaccgccaagtggctctggggcttcctgagccgcaacaagaagccccggatctgcacccgcgaggagttcacccggaaggtccgctccaacgcggccatcggggccgtgttcgtggacgagaaccagtggaacagcgccaaggaggccgtcgaggacgagcggttctgggacctggtgcaccgcgagcgggagctccacaagcagggcaagtgcgcgacgtgcgtgtacaacatgatggggaagcgcgagaagaagctgggcgagttcgggaaggccaagggcagccgggccatctggtacatgtggctgggcgcccgcttcctcgagttcgaggcgctggggttcatgaacgaggaccactggttctcccgggagaacagcctgtccggcgtcgagggggagggcctccacaagctggggtacatcctgcgcgacatcagcaagatcccgggcggcaacatgtacgccgacgacaccgccgggtgggacacccgcatcaccgaggacgacctccagaacgaggccaagatcacggacatcatggagcccgagcacgccctgctggcgacctccatcttcaagctcacctaccagaacaaggtggtgcgggtccagcgccccgccaagagcggcaccgtgatggacgtgatctcccggcgcgaccagcgggggagcggccaggtcggcacgtacgggctgaacaccttcaccaacatggaggtgcagctgatccgccagatggagtccgagggcatcttcagcccctccgagctcgagaacagcaacctggccgagcgggtgctggactggctcgagaagcacggggtcgagcgcctgaagcggatggccatctccggcgacgactgcgtggtgaagccgaccgacgaccgcttcgccacggcgctgaccgccctcaacgacatggggaaggtccggaaggacatcccccagtgggagcccagcaagggctggaacgactggcagcaggtccccttctgctcccaccacttccaccagctgatcatgaaggacggccgcgagatcgtggtcccgtgccggaaccaggacgagctggtggggcgcgcccgggtgagccagggcgccgggtggtccctccgcgagaccgcctgcctgggcaagagctacgcgcagatgtggcagctgatgtacttccaccggcgcgacctccggctggccgccaacgccatctgcagcgccgtccccgtgaactgggtgcccacctcccgcaccacgtggagcatccacgcgcaccaccagtggatgaccaccgaggacatgctgtccgtctggaaccgcgtgtggatcgaggagaacccctggatggaggacaagacccacgtgagctcctgggaggacgtcccgtacctcgggaagcgggaggaccagtggtgcggcagcctgatcggcctgacggcccgcgccacctgggccaccaacatccaggtggcgatcaaccaggtgcggcgcctcatcgggaacgagaactacctggactacatgacctccatgaagcggttcaagaacgagagcgaccccgagggcgccctgtggtga

SEQ ID NO: 8931 - RNA, 9879 nt, synthetic construct
  misc_feature 1..9879: note = derived and/or modified CDS sequence (opt1) from DENV-1__KM403591__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctgctgttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatgggcaagctcaccctgaagggggtctcctacgtgatgtgcaccggcagcttcaagctggagaaggaggtggcggagacccagcacggcacggtcctggtccaggtgaagtacgaggggaccgacgccccctgcaagatccccatctccacccaggacgagaagggcgtcacccagaacgggcggctcatcacggccaacccgatcgtgaccgacaaggagaagcccgtgaacatcgagaccgagccgcccttcggcgagagctacatcgtcatcggcgccggggagaaggcgctgaagctgtcctggttcaagaagggcagctccatcgggaagatgttcgaggccaccgcccgcggcgcccggcgcatggccatcctcggggacacggcgtgggacttcggcagcatcggcggggtgttcacctccgtgggcaagctggtccaccaggtgttcgggaccgcctacggcgtgctgttcagcggggtctcctggaccatgaagatcggcatcggcatcctcctgacgtggctggggctcaacagccgctccaccagcctgtccatgacctgcatcgccgtgggcatggtgaccctgtacctcggggtcatggtgcaggccgacagcggctgcgtgatcaactggaaggggcgggagctgaagtgcggctccggcatcttcgtcacgaacgaggtgcacacctggaccgagcagtacaagttccaggccgacagcccgaagcgcctgagcgcggccatcgggaaggcctgggaggagggcgtgtgcgggatccggtccgccacccgcctcgagaacatcatgtggaagcagatcagcaacgagctgaaccacatcctgctcgagaacgacatgaagttcaccgtcgtggtgggcgacgccaacgggatcctgacgcagggcaagaagatgatccggccccagcccatggagcacaagtactcctggaagtcctggggcaaggcgaagatcatcggggccgacacccagaacaccaccttcatcatcgacggccccgacacgccggagtgccccgacgaccagcgcgcctggaacatctgggaggtcgaggactacgggttcggcgtgttcaccaccaacatctggctgaagctccgggactcctacacccagatgtgcgaccaccgcctgatgagcgccgcgatcaaggactccaaggccgtgcacgccgacatgggctactggatcgagagcgagaagaacgagacgtggaagctggcccgggcctccttcatcgaggtcaagacctgcatctggccccgcagccacaccctctggtccaacggggtgctggagagcgagatgatcatccccaagatctacggcgggccgatctcccagcacaactaccggcccggctacttcacccagacggcggggccctggcacctgggcaagctcgagctggacttcaacctgtgcgagggcaccaccgtggtcgtggacgagcactgcgggaaccgcggcccgagcctccggaccacgaccgtgaccgggaagatcatccacgagtggtgctgccgctcctgcaccctgccgcccctgcggttccgcggcgaggacgggtgctggtacggcatggagatccggcccgtcaaggagaaggaggagaacctcgtgcgcagcatggtgtccgccggcagcggggaggtcgacagcttctccctgggcctgctctgcgtgagcatcatgatcgaggaggtgatgcggtcccgctggagccgcaagatgctgatgacggggaccctggccgtcttcttcctcctgatcatgggccagctgacctggaacgacctcatccggctgtgcatcatggtgggggccaacgtgtccgaccgcatgggcatgggcaccacgtacctggccctcatggcgaccttcaagatgcggccgatgttcgccgtcgggctgctgttccgccggctcaccagccgcgaggtgctgctgctcaccatcggcctgtccctggtcgccagcgtggagctccccaactccctggaggagctgggggacggcctcgccatgggcatcatgatgctgaagctgctcacggacttccagagccaccagctgtggaccaccctgctctccctgaccttcatcaagacgaccctgagcctcgactacgcctggaagaccatggcgatggtgctgtccatcgtcagcctgttccccctctgcctgtccaccacgagccagaagaccacctggctgcccgtgctcctggggtccttcggctgcaagccgctgaccatgttcctcatcaccgagaacaagatctgggggcgcaagagctggcccctgaacgagggcatcatggccgtggggatcgtctccatcctgctcagcagcctgctgaagaacgacgtgcccctcgccggccccctgatcgccggcgggatgctgatcgcgtgctacgtgatctccggcagctccgccgacctcagcctggagcgcgccgccgaggtctcctgggaggaggaggccgagcacagcggggcgtcccacaacatcctggtggaggtgcaggacgacggcacgatgaagatcaaggacgaggagcgggacgacaccctcaccatcctgctgaaggccaccctcctggccgtcagcggggtgtacccgatgtccatccccgccacgctgttcgtgtggtacttctggcagaagaagaagcagcgcagcggcgtcctctgggacacccccagcccgcccgaggtggagcgggccgtgctggacgacggcatctaccgcatcctgcagcgggggctgctcggccgcagccaggtcggggtgggcgtgttccaggacggggtcttccacaccatgtggcacgtgacccggggcgcggtgctgatgtaccagggcaagcgcctggagccctcctgggccagcgtcaagaaggacctcatctcctacgggggcgggtggcggttccagggcagctggaacacgggggaggaggtccaggtgatcgccgtcgagcccggcaagaaccccaagaacgtgcagaccacccccggcaccttcaagacgcccgagggggaggtgggcgccatcgccctggacttcaagcccgggacctccggcagccccatcgtcaaccgcgagggcaagatcgtggggctgtacggcaacggggtggtcaccacctccggcacgtacgtgagcgcgatcgcccaggccaaggccagccaggaggggccgctccccgagatcgaggacgaggtgttcaagaagcggaacctgaccatcatggacctgcaccccggctccggcaagaccaagcgctacctcccggccatcgtccgggaggcgatcaagcgcaagctgcgcaccctgatcctcgcccccacgcgggtggtggccagcgagatggccgaggcgctgaaggggatgcccatccgctaccagaccaccgccgtcaagtccgagcacaccggcaaggagatcgtggacctgatgtgccacgccacgttcaccatgcggctcctgagccccgtgcgcgtcccgaactacaacatgatcatcatggacgaggcccacttcaccgaccccgcctccatcgcggcccgggggtacatcagcacccgcgtgggcatgggggaggccgccgccatcttcatgacggcgacgccgcccggctccgtggaggccttcccgcagagcaacgccgtcatccaggacgaggagcgggacatccccgagcgctcctggaacagcggctacgactggatcaccgacttccccgggaagaccgtgtggttcgtgccctccatcaagagcggcaacgacatcgccaactgcctgcggaagaacgggaagcgcgtcatccagctctcccggaagacgttcgacaccgagtaccagaagaccaagaacaacgactgggactacgtggtgaccacggacatcagcgagatgggcgccaacttccgcgcggaccgggtcatcgacccgcgccggtgcctgaagcccgtgatcctgaaggacgggcccgagcgcgtcatcctcgccggccccatgccggtgaccgccgcctccgcggcccagcggcgcggccggatcgggcgcaaccagaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgcgagaagtccgcggccatcgacggggagtaccggctgcgcggcgaggcccggaagacgttcgtggagctcatgcgccggggcgacctgcccgtctggctgtcctacaaggtggccagcgaggggttccagtactccgaccgccggtggtgcttcgacggcgagcgcaacaaccaggtgctcgaggagaacatggacgtcgagatctggaccaaggagggggagcggaagaagctgcgcccccggtggctggacgcccgcacctacagcgaccccctcgcgctgcgggagttcaaggagttcgccgccggccgccggagcgtgtccggcgacctgatcctcgagatcgggaagctgccgcagcacctgaccctccgcgcccagaacgccctggacaacctggtgatgctccacaacagcgagcagggcgggaaggcgtaccggcacgccatggaggagctgcccgacaccatcgagacgctgatgctcctggccctgatcgccgtcctcaccggcggggtgaccctgttcttcctgtccggcaagggcctcgggaagaccagcatcggcctgctgtgcgtgatggcgtccagcgtcctcctgtggatggcctccgtggagccccactggatcgccgccagcatcatcctggagttcttcctcatggtgctgctgatccccgagccggaccgccagcggacgccccaggacaaccagctcgcctacgtcgtgatcgggctgctgttcatgatcctcaccgtggcggccaacgagatgggcctgctggagaccaccaagaaggacctcgggatcggccacgtcgtggccgagaaccaccaccacgccacgatgctggacatcgacctgcaccccgcctccgcgtggaccctctacgccgtggccaccaccatcatcacgccgatgatgcgccacaccatcgagaacaccaccgccaacatcagcctgacggccatcgcgaaccaggccgccatcctgatgggcctcgacaaggggtggcccatctccaagatggacatcggcgtccccctgctggccctcgggtgctacagccaggtgaaccccctgaccctgaccgccgcggtgctcatgctggtcgcccactacgccatcatcggcccggggctgcaggccaaggcgacccgggaggcccagaagcgcacggccgccggcatcatgaagaaccccaccgtggacggcatcgtggccatcgacctcgaccccgtcgtgtacgacgcgaagttcgagaagcagctggggcagatcatgctgctcatcctgtgcacctcccagatcctgctcatgcgcaccacgtgggccctgtgcgagagcatcaccctggccaccggccccctcaccacgctgtgggaggggtccccgggcaagttctggaacaccaccatcgccgtgagcatggccaacatcttccggggctcctacctggcgggggccggcctcgccttcagcctgatgaagtccctcgggggcgggcgccgggggaccggcgcccagggggagacgctcggcgagaagtggaagcgccagctgaaccagctgagcaagagcgagttcaacacctacaagcggtccgggatcatggaggtcgaccgcagcgaggccaaggagggcctcaagcgcggggagaccaccaagcacgcggtgtcccgcggcacggccaagctgcggtggttcgtggagcgcaacctggtcaagcccgagggcaaggtgatcgacctggggtgcggccgcgggggctggagctactactgcgccgggctcaagaaggtgaccgaggtcaagggctacaccaagggcgggcccggccacgaggagcccatcccgatggccacctacgggtggaacatcgtgaagctgcactccggccgcgacgtgttcttcacgccgcccgagaagtgcgacacgctgctctgcgacatcggggagagctcccccaacccgaccatcgaggagggccggaccctgcgcgtcctgaagatggtggagccctggctccggggcaaccagttctgcatcaagatcctgaacccctacatgcccagcgtggtcgagaccctggagcagatgcagcgcaagcacgggggcatgctcgtgcggaacccgctgtcccgcaacagcacgcacgagatgtactgggtgtcctgcgggaccggcaacatcgtcagcgcggtgaacatgacctcccggatgctgctcaaccgcttcaccatggcccaccgcaagcccacgtacgagcgggacgtggacctgggcgccgggacccgccacgtcgccgtggagcccgagatcgccaacctggacatcatcggccagcggatcgagaacatcaagaacgagcacaagagcacctggcactacgacgaggacaacccctacaagacctgggcgtaccacgggtcctacgaggtgaagccgagcggctccgccagctccatggtcaacggggtggtccgcctcctgacgaagccctgggacgtgatccccatggtgacccagatcgccatgaccgacaccacgcccttcggccagcagcgggtcttcaaggagaaggtggacacccgcaccccgcggcccaagcgcggcaccgcccagatcatggaggtgacggccaagtggctgtgggggttcctcagccggaacaagaagccccgcatctgcacccgggaggagttcacccgcaaggtccggagcaacgcggccatcggcgccgtgttcgtggacgagaaccagtggaactccgccaaggaggccgtcgaggacgagcgcttctgggacctggtgcaccgggagcgcgagctgcacaagcaggggaagtgcgcgacctgcgtgtacaacatgatgggcaagcgggagaagaagctcggggagttcggcaaggccaagggcagccgcgccatctggtacatgtggctgggggcccggttcctggagttcgaggcgctcggcttcatgaacgaggaccactggttctcccgcgagaacagcctgtccggggtcgagggcgaggggctgcacaagctcggctacatcctgcgggacatcagcaagatcccgggcgggaacatgtacgccgacgacacggccggctgggacacccgcatcaccgaggacgacctgcagaacgaggccaagatcaccgacatcatggagcccgagcacgccctcctggcgacgtccatcttcaagctgacctaccagaacaaggtggtgcgcgtccagcggcccgccaagagcgggaccgtgatggacgtgatctcccgccgggaccagcgcggcagcggccaggtcgggacctacggcctcaacacgttcaccaacatggaggtgcagctgatccggcagatggagtccgaggggatcttcagcccctccgagctggagaacagcaacctcgccgagcgcgtgctggactggctggagaagcacggcgtcgagcggctcaagcgcatggccatctccggggacgactgcgtggtgaagccgaccgacgaccggttcgccaccgcgctgacggccctgaacgacatgggcaaggtccgcaaggacatcccccagtgggagcccagcaagggctggaacgactggcagcaggtccccttctgctcccaccacttccaccagctcatcatgaaggacgggcgggagatcgtggtcccgtgccgcaaccaggacgagctggtgggccgggcccgcgtgagccagggggccggctggagcctgcgggagaccgcctgcctcgggaagtcctacgcgcagatgtggcagctgatgtacttccaccgccgggacctgcgcctcgccgccaacgccatctgcagcgccgtccccgtgaactgggtgcccacctcccggaccacctggagcatccacgcgcaccaccagtggatgacgaccgaggacatgctgtccgtctggaaccgcgtgtggatcgaggagaacccctggatggaggacaagacccacgtgagctcctgggaggacgtcccgtacctgggcaagcgcgaggaccagtggtgcggcagcctcatcgggctgaccgcccgggccacgtgggccaccaacatccaggtggcgatcaaccaggtgcgccggctgatcggcaacgagaactacctcgactacatgacctccatgaagcgcttcaagaacgagagcgaccccgagggggccctgtggtga

SEQ ID NO: 8932 - RNA, 9879 nt, synthetic construct
  misc_feature 1..9879: note = derived and/or modified CDS sequence (opt1) from DENV-1__KM403607__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccatccaggacgagaagggggtcacccagaacggccggctcatcaccgccaacccgatcgtgacggacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccggcgcatggccatcctcggcgacaccgcgtgggacttcgggagcatcggcggcgtgttcacgtccgtggggaagctggtccaccaggtgttcggcaccgcctacggggtgctgttcagcggcgtctcctggaccatgaagatcgggatcggcatcctcctgacctggctgggcctcaacagccgctccacgagcctgtccatgacctgcatcgccgtggggatggtgaccctgtacctcggcgtcatggtgcaggccgacagcgggtgcgtgatcaactggaagggccgggagctgaagtgcgggtccggcatcttcgtcaccaacgaggtgcacacgtggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctgacccaggggaagaagatgatccggccccagcccatggagcacaagtactcctggaagtcctggggcaaggcgaagatcatcggcgccgacacgcagaacaccaccttcatcatcgacgggcccgacaccccggagtgccccgacgaccagcgcgcctggaacatctgggaggtcgaggactacggcttcggggtgttcacgaccaacatctggctgaagctccgggactcctacacccagatgtgcgaccaccgcctgatgagcgccgcgatcaaggactccaaggccgtgcacgccgacatgggctactggatcgagagcgagaagaacgagacctggaagctggcccgggcctccttcatcgaggtcaagacgtgcatctggccccgcagccacaccctctggtccaacggcgtgctggagagcgagatgatcatccccaagatctacgggggcccgatctcccagcacaactaccggcccgggtacttcacccagaccgcgggcccctggcacctggggaagctcgagctggacttcaacctgtgcgagggcacgaccgtggtcgtggacgagcactgcggcaaccgcgggccgagcctccggaccaccacggtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggctgctctgcgtgagcatcatgatcgaggaggtgatgcggtcccgctggagccgcaagatgctgatgaccggcacgctggccgtcttcttcctcctgatcatggggcagctgacctggaacgacctcatccggctgtgcatcatggtgggcgccaacgtgtccgaccgcatggggatgggcaccacctacctggccctcatggcgacgttcaagatgcggccgatgttcgccgtcggcctgctgttccgccggctcaccagccgcgaggtgctgctgctcaccatcgggctgtccctggtcgccagcgtggagctccccaactccctggaggagctgggcgacgggctcgccatgggcatcatgatgctgaagctgctcaccgacttccagagccaccagctgtggacgaccctgctctccctgaccttcatcaagaccacgctgagcctcgactacgcctggaagaccatggcgatggtgctgtccatcgtcagcctgttccccctctgcctgtccaccaccagccagaagacgacctggctgcccgtgctcctgggctccttcgggtgcaagccgctgaccatgttcctcatcaccgagaacaagatctggggccgcaagagctggcccctgaacgaggggatcatggccgtgggcatcgtctccatcctgctcagcagcctgctgaagaacgacgtgcccctcgccgggcccctgatcgccggcggcatgctgatcgcgtgctacgtgatctccgggagctccgccgacctcagcctggagcgcgccgccgaggtctcctgggaggaggaggccgagcacagcggcgcgtcccacaacatcctggtggaggtgcaggacgacgggaccatgaagatcaaggacgaggagcgggacgacacgctcaccatcctgctgaaggccaccctcctggccgtcagcggcgtgtacccgatgtccatccccgccaccctgttcgtgtggtacttctggcagaagaagaagcagcgcagcggggtcctctgggacacgcccagcccgcccgaggtggagcgggccgtgctggacgacggcatctaccgcatcctgcagcggggcctgctcgggcgcagccaggtcggcgtgggggtgttccaggacggcgtcttccacaccatgtggcacgtgacccgcggggcggtgctgatgtaccagggcaagcgcctggagccctcctgggccagcgtcaagaaggacctcatctcctacggcgggggctggcggttccaggggagctggaacaccggcgaggaggtccaggtgatcgccgtcgagcccgggaagaaccccaagaacgtgcagacgacccccggcaccttcaagacccccgagggcgaggtgggggccatcgccctggacttcaagcccggcacgtccgggagccccatcgtcaaccgcgagggcaagatcgtgggcctgtacgggaacggcgtggtcaccacctccgggacctacgtgagcgcgatcgcccaggccaaggccagccaggagggcccgctccccgagatcgaggacgaggtgttcaagaagcggaacctgacgatcatggacctgcaccccgggtccggcaagacccgccggtacctcccggccatcgtccgcgaggcgatcaagcgcaagctgcggaccctgatcctcgcccccacccgcgtggtggccagcgagatggccgaggcgctgaagggcatgcccatccggtaccagacgaccgccgtcaagtccgagcacaccgggaaggagatcgtggacctgatgtgccacgccaccttcacgatgcgcctcctgagccccgtgcgggtcccgaactacaacatgatcatcatggacgaggcccacttcaccgaccccgcctccatcgcggcccgcggctacatcagcacccgggtggggatgggcgaggccgccgccatcttcatgaccgcgacgccgcccgggtccgtggaggccttcccgcagagcaacgccgtcatccaggacgaggagcgcgacatccccgagcggtcctggaacagcggctacgactggatcaccgacttccccggcaagaccgtgtggttcgtgccctccatcaagagcgggaacgacatcgccaactgcctgcgcaagaacggcaagcgggtcatccagctctcccgcaagaccttcgacacggagtaccagaagaccaagaacaacgactgggactacgtggtgaccaccgacatcagcgagatgggggccaacttccgggcggaccgcgtcatcgacccgcggcgctgcctgaagcccgtgatcctgaaggacggccccgagcgggtcatcctcgccgggcccatgccggtgacggccgcctccgcggcccagcgccggggccgcatcggccgcaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgggagaagtccgcggccatcgacggcgagtaccgcctgcgcggggaggcccgcaagaccttcgtggagctcatgcggcgcggcgacctgcccgtctggctgtcctacaaggtggccagcgagggcttccagtactccgaccggcgctggtgcttcgacggggagcggaacaaccaggtgctcgaggagaacatggacgtcgagatctggacgaaggagggcgagcgcaagaagctgcggccccgctggctggacgcccggacctacagcgaccccctcgcgctgcgcgagttcaaggagttcgccgccgggcggcgcagcgtgtccggcgacctgatcctcgagatcggcaagctgccgcagcacctgaccctccgggcccagaacgccctggacaacctggtgatgctccacaacagcgagcagggcgggaaggcgtaccgccacgccatggaggagctgcccgacaccatcgagaccctgatgctcctggccctgatcgccgtcctcaccggcggggtgaccctgttcttcctgtccgggaaggggctcggcaagaccagcatcgggctgctgtgcgtgatggcgtccagcgtcctcctgtggatggcctccgtggagccccactggatcgccgccagcatcatcctggagttcttcctcatggtgctgctgatccccgagccggaccggcagcgcacgccccaggacaaccagctcgcctacgtcgtgatcggcctgctgttcatgatcctcacggtggcggccaacgagatggggctgctggagaccaccaagaaggacctcggcatcgggcacgtcgtggccgagaaccaccaccacgccaccatgctggacatcgacctgcaccccgcctccgcgtggacgctctacgccgtggccaccaccatcatcaccccgatgatgcggcacacgatcgagaacaccaccgccaacatcagcctgaccgccatcgcgaaccaggccgccatcctgatgggcctcgacaagggctggcccatctccaagatggacatcggggtccccctgctggccctcggctgctacagccaggtgaaccccctgacgctgaccgccgcggtgctcatgctggtcgcccactacgccatcatcgggccgggcctgcaggccaaggcgacccgcgaggcccagaagcgcaccgccgccgggatcatgaagaaccccacggtggacggcatcgtggccatcgacctcgaccccgtcgtgtacgacgcgaagttcgagaagcagctgggccagatcatgctgctcatcctgtgcacctcccagatcctgctcatgcggaccacctgggccctgtgcgagagcatcacgctggccaccgggcccctcaccaccctgtgggagggctccccggggaagttctggaacacgaccatcgccgtgagcatggccaacatcttccgcggctcctacctggcgggcgccgggctcgccttcagcctgatgaagaccctgggcgggggccggcgcgggaccggcgcccagggcgagacgctcggggagaagtggaagcggcagctgaaccagctgtccaagagcgagttcaacacctacaagcgcagcggcatcatggaggtcgaccggtccgaggccaaggaggggctcaagcgcggcgagaccaccaagcacgcggtgagccgggggacggccaagctgcgctggttcgtggagcggaacctggtcaagcccgagggcaaggtgatcgacctgggctgcgggcgcggcgggtggtcctactactgcgccggcctcaagaaggtgaccgaggtcaaggggtacaccaagggcggccccgggcacgaggagcccatcccgatggccacctacggctggaacatcgtgaagctgcacagcgggcgggacgtgttcttcacgccgcccgagaagtgcgacacgctgctctgcgacatcggcgagtccagccccaacccgaccatcgaggaggggcgcaccctgcgggtcctgaagatggtggagccctggctccgcggcaaccagttctgcatcaagatcctgaacccctacatgccctccgtggtcgagaccctggagcagatgcagcggaagcacggcgggatgctcgtgcgcaacccgctgagccggaactccacgcacgagatgtactgggtgagctgcggcaccgggaacatcgtctccgcggtgaacatgaccagccgcatgctgctcaaccgcttcaccatggcccaccggaagcccacgtacgagcgcgacgtggacctgggcgccggcacccggcacgtcgccgtggagcccgagatcgccaacctggacatcatcgggcagcgcatcgagaacatcaagaacgagcacaagtccacctggcactacgacgaggacaacccctacaagacctgggcgtaccacggcagctacgaggtgaagccgtccgggagcgcctccagcatggtcaacggcgtggtccggctcctgacgaagccctgggacgtgatccccatggtgacccagatcgccatgaccgacaccacgcccttcgggcagcagcgcgtcttcaaggagaaggtggacacccggaccccgcgccccaagcggggcaccgcccagatcatggaggtgacggccaagtggctgtggggcttcctctcccgcaacaagaagccccggatctgcacccgcgaggagttcacccggaaggtccgcagcaacgcggccatcggggccgtgttcgtggacgagaaccagtggaacagcgccaaggaggccgtcgaggacgagcggttctgggacctggtgcaccgcgagcgggagctgcacaagcagggcaagtgcgcgacctgcgtgtacaacatgatggggaagcgcgagaagaagctcggcgagttcgggaaggccaagggctcccgggccatctggtacatgtggctgggcgcccgcttcctggagttcgaggcgctcgggttcatgaacgaggaccactggttcagccgggagaactccctgagcggcgtcgagggggagggcctgcacaagctcgggtacatcctgcgcgacatctccaagatcccgggcggcaacatgtacgccgacgacacggccgggtgggacacccgcatcaccgaggacgacctgcagaacgaggccaagatcaccgacatcatggagcccgagcacgccctcctggcgacgagcatcttcaagctgacctaccagaacaaggtggtgcgggtccagcgccccgccaagtccggcaccgtgatggacgtgatcagccggcgcgaccagcgggggtccggccaggtcggcacctacgggctcaacacgttcaccaacatggaggtgcagctgatccgccagatggagagcgagggcatcttctcccccagcgagctggagaactccaacctcgccgagcgggtgctggactggctggagaagcacggggtcgagcgcctcaagcggatggccatcagcggcgacgactgcgtggtgaagccgaccgacgaccgcttcgccaccgcgctgacggccctgaacgacatggggaaggtccggaaggacatcccccagtgggagccctccaagggctggaacgactggcagcaggtccccttctgcagccaccacttccaccagctcatcatgaaggacggccgcgagatcgtggtcccgtgccggaaccaggacgagctggtggggcgcgcccgggtgtcccagggcgccgggtggagcctgcgcgagaccgcctgcctcggcaagagctacgcgcagatgtggcagctgatgtacttccaccggcgcgacctgcggctcgccgccaacgccatctgctccgccgtccccgtgaactgggtgcccaccagccgcaccacctggtccatccacgcgcaccaccagtggatgacgaccgaggacatgctgagcgtctggaaccgcgtgtggatcgaggagaacccctggatggaggacaagacccacgtgtccagctgggaggacgtcccgtacctggggaagcgggaggaccagtggtgcggctccctcatcggcctgaccgcccgcgccacgtgggccaccaacatccaggtggcgatcaaccaggtgcggcgcctgatcgggaacgagaactacctcgactacatgaccagcatgaagcggttcaagaacgagtccgaccccgagggcgccctgtggtga

SEQ ID NO: 8933 - RNA, 9879 nt, synthetic construct
  misc_feature 1..9879: note = derived and/or modified CDS sequence (opt1) from DENV-1__KM403581__SS-prME
  source 1..9879: mol_type = other RNA
agcgtgaccatgctgctcatgctgctgcccaccgccctcgccttccacctgacgacccggggcggggagccccacatgatcgtgagcaagcaggagcggggcaagagcctcctgttcaagacctccgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtcacctacgggacctgcagccagaccggcgagcaccggcgcgaccggcgctccgtggccctggcgccccacgtgggcctggggctcgagacgcggaccgagacctggatgagctccgagggcgcctggcgccagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctgttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccgccggatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctgacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtcgaggactacggcttcggggtgttcaccaccaacatctggctgaagctccgggactcctacacccagctgtgcgaccaccgcctgatgagcgccgcgatcaaggactccaaggccgtgcacgccgacatgggctactggatcgagagcgagaagaacgagacgtggaagctcgcccgggcctccttcatcgaggtcaagacctgcatctggccccgcagccacaccctgtggtccaacggcgtgctggagagcgagatgatcatccccaagatctacgggggcccgatctcccagcacaactaccggcccgggtacttcacccagacggcgggcccctggcacctcgggaagctggagctggacttcaacctctgcgagggcaccaccgtggtcgtggacgagcactgcggcaaccgcgggccgagcctgcggaccacgaccgtgaccggcaagatcatccacgagtggtgctgccgctcctgcaccctgccgcccctgcggttccgcggggaggacggctgctggtacgggatggagatccggcccgtcaaggagaaggaggagaacctggtgcgcagcatggtgtccgccggcagcggcgaggtcgacagcttctccctggggctcctgtgcgtgagcatcatgatcgaggaggtgatgcgctcccggtggagccgcaagatgctgatgacgggcaccctcgccatcttcttcctgctgatcatggggcagctcacctggaacgacctgatccggctgtgcatcatggtcggcgccaacgtgtccgaccgcatggggatgggcaccacgtacctcgccctgatggcgaccttcaagatgcggccgatgttcgccgtggggctcctcttccgccggctgaccagccgcgaggtcctgctcctgaccatcgggctgtccctcgtggccagcgtcgagctgcccaactccctggaggagctcggcgacgggctggccatgggcatcatgatgctgaagctcctgacggacttccagagccaccagctgtggaccaccctcctgtccctgaccttcatcaagacgaccctcagcctggactacgcctggaagaccatggcgatggtgctgtccatcgtgagcctcttccccctgtgcctgtccaccacgagccagaagaccacctggctccccgtcctgctgggctccttcgggtgcaagccgctcaccatgttcctgatcaccgagaacaagatctggggccgcaagagctggcccctgaacgaggggatcatggccgtgggcatcgtgtccatcctcctgagcagcctgctcaagaacgacgtccccctggccgggcccctgatcgccggcggcatgctcatcgcgtgctacgtgatctccgggagctccgccgacctgagcctggagcgcgccgccgaggtgtcctgggaggaggaggccgagcacagcggcgcgtcccacaacatcctcgtcgaggtgcaggacgacgggacgatgaagatcaaggacgaggagcgggacgacaccctgaccatcctgctcaaggccaccctgctggccgtgagcggcgtctacccgatgtccatccccgccaccctcttcgtgtggtacttctggcagaagaagaagcagcgcagcggggtgctgtgggacacccccagcccgcccgaggtcgagcgggccgtgctggacgacggcatctaccgcatcctgcagcggggcctcctggggcgcagccaggtgggcgtcggggtgttccaggacggcgtgttccacaccatgtggcacgtcacccgcggggcggtgctgatgtaccagggcaagcgcctcgagccctcctgggccagcgtgaagaaggacctgatctcctacggcgggggctggcggttccaggggagctggaacacgggcgaggaggtccaggtgatcgccgtggagcccgggaagaaccccaagaacgtccagaccacccccggcaccttcaagacgcccgagggcgaggtgggggccatcgccctggacttcaagcccggcacctccgggagccccatcgtgaaccgcgagggcaagatcgtcggcctctacgggaacggcgtggtgaccacctccgggacgtacgtcagcgcgatcgcccaggccaaggccagccaggagggcccgctgcccgagatcgaggacgaggtgttcaagaagcggaacctgaccatcatggacctccaccccgggtccggcaagacccgccgctacctgccggccatcgtgcgggaggcgatcaagcgcaagctgcggaccctcatcctggcccccacgcgcgtcgtggccagcgagatggccgaggcgctgaagggcatgcccatccggtaccagaccaccgccgtgaagtccgagcacaccgggaaggagatcgtcgacctcatgtgccacgccacgttcaccatgcgcctgctgagccccgtgcgggtgccgaactacaacatgatcatcatggacgaggcccacttcaccgaccccgcctccatcgcggcccgcggctacatcagcacccgggtcgggatgggcgaggccgccgccatcttcatgacggcgacgccgcccgggtccgtggaggccttcccgcagagcaacgccgtgatccaggacgaggagcgcgacatccccgagcggtcctggaacagcggctacgactggatcaccgacttccccggcaagaccgtctggttcgtgccctccatcaagagcgggaacgacatcgccaactgcctccgcaagaacggcaagcgggtgatccagctgtcccgcaagacgttcgacaccgagtaccagaagaccaagaacaacgactgggactacgtcgtgaccacggacatcagcgagatgggggccaacttccgggcggaccgcgtgatcgacccgcggcgctgcctgaagcccgtcatcctcaaggacggccccgagcgggtgatcctggccgggcccatgccggtcaccgccgcctccgcggcccagcgccgcggccggatcggccgcaaccagaacaaggagggggaccagtacatctacatgggccagcccctgaacaacgacgaggaccacgcccactggaccgaggccaagatgctcctggacaacatcaacacccccgaggggatcatccccgccctgttcgagccggagcgggagaagtccgcggccatcgacggcgagtaccgcctccgcggggaggcccgcaagacgttcgtggagctgatgcggcgcggcgacctgcccgtgtggctctcctacaaggtcgccagcgagggcttccagtactccgaccggcgctggtgcttcgacggggagcggaacaaccaggtgctggaggagaacatggacgtggagatctggaccaaggagggcgagcgcaagaagctgcggccccgctggctcgacgcccggacctacagcgaccccctggcgctgcgcgagttcaaggagttcgccgccgggcggcgcagcgtctccggcgacctcatcctggagatcggcaagctgccgcagcacctcaccctgcgggcccagaacgccctggacaacctcgtgatgctgcacaacagcgagcagggcgggaaggcgtaccgccacgccatggaggagctgcccgacaccatcgagacgctcatgctgctggccctcatcgccgtgctgaccgggggcgtcaccctgttcttcctctccgggaagggcctgggcaagaccagcatcgggctgctctgcgtgatggcgtccagcgtgctgctgtggatggcctccgtcgagccccactggatcgccgccagcatcatcctcgagttcttcctgatggtgctgctcatccccgagccggaccggcagcgcacgccccaggacaaccagctggcctacgtggtcatcggcctcctcttcatgatcctgaccgtggcggccaacgagatggggctgctcgagaccaccaagaaggacctgggcatcgggcacgtggtcgccgagaaccaccaccacgccacgatgctggacatcgacctccaccccgcctccgcgtggaccctgtacgccgtggccaccaccatcatcacgccgatgatgcgccacaccatcgagaacaccaccgccaacatcagcctgacggccatcgcgaaccaggccgccatcctcatgggcctggacaagggctggcccatctccaagatggacatcggggtgcccctgctcgccctgggctgctacagccaggtcaaccccctgaccctcaccgccgcggtgctgatgctggtggcccactacgccatcatcgggccgggcctccaggccaaggcgacccgggaggcccagaagcgcacggccgccgggatcatgaagaaccccaccgtcgacggcatcgtggccatcgacctggaccccgtggtctacgacgcgaagttcgagaagcagctgggccagatcatgctcctgatcctgtgcacctcccagatcctcctgatgcggaccacgtgggccctgtgcgagagcatcaccctcgccaccgggcccctgaccacgctgtgggagggctccccggggaagttctggaacaccaccatcgccgtgagcatggccaacatcttccgcggctcctacctcgcgggcgccgggctggccttcagcctgatgaagtccctcggcgggggccggcgcgggaccggcgcccagggcgagacgctgggggagaagtggaagcggcagctgaaccagctcagcaagagcgagttcaacacctacaagcgctccggcatcatggaggtggaccggagcgaggccaaggaggggctgaagcgcggcgagaccaccaagcacgcggtctcccgggggacggccaagctgcgctggttcgtggagcggaacctggtgaagcccgagggcaaggtcatcgacctcggctgcgggcgcggcgggtggagctactactgcgccggcctgaagaaggtgaccgaggtgaaggggtacaccaagggcggccccgggcacgaggagcccatcccgatggccacctacggctggaacatcgtcaagctgcactccgggcgggacgtgttcttcacgccgcccgagaagtgcgacacgctcctgtgcgacatcggcgagagctcccccaacccgaccatcgaggaggggcgcaccctgcgggtgctcaagatggtcgagccctggctgcgcggcaaccagttctgcatcaagatcctgaacccctacatgcccagcgtggtggagaccctcgagcagatgcagcggaagcacggcgggatgctggtccgcaacccgctgtcccgcaacagcacgcacgagatgtactgggtgtcctgcggcaccgggaacatcgtgagcgcggtcaacatgacctcccggatgctcctgaaccgcttcaccatggcccaccggaagcccacgtacgagcgcgacgtggacctgggcgccggcacccggcacgtggccgtcgagcccgagatcgccaacctcgacatcatcgggcagcgcatcgagaacatcaagaacgagcacaagagcacctggcactacgacgaggacaacccctacaagacctgggcgtaccacggctcctacgaggtgaagccgagcgggtccgccagctccatggtgaacggcgtcgtgcggctgctgacgaagccctgggacgtcatccccatggtgacccagatcgccatgaccgacaccacgcccttcgggcagcagcgcgtgttcaaggagaaggtcgacacccggaccccgcgccccaagcggggcaccgcccagatcatggaggtgacggccaagtggctctggggcttcctgagccgcaacaagaagccccggatctgcacccgcgaggagttcacccggaaggtgcgcagcaacgcggccatcggggccgtcttcgtggacgagaaccagtggaactccgccaaggaggccgtggaggacgagcggttctgggacctggtccaccgcgagcgggagctccacaagcagggcaagtgcgcgacctgcgtgtacaacatgatggggaagcgcgagaagaagctgggcgagttcgggaaggccaagggcagccgggccatctggtacatgtggctgggcgcccgcttcctcgagttcgaggcgctggggttcatgaacgaggaccactggttctcccgcgagaacagcctgtccggcgtggagggggagggcctccacaagctggggtacatcctgcgggacatcagcaagatcccgggcggcaacatgtacgccgacgacacggccgggtgggacacccgcatcaccgaggacgacctccagaacgaggccaagatcaccgacatcatggagcccgagcacgccctgctggcgacgtccatcttcaagctcacctaccagaacaaggtcgtgcgggtgcagcgccccgccaagagcggcaccgtcatggacgtgatctcccggcgcgaccagcgggggagcggccaggtgggcacctacgggctgaacacgttcaccaacatggaggtccagctgatccgccagatggagtccgagggcatcttcagcccctccgagctcgagaacagcaacctggccgagcgggtgctggactggctcgagaagcacggggtggagcgcctgaagcggatggccatctccggcgacgactgcgtcgtgaagccgaccgacgaccgcttcgccaccgcgctgacggccctcaacgacatggggaaggtgcggaaggacatcccccagtgggagcccagcaagggctggaacgactggcagcaggtccccttctgctcccaccacttccaccagctgatcatgaaggacggccgcgagatcgtggtgccgtgccggaaccaggacgagctggtcgggcgcgcccgggtgagccagggcgccgggtggagcctccgcgagaccgcctgcctgggcaagtcctacgcgcagatgtggcagctgatgtacttccaccggcgcgacctccgcctggccgccaacgccatctgcagcgccgtgcccgtcaactgggtgcccacctcccggaccacctggagcatccacgcgcaccaccagtggatgacgaccgaggacatgctgtccgtgtggaaccgcgtctggatcgaggagaacccctggatggaggacaagacccacgtgagctcctgggaggacgtgccgtacctcgggaagcgggaggaccagtggtgcggcagcctgatcggcctgaccgcccgcgccacgtgggccaccaacatccaggtcgcgatcaaccaggtgcggcgcctcatcgggaacgagaactacctggactacatgacctccatgaagcggttcaagaacgagagcgaccccgagggcgccctgtggtga

SEQ ID NO: 8934 - RNA, 9879 nt, synthetic construct
  misc_feature 1..9879: note = derived and/or modified CDS sequence (opt1) from DENV-1__KM403597__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtcacctacgggacctgcagccagaccggcgagcaccggcgcgaccggcgctccgtggccctggcgccccacgtgggcctggggctcgagacccggaccgagacctggatgagctccgagggcgcctggcgccagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccgccggatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctgacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtcgaggactacggcttcggggtgttcaccaccaacatctggctgaagctccgggactcctacacccagatgtgcgaccaccgcctgatgagcgccgcgatcaaggactccaaggccgtgcacgccgacatgggctactggatcgagagcgagaagaacgagacgtggaagctggcccgggcctccttcatcgaggtcaagacctgcatctggccccgcagccacaccctctggtccaacggcgtgctggagagcgagatgatcatccccaagatctacgggggcccgatctcccagcacaactaccggcccgggtacttcacccagacggcgggcccctggcacctggggaagctcgagctggacttcaacctgtgcgagggcaccaccgtggtcgtggacgagcactgcggcaaccgcgggccgagcctccggaccacgaccgtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggctgctctgcgtgagcatcatgatcgaggaggtgatgcgctcccggtggagccgcaagatgctgatgacgggcaccctggccatcttcttcctcctgatcatggggcagctgacctggaacgacctcatccggctgtgcatcatggtcggcgccaacgtgtccgaccgcatggggatgggcaccacgtacctggccctcatggcgaccttcaagatgcggccgatgttcgccgtggggctgctgttccgccggctcaccagccgcgaggtcctgctgctcaccatcgggctgtccctggtggccagcgtcgagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcctggaagaccatggcgatggtgctgtccatcgtgagcctgttccccctctgcctgtccaccacgagccagaagaccacctggctgcccgtcctcctgggctccttcgggtgcaagccgctgaccatgttcctcatcaccgagaacaagatctggggccgcaagagctggcccctgaacgaggggatcatggccgtgggcatcgtgtccatcctgctcagcagcctgctgaagaacgacgtccccctcgccgggcccctgatcgccggcggcatgctgatcgcgtgctacgtgatctccgggagctccgccgacctcagcctggagcgcgccgccgaggtgtcctgggaggaggaggccgagcacagcggcgcgtcccacaacatcctggtcgaggtgcaggacgacgggacgatgaagatcaaggacgaggagcgggacgacaccctcaccatcctgctgaaggccaccctcctggccgtgagcggcgtctacccgatgtccatccccgccacgctgttcgtgtggtacttctggcagaagaagaagcagcgcagcggggtgctctgggacacccccagcccgcccgaggtcgagcgggccgtgctggacgacggcatctaccgcatcctgcagcggggcctgctcgggcgcagccaggtgggcgtcggggtgttccaggacggcgtgttccacaccatgtggcacgtcacccgcggggcggtgctgatgtaccagggcaagcgcctggagccctcctgggccagcgtgaagaaggacctcatctcctacggcgggggctggcggttccaggggagctggaacacgggcgaggaggtccaggtgatcgccgtggagcccgggaagaaccccaagaacgtccagaccacccccggcaccttcaagacgcccgagggcgaggtgggggccatcgccctggacttcaagcccggcacctccgggagccccatcgtgaaccgcgagggcaagatcgtcggcctgtacgggaacggcgtggtgaccacctccgggacgtacgtcagcgcgatcgcccaggccaaggccagccaggagggcccgctccccgagatcgaggacgaggtgttcaagaagcggaacctgaccatcatggacctgcaccccgggtccggcaagacccgccgctacctcccggccatcgtgcgggaggcgatcaagcgcaagctgcggaccctgatcctcgcccccacgcgcgtcgtggccagcgagatggccgaggcgctgaagggcatgcccatccggtaccagaccaccgccgtgaagtccgagcacaccgggaaggagatcgtcgacctgatctgccacgccacgttcaccatgcgcctcctgagccccgtgcgggtgccgaactacaacatgatcatcatggacgaggcccacttcaccgaccccgcctccatcgcggcccgcggctacatcagcacccgggtcgggatgggcgaggccgccgccatcttcatgacggcgacgccgcccgggtccgtggaggccttcccgcagagcaacgccgtgatccaggacgaggagcgcgacatccccgagcggtcctggaacagcggctacgactggatcaccgacttccccggcaagaccgtctggttcgtgccctccatcaagagcgggaacgacatcgccaactgcctgcgcaagaacggcaagcgggtgatccagctctcccgcaagacgttcgacaccgagtaccagaagaccaagaacaacgactgggactacgtcgtgaccacggacatcagcgagatgggggccaacttccgggcggaccgcgtgatcgacccgcggcgctgcctgaagcccgtcatcctgaaggacggccccgagcgggtgatcctcgccgggcccatgccggtcaccgccgcctccgcggcccagcgccgcggccggatcggccgcaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgggagaagtccgcggccatcgacggcgagtaccgcctgcgcggggaggcccgcaagacgttcgtggagctcatgcggcgcggcgacctgcccgtgtggctgtcctacaaggtcgccagcgagggcttccagtactccgaccggcgctggtgcttcgacggggagcggaacaaccaggtgctcgaggagaacatggacgtggagatctggaccaaggagggcgagcgcaagaagctgcggccccgctggctggacgcccggacctacagcgaccccctcgcgctgcgcgagttcaaggagttcgccgccgggcggcgcagcgtctccggcgacctgatcctcgagatcggcaagctgccgcagcacctgaccctccgggcccagaacgccctggacaacctggtgatgctccacaacagcgagcagggcgggaaggcgtaccgccacgccatggaggagctgcccgacaccatcgagacgctgatgctcctggccctgatcgccgtgctcaccgggggcgtcaccctgttcttcctgtccgggaagggcctcggcaagaccagcatcgggctgctgtgcgtgatggcgtccagcgtgctcctgtggatggcctccgtcgagccccactggatcgccgccagcatcatcctggagttcttcctcatggtgctgctgatccccgagccggaccggcagcgcacgccccaggacaaccagctcgcctacgtggtcatcggcctgctgttcatgatcctcaccgtggcggccaacgagatggggctgctggagaccaccaagaaggacctcggcatcgggcacgtggtcgccgagaaccaccaccacgccacgatgctggacatcgacctgcaccccgcctccgcgtggaccctctacgccgtggccaccaccatcatcacgccgatgatgcgccacaccatcgagaacaccaccgccaacatcagcctgacggccatcgcgaaccaggccgccatcctgatgggcctcgacaagggctggcccatctccaagatggacatcggggtgcccctgctggccctcggctgctacagccaggtcaaccccctgaccctgaccgccgcggtgctcatgctggtggcccactacgccatcatcgggccgggcctgcaggccaaggcgacccgggaggcccagaagcgcacggccgccgggatcatgaagaaccccaccgtcgacggcatcgtggccatcgacctcgaccccgtggtctacgacgcgaagttcgagaagcagctgggccagatcatgctgctcatcctgtgcacctcccagatcctgctcatgcggaccacgtgggccctgtgcgagagcatcaccctggccaccgggcccctcaccacgctgtgggagggctccccggggaagttctggaacaccaccatcgccgtgagcatggccaacatcttccgcggctcctacctggcgggcgccgggctcgccttcagcctgatgaagtccctgggcgggggccggcgcgggaccggcgcccagggcgagacgctcggggagaagtggaagcggcagctgaaccagctgagcaagagcgagttcaacacctacaagcgctccggcatcatggaggtggaccggagcgaggccaaggaggggctcaagcgcggcgagaccaccaagcacgcggtctcccgggggacggccaagctgcgctggttcgtggagcggaacctggtgaagcccgagggcaaggtcatcgacctgggctgcgggcgcggcgggtggagctactactgcgccggcctcaagaaggtgaccgaggtgaaggggtacaccaagggcggccccgggcacgaggagcccatcccgatggccacctacggctggaacatcgtcaagctgcactccgggcgggacgtgttcttcacgccgcccgagaagtgcgacacgctgctctgcgacatcggcgagagctcccccaacccgaccatcgaggaggggcgcaccctgcgggtgctgaagatggtcgagccctggctccgcggcaaccagttctgcatcaagatcctgaacccctacatgcccagcgtggtggagaccctggagcagatgcagcggaagcacggcgggatgctcgtccgcaacccgctgtcccgcaacagcacgcacgagatgtactgggtgtcctgcggcaccgggaacatcgtgagcgcggtcaacatgacctcccggatgctgctcaaccgcttcaccatggcccaccggaagcccacgtacgagcgcgacgtggacctgggcgccggcacccggcacgtggccgtcgagcccgagatcgccaacctggacatcatcgggcagcgcatcgagaacatcaagaacgagcacaagagcacctggcactacgacgaggacaacccctacaagacctgggcgtaccacggctcctacgaggtgaagccgagcgggtccgccagctccatggtgaacggcgtcgtgcggctcctgacgaagccctgggacgtcatccccatggtgacccagatcgccatgaccgacaccacgcccttcgggcagcagcgcgtgttcaaggagaaggtcgacacccggaccccgcgccccaagcggggcaccgcccagatcatggaggtgacggccaagtggctgtggggcttcctcagccgcaacaagaagccccggatctgcacccgcgaggagttcacccggaaggtgcgcagcaacgcggccatcggggccgtcttcgtggacgagaaccagtggaactccgccaaggaggccgtggaggacgagcggttctgggacctggtccaccgcgagcgggagctgcacaagcagggcaagtgcgcgacctgcgtgtacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgcgagaacagcctgtccggcgtggagggggagggcctgcacaagctcgggtacatcctgcgggacatcagcaagatcccgggcggcaacatgtacgccgacgacacggccgggtgggacacccgcatcaccgaggacgacctgcagaacgaggccaagatcaccgacatcatggagcccgagcacgccctcctggcgacgtccatcttcaagctgacctaccagaacaaggtcgtgcgggtgcagcgccccgccaagagcggcaccgtcatggacgtgatctcccggcgcgaccagcgggggagcggccaggtgggcacctacgggctcaacacgttcaccaacatggaggtccagctgatccgccagatggagtccgagggcatcttcagcccctccgagctggagaacagcaacctcgccgagcgggtgctggactggctggagaagcacggggtggagcgcctcaagcggatggccatctccggcgacgactgcgtcgtgaagccgaccgacgaccgcttcgccaccgcgctgacggccctgaacgacatggggaaggtgcggaaggacatcccccagtgggagcccagcaagggctggaacgactggcagcaggtccccttctgctcccaccacttccaccagctcatcatgaaggacggccgcgagatcgtggtgccgtgccggaaccaggacgagctggtcgggcgcgcccgggtgagccagggcgccgggtggagcctgcgcgagaccgcctgcctcggcaagtcctacgcgcagatgtggcagctgatgtacttccaccggcgcgacctgcgcctcgccgccaacgccatctgcagcgccgtgcccgtcaactgggtgcccacctcccggaccacctggagcatccacgcgcaccaccagtggatgacgaccgaggacatgctgtccgtgtggaaccgcgtctggatcgaggagaacccctggatggaggacaagacccacgtgagctcctgggaggacgtgccgtacctggggaagcgggaggaccagtggtgcggcagcctcatcggcctgaccgcccgcgccacgtgggccaccaacatccaggtcgcgatcaaccaggtgcggcgcctgatcgggaacgagaactacctcgactacatgacctccatgaagcggttcaagaacgagagcgaccccgagggcgccctgtggtga

SEQ ID NO: 8935 - RNA, 9879 nt, synthetic construct
  misc_feature 1..9879: note = derived and/or modified CDS sequence (opt1) from DENV-1__KM403610__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccatccacaccggcgaccagcaccaggtcgggaacgagacgaccgagcacggcaccatcgcgaccatcacgccccaggcccccacgagcgagatccagctgaccgactacggggccctcaccctggactgcagcccccgcaccggcctggacttcaacgagatggtgctcctgacgatgaaggagaagtcctggctggtccacaagcagtggttcctcgacctgccgctgccctggacctccggggccagcaccagccaggagacctggaaccggcaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccgcctgaagatggacaagctcaccctgaagggcgtgtcctacgtcatgtgcaccgggagcttcaagctggagaaggaggtggcggagacccagcacggcacggtgctggtccaggtgaagtacgagggcaccgacgccccctgcaagatccccatctccacccaggacgagaagggggtgacccagaacggccggctcatcacggccaacccgatcgtcaccgacaaggagaagcccgtgaacatcgagaccgagccgcccttcggggagagctacatcgtgatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtcttcacctccgtggggaagctggtgcaccaggtcttcggcaccgcctacggggtgctgttcagcggcgtgtcctggaccatgaagatcgggatcggcatcctcctgacgtggctgggcctcaacagccgctccaccagcctgtccatgacctgcatcgccgtcgggatggtgaccctgtacctcggcgtgatggtccaggccgacagcgggtgcgtgatcaactggaagggccgggagctgaagtgcgggtccggcatcttcgtgacgaacgaggtccacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagctccgagctgaaccacatcctgctcgagaacgacatgaagttcaccgtggtcgtgggggacgccaacggcatcctgacgcaggggaagaagatgatccggccccagcccatggagcacaagtacagctggaagtcctggggcaaggcgaagatcatcggcgccgacacccagaacaccaccttcatcatcgacgggcccgacacgccggagtgccccgacgaccagcgcgcctggaacatctgggaggtggaggactacggcttcggggtcttcaccaccaacatctggctgaagctccgggacagctacacccagatgtgcgaccaccgcctgatgtccgccgcgatcaaggacagcaaggccgtgcacgccgacatgggctactggatcgagtccgagaagaacgagacgtggaagctggcccgggccagcttcatcgaggtgaagacctgcatctggccccgctcccacaccctctggagcaacggcgtcctggagtccgagatgatcatccccaagatctacgggggcccgatcagccagcacaactaccggcccgggtacttcacccagacggcgggcccctggcacctggggaagctcgagctggacttcaacctgtgcgagggcaccaccgtggtggtcgacgagcactgcggcaaccgcgggccgtccctccggaccacgaccgtgaccggcaagatcatccacgagtggtgctgccgcagctgcaccctgccgcccctgcggttccgcggggaggacggctgctggtacgggatggagatccggcccgtgaaggagaaggaggagaacctcgtccgctccatggtgagcgccggcagcggcgaggtggactccttcagcctggggctgctctgcgtctccatcatgatcgaggaggtgatgcggagccgctggtccaagaagatgctgatgacgggcaccctggccgtgttcttcctcctgatcatggggcagctgacctggaacgacctcatccgcctgtgcatcatggtcggcgccaacgtgagcgaccggatggggatgggcaccacgtacctggccctcatggcgaccttcaagatgcgcccgatgttcgccgtggggctgctgttccggcgcctcacctcccgggaggtcctgctgctcaccatcgggctgagcctggtggcctccgtcgagctccccaacagcctggaggagctgggcgacgggctcgccatgggcatcatgatgctgaagctgctcacggacttccagtcccaccagctgtggaccaccctgctcagcctgaccttcatcaagacgaccctgtccctcgactacgcctggaagaccatggcgatggtgctgagcatcgtgtccctgttccccctctgcctgagcaccacgtcccagaagaccacctggctgcccgtcctcctgggcagcttcgggtgcaagccgctgaccatgttcctcatcaccgagaacaagatctggggccgcaagtcctggcccctgaacgaggggatcatggccgtgggcatcgtgagcatcctgctcagctccctgctgaagaacgacgtccccctcgccgggcccctgatcgccggcggcatgctgatcgcgtgctacgtgatcagcgggtccagcgccgacctctccctggagcgggccgccgaggtgagctgggaggaggaggccgagcactccggcgcgagccacaacatcctggtcgaggtgcaggacgacgggacgatgaagatcaaggacgaggagcgcgacgacaccctcaccatcctgctgaaggccaccctcctggccgtgtccggcgtctacccgatgagcatccccgccacgctgttcgtgtggtacttctggcagaagaagaagcagcggtccggggtgctctgggacacccccagcccgcccgaggtcgagcgcgccgtgctggacgacggcatctaccggatcctgcagcgcggcctgctcgggcggtcccaggtgggcgtcggggtgttccaggacggcgtgttccacaccatgtggcacgtcacccgcggggcggtgctgatgtaccagggcaagcggctggagcccagctgggcctccgtgaagaaggacctcatcagctacggcgggggctggcgcttccaggggtcctggaacacgggcgaggaggtccaggtgatcgccgtggagcccgggaagaaccccaagaacgtccagaccacccccggcaccttcaagacgcccgagggcgaggtgggggccatcgccctggacttcaagcccggcaccagcgggtcccccatcgtgaaccgggagggcaagatcgtcggcctgtacgggaacggcgtggtgaccaccagcgggacgtacgtcagcgcgatcgcccaggccaaggcctcccaggagggcccgctccccgagatcgaggacgaggtgttcaagaagcgcaacctgaccatcatggacctgcaccccgggagcggcaagacccggcgctacctcccggccatcgtgcgggaggcgatcaagcgcaagctgcgcaccctgatcctcgcccccacgcgggtcgtggcctccgagatggccgaggcgctgaagggcatgcccatccgctaccagaccaccgccgtcaagagcgagcacaccgggaaggagatcgtcgacctgatgtgccacgccacgttcaccatgcggctcctgtcccccgtgcgcgtgccgaactacaacatgatcatcatggacgaggcccacttcaccgaccccgccagcatcgcggcccggggctacatctccacccgcgtcgggatgggcgaggccgccgccatcttcatgacggcgacgccgcccgggagcgtggaggccttcccgcagtccaacgccgtgatccaggacgaggagcgggacatccccgagcgcagctggaactccggctacgactggatcaccgacttccccggcaagaccgtctggttcgtgcccagcatcaagtccgggaacgacatcgccaactgcctgcggaagaacggcaagcgcgtgatccagctcagccggaagacgttcgacaccgagtaccagaagaccaagaacaacgactgggactacgtcgtgaccacggacatctccgagatgggggccaacttccgcgcggaccgggtgatcgacccgcgccggtgcctgaagcccgtcatcctgaaggacggccccgagcgcgtgatcctcgccgggcccatgccggtcaccgccgccagcgcggcccagcggcgcggccggatcggccgcaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgcgagaagtccgcggccatcgacggcgagtaccggctgcgcggggaggcccggaagacgttcgtggagctcatgcgccggggcgacctgcccgtgtggctgagctacaaggtcgcctccgagggcttccagtacagcgaccgccggtggtgcttcgacggggagcgcaacaaccaggtgctcgaggagaacatggacgtggagatctggaccaaggagggcgagcggaagaagctgcgcccccggtggctggacgcccgcacctacagcgaccccctcgcgctgcgggagttcaaggagttcgccgccgggcgccggtccgtcagcggcgacctgatcctcgagatcggcaagctgccgcagcacctgaccctccgcgcccagaacgccctggacaacctggtgatgctccacaactccgagcagggcgggaaggcgtaccggcacgccatggaggagctgcccgacaccatcgagacgctgatgctcctggccctgatcgccgtgctcaccgggggcgtcaccctgttcttcctgagcgggaagggcctcggcaagacctccatcgggctgctgtgcgtgatggcgagctccgtgctcctgtggatggccagcgtcgagccccactggatcgccgcctccatcatcctggagttcttcctcatggtgctgctgatccccgagccggaccgccagcggacgccccaggacaaccagctcgcctacgtggtcatcggcctgctgttcatgatcctcaccgtggcggccaacgagatggggctgctggagaccaccaagaaggacctcggcatcgggcacgtggtcgccgagaaccaccaccacgccacgatgctggacatcgacctgcaccccgccagcgcgtggaccctctacgccgtggccaccaccatcatcacgccgatgatgcgccacaccatcgagaacaccaccgccaacatctccctgacggccatcgcgaaccaggccgccatcctgatgggcctcgacaagggctggcccatcagcaagatggacatcggggtgcccctgctggccctcggctgctactcccaggtcaaccccctgaccctgaccgccgcggtgctcatgctggtggcccactacgccatcatcgggccgggcctgcaggccaaggcgacccgggaggcccagaagcgcacggccgccgggatcatgaagaaccccaccgtcgacggcatcgtggccatcgacctcgaccccgtggtctacgacgcgaagttcgagaagcagctgggccagatcatgctgctcatcctgtgcaccagccagatcctgctcatgcgcaccacgtgggccctgtgcgagtccatcaccctggccaccgggcccctcaccacgctgtgggagggcagcccggggaagttctggaacaccaccatcgccgtgtccatggccaacatcttccggggcagctacctggcgggcgccgggctcgccttctccctgatgaagtccctgggcgggggccgccgggggaccggcgcccagggcgagacgctcggggagaagtggaagcgccagctgaaccagctgagcaagtccgagttcaacacctacaagcggagcggcatcatggaggtggaccgctccgaggccaaggaggggctcaagcggggcgagaccaccaagcacgcggtcagccgcgggacggccaagctgcggtggttcgtggagcgcaacctggtgaagcccgagggcaaggtcatcgacctgggctgcgggcggggcgggtggtcctactactgcgccggcctcaagaaggtgaccgaggtgaaggggtacaccaagggcggccccgggcacgaggagcccatcccgatggccacctacggctggaacatcgtcaagctgcacagcgggcgcgacgtgttcttcacgccgcccgagaagtgcgacacgctgctctgcgacatcggcgagtccagccccaacccgaccatcgaggaggggcggaccctgcgcgtgctgaagatggtcgagccctggctccggggcaaccagttctgcatcaagatcctgaacccctacatgccctccgtggtggagaccctggagcagatgcagcgcaagcacggcgggatgctcgtccggaacccgctgagccgcaactccacgcacgagatgtactgggtgagctgcggcaccgggaacatcgtgtccgcggtcaacatgaccagccggatgctgctcaaccgcttcaccatggcccaccgcaagcccacgtacgagcgggacgtggacctgggcgccggcacccgccacgtggccgtcgagcccgagatcgccaacctggacatcatcgggcagcggatcgagaacatcaagaacgagcacaagtccacctggcactacgacgaggacaacccctacaagacctgggcgtaccacggcagctacgaggtgaagccgtccgggagcgcctccagcatggtgaacggcgtcgtgcgcctcctgacgaagccctgggacgtcatccccatggtgacccagatcgccatgaccgacaccacgcccttcgggcagcagcgggtgttcaaggagaaggtcgacacccgcaccccgcggcccaagcgcggcaccgcccagatcatggaggtgacggccaagtggctgtggggcttcctcagccggaacaagaagccccgcatctgcacccgggaggagttcacccgcaaggtgcggtccaacgcggccatcggggccgtcttcgtggacgagaaccagtggaacagcgccaaggaggccgtggaggacgagcgcttctgggacctggtccaccgggagcgcgagctgcacaagcagggcaagtgcgcgacctgcgtgtacaacatgatggggaagcgggagaagaagctcggcgagttcgggaaggccaagggctcccgcgccatctggtacatgtggctgggcgcccggttcctggagttcgaggcgctcgggttcatgaacgaggaccactggttcagccgcgagaactccctgagcggcgtggagggggagggcctgcacaagctcgggtacatcctgcgggacatctccaagatcccgggcggcaacatgtacgccgacgacacggccgggtgggacacccgcatcaccgaggacgacctgcagaacgaggccaagatcaccgacatcatggagcccgagcacgccctcctggcgacgagcatcttcaagctgacctaccagaacaaggtcgtgcgcgtgcagcggcccgccaagtccggcaccgtcatggacgtgatcagccgccgggaccagcgcgggtccggccaggtgggcacctacgggctcaacacgttcaccaacatggaggtccagctgatccggcagatggagagcgagggcatcttcctgccctccgagctcgagaacagcaacctggccgagcgcgtgctggactggctcgagaagcacggggtggagcggctgaagcgcatggccatctccggcgacgactgcgtcgtgaagccgaccgacgaccggttcgccaccgcgctgacggccctcaacgacatggggaaggtgcgcaaggacatcccccagtgggagcccagcaagggctggaacgactggcagcaggtccccttctgctcccaccacttccaccagctgatcatgaaggacggccgggagatcgtggtgccgtgccgcaaccaggacgagctggtcgggcgggcccgcgtgagccagggcgccgggtggagcctccgggagaccgcctgcctgggcaagtcctacgcgcagatgtggcagctgatgtacttccaccgccgggacctccgcctggccgccaacgccatctgcagcgccgtgcccgtcaactgggtgcccacctcccggaccacctggagcatccacgcgcaccaccagtggatgacgaccgaggacatgctgtccgtgtggaaccgcgtctggatcgaggagaacccctggatggaggacaagacccacgtgagctcctgggaggacgtgccgtacctcgggaagcgcgaggaccagtggtgcggcagcctgatcggcctgaccgcccgggccacgtgggccaccaacatccaggtcgcgatcaaccaggtgcgccggctcatcgggaacgagaactacctggactacatgacctccatgaagcgcttcaagaacgagagcgaccccgagggcgccctgtggtga

SEQ ID NO: 8936 - RNA, 9879 nt, synthetic construct
  misc_feature 1..9879: note = derived and/or modified CDS sequence (opt1) from DENV-1__KM403596__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgaccggcgctccgtggccctggcgccccacgtgggcctggggctcgagacgcggaccgagacctggatgagctccgagggcgcctggcgccagatccagcgggtcgagacctgggccctgcgccaccccgggttcaccgtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctctccctggactgcagcccccgcaccggcctggacttcaacgagatggtcctcctgaccatgaaggagaagtcctggctggtgcacaagcagtggttcctcgacctgccgctgccctggacgagcggggccagcacctcccaggagacctggaaccggcaggacctcctggtgaccttcaagacggcccacgcgaagaagcaggaggtcgtggtgctgggcagccaggagggcgccatgcacaccgccctcaccggggccaccgagatccagacgtccggcaccaccaccatcttcgccgggcacctgaagtgccgcctgaagatggacaagctcacgctgaagggcgtcagctacgtgatgtgcaccgggtccttcaagctggagaaggaggtggcggagacccagcacggcaccgtcctggtccaggtgaagtacgagggcacggacgccccctgcaagatccccatcagcacccaggacgagaagggggtcacccagaacggccggctcatcaccgccaacccgatcgtgacggacaaggagaagcccgtgaacatcgagatcgagccgcccttcggggagtcctacatcgtcatcggcgccggcgagaaggcgctgaagctgagctggttcaagaaggggtccagcatcggcaagatgttcgaggccaccgcccgcggggcccgccggatggccatcctcggcgacaccgcgtgggacttcgggtccatcggcggcgtgttcaccagcgtggggaagctggtccaccaggtgttcggcacggcctacggggtgctgttctccggcgtcagctggaccatgaagatcgggatcggcatcctcctgacctggctgggcctcaactcccgcagcacctccctgagcatgacgtgcatcgccgtggggatggtgaccctgtacctcggcgtcatggtgcaggccgactccgggtgcgtgatcaactggaagggccgggagctgaagtgcgggagcggcatcttcgtcaccaacgaggtgcacacctggacggagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcaccgtcgtggtgggggacgccaacggcatcctgacccaggggaagaagatgatccggccccagcccatggagcacaagtacagctggaagtcctggggcaaggcgaagatcatcggcgccgacacccagaacacgaccttcatcatcgacgggcccgacaccccggagtgccccgacgaccagcgcgcctggaacatctgggaggtcgaggactacggcttcggggtgttcaccacgaacatctggctgaagctccgggacagctacacccagatgtgcgaccaccgcctgatgtccgccgcgatcaaggacagcaaggccgtgcacgccgacatgggctactggatcgagtccgagaagaacgagacctggaagctggcccgggccagcttcatcgaggtcaagacctgcatctggccccgctcccacacgctctggagcaacggcgtgctggagtccgagatgatcatccccaagatctacgggggcccgatcagccagcacaactaccggcccgggtacttcacccagaccgcgggcccctggcacctggggaagctcgagctggacttcaacctgtgcgagggcaccacggtggtcgtggacgagcactgcggcaaccgcgggccgtccctccggaccaccaccgtgacgggcaagatcatccacgagtggtgctgccgcagctgcaccctgccgcccctgcggttccgcggggaggacggctgctggtacgggatggagatccggcccgtcaaggagaaggaggagaacctcgtgcgctccatggtgagcgccggcagcggcgaggtcgactccttcagcctggggctgctctgcgtgtccatcatgatcgaggaggtgatgcgcagccggtggtcccgcaagatgctgatgaccggcaccctggccatcttcttcctcctgatcatggggcagctgacgtggaacgacctcatccggctgtgcatcatggtcggcgccaacgtgagcgaccgcatggggatgggcaccacctacctggccctcatggcgaccttcaagatgcggccgatgttcgccgtggggctgctgttccgccggctcacgtcccgcgaggtcctgctgctcaccatcgggctgagcctggtggcctccgtcgagctccccaacagcctggaggagctgggcgacgggctcgccatgggcatcatgatgctgaagctgctcaccgacttccagtcccaccagctgtggaccacgctgctcagcctgaccttcatcaagaccaccctgtccctcgactacgcctggaagacgatggcgatggtgctgagcatcgtgtccctgttccccctctgcctgagcaccacctcccagaagaccacgtggctgcccgtcctcctgggcagcttcgggtgcaagccgctgaccatgttcctcatcaccgagaacaagatctggggccggaagtcctggcccctgaacgaggggatcatggccgtgggcatcgtgagcatcctgctcagctccctgctgaagaacgacgtccccctcgccgggcccctgatcgccggcggcatgctgatcgcgtgctacgtgatcagcgggtccagcgccgacctctccctggagcgcgccgccgaggtgagctgggaggaggaggccgagcactccggcgcgagccacaacatcctggtcgaggtgcaggacgacgggaccatgaagatcaaggacgaggagcgggacgacaccctcacgatcctgctgaaggccaccctcctggccgtgtccggcgtctacccgatgagcatccccgccaccctgttcgtgtggtacttctggcagaagaagaagcagcgctccggggtgctctgggacacccccagcccgcccgaggtcgagcgggccgtgctggacgacggcatctaccgcatcctgcagcggggcctgctcgggcgctcccaggtgggcgtcggggtgttccaggacggcgtgttccacacgatgtggcacgtcacccgcggggcggtgctgatgtaccagggcaagcgcctggagcccagctgggcctccgtgaagaaggacctcatcagctacggcgggggctggcggttccaggggtcctggaacaccggcgaggaggtccaggtgatcgccgtggagcccgggaagaaccccaagaacgtccagaccacgcccggcaccttcaagacccccgagggcgaggtgggggccatcgccctggacttcaagcccggcaccagcgggtcccccatcgtgaaccgcgagggcaagatcgtcggcctgtacgggaacggcgtggtgacgaccagcgggacctacgtcagcgcgatcgcccaggccaaggcctcccaggagggcccgctccccgagatcgaggacgaggtgttcaagaagcggaacctgaccatcatggacctgcaccccgggagcggcaagacgcgccgctacctcccggccatcgtgcgggaggcgatcaagcgcaagctgcggaccctgatcctcgcccccacccgcgtcgtggcctccgagatggccgaggcgctgaagggcatgcccatccggtaccagaccacggccgtcaagagcgagcacaccgggaaggagatcgtcgacctgatgtgccacgccaccttcaccatgcgcctcctgtcccccgtgcgggtgccgaactacaacatgatcatcatggacgaggcccacttcacggaccccgccagcatcgcggcccgcggctacatctccacccgggtcgggatgggcgaggccgccgccatcttcatgaccgcgacgccgcccgggagcgtggaggccttcccgcagtccaacgccgtgatccaggacgaggagcgcgacatccccgagcggagctggaactccggctacgactggatcacggacttccccggcaagaccgtctggttcgtgcccagcatcaagtccgggaacgacatcgccaactgcctgcgcaagaacggcaagcgggtgatccagctcagccgcaagaccttcgacaccgagtaccagaagacgaagaacaacgactgggactacgtcgtgaccaccgacatctccgagatgggggccaacttccgggcggaccgcgtgatcgacccgcggcgctgcctgaagcccgtcatcctgaaggacggccccgagcgggtgatcctcgccgggcccatgccggtcaccgccgccagcgcggcccagcgccgcggccggatcggccgcaaccagaacaaggagggggaccagtacatctacatgggccagcccctgaacaacgacgaggaccacgcccactggacggaggccaagatgctgctcgacaacatcaacacccccgaggggatcatccccgccctgttcgagccggagcgggagaagtccgcggccatcgacggcgagtaccgcctgcgcggggaggcccgcaagaccttcgtggagctcatgcggcgcggcgacctgcccgtgtggctgagctacaaggtcgcctccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacgtacagcgaccccctcgcgctgcgcgagttcaaggagttcgccgccgggcggcgctccgtcagcggcgacctgatcctcgagatcggcaagctgccgcagcacctgaccctccgggcccagaacgccctggacaacctggtgatgctccacaactccgagcagggcgggaaggcgtaccgccacgccatggaggagctgcccgacaccatcgagaccctgatgctcctggccctgatcgccgtgctcaccgggggcgtcacgctgttcttcctgagcgggaagggcctcggcaagacctccatcgggctgctgtgcgtgatggcgagctccgtgctcctgtggatggccagcgtcgagccccactggatcgccgcctccatcatcctggagttcttcctcatggtgctgctgatccccgagccggaccggcagcgcacgccccaggacaaccagctcgcctacgtggtcatcggcctgctgttcatgatcctcaccgtggcggccaacgagatggggctgctggagacgaccaagaaggacctcggcatcgggcacgtggtcgccgagaaccaccaccacgccaccatgctggacatcgacctgcaccccgccagcgcgtggaccctctacgccgtggccacgaccatcatcaccccgatgatgcgccacaccatcgagaacacgaccgccaacatctccctgaccgccatcgcgaaccaggccgccatcctgatgggcctcgacaagggctggcccatcagcaagatggacatcggggtgcccctgctggccctcggctgctactcccaggtcaaccccctgaccctgacggccgcggtgctcatgctggtggcccactacgccatcatcgggccgggcctgcaggccaaggcgacccgggaggcccagaagcgcaccgccgccgggatcatgaagaaccccaccgtcgacggcatcgtggccatcgacctcgaccccgtggtctacgacgcgaagttcgagaagcagctgggccagatcatgctgctcatcctgtgcacgagccagatcctgctcatgcggaccacctgggccctgtgcgagtccatcaccctggccacggggcccctcaccaccctgtgggagggcagcccggggaagttctggaacaccacgatcgccgtgtccatggccaacatcttccgcggcagctacctggcgggcgccgggctcgccttctccctgatgaagtccctgggcgggggccggcgcgggaccggcgcccagggcgagaccctcggggagaagtggaagcggcagctgaaccagctgagcaagtccgagttcaacacctacaagcgcagcggcatcatggaggtggaccggtccgaggccaaggaggggctcaagcgcggcgagacgaccaagcacgcggtcagccgggggaccgccaagctgcgctggttcgtggagcggaacctggtgaagcccgagggcaaggtcatcgacctgggctgcgggcgcggcgggtggtcctactactgcgccggcctcaagaaggtgaccgaggtgaaggggtacacgaagggcggccccgggcacgaggagcccatcccgatggccacctacggctggaacatcgtcaagctgcacagcgggcgggacgtgttcttcacgccgcccgagaagtgcgacaccctgctctgcgacatcggcgagtccagccccaacccgaccatcgaggaggggcgcacgctgcgggtgctgaagatggtcgagccctggctccgcggcaaccagttctgcatcaagatcctgaacccctacatgccctccgtggtggagaccctggagcagatgcagcggaagcacggcgggatgctcgtccgcaacccgctgagccgcaactccacccacgagatgtactgggtgagctgcggcaccgggaacatcgtgtccgcggtcaacatgacgagccggatgctgctcaaccgcttcaccatggcccaccggaagcccacctacgagcgcgacgtggacctgggcgccggcacccggcacgtggccgtcgagcccgagacggccaacctggacatcatcgggcagcgcatcgagaacatcaagaacgagcacaagtccacctggcactacgacgaggacaacccctacaagacctgggcgtaccacggcagctacgaggtgaagccgtccgggagcgcctccagcatggtgaacggcgtcgtgcggctcctgaccaagccctgggacgtcatccccatggtgacgcagatcgccatgaccgacaccacccccttcgggcagcagcgcgtgttcaaggagaaggtcgacacgcggaccccgcgccccaagcggggcaccgcccagatcatggaggtgaccgccaagtggctgtggggcttcctcagccgcaacaagaagccccggatctgcacgcgcgaggagttcacccggaaggtgcgctccaacgcggccatcggggccgtcttcgtggacgagaaccagtggaacagcgccaaggaggccgtggaggacgagcggttctgggacctggtccaccgcgagcgggagctgcacaagcagggcaagtgcgcgacctgcgtgtacaacatgatggggaagcgcgagaagaagctcggcgagttcgggaaggccaagggctcccgggccatctggtacatgtggctgggcgcccgcttcctggagttcgaggcgctcgggttcatgaacgaggaccactggttcagccgcgagaactccctgagcggcgtggagggggagggcctgcacaagctcgggtacatcctgcgggacatctccaagatcccgggcggcaacatgtacgccgacgacaccgccgggtgggacacgcgcatcaccgaggacgacctgcagaacgaggccaagatcaccgacatcatggagcccgagcacgccctcctggcgaccagcatcttcaagctgacgtaccagaacaaggtcgtgcgggtgcagcgccccgccaagtccggcaccgtcatggacgtgatcagccggcgcgaccagcgggggtccggccaggtgggcacctacgggctcaacaccttcacgaacatggaggtccagctgatccgccagatggagagcgagggcatcttctcccccagcgagctggagaactccaacctcgccgagcgggtgctggactggctggagaagcacggggtggagcgcctcaagcggatggccatcagcggcgacgactgcgtcgtgaagccgaccgacgaccgcttcgccaccgcgctgaccgccctgaacgacatggggaaggtgcggaaggacatcccccagtgggagccctccaagggctggaacgactggcagcaggtccccttctgcagccaccacttccaccagctcatcatgaaggacggccgcgagatcgtggtgccgtgccggaaccaggacgagctggtcgggcgcgcccgggtgagccagggcgccgggtggtccctgcgcgagacggcctgcctcggcaagagctacgcgcagatgtggcagctgatgtacttccaccggcgcgacctgcgcctcgccgccaacgccatctgctccgccgtgcccgtcaactgggtgcccaccagccggaccacctggtccatccacgcgcaccaccagtggatgaccacggaggacatgctgagcgtgtggaaccgcgtctggatcgaggagaacccctggatggaggacaagacccacgtgtccagctgggaggacgtgccgtacctggggaagcgggaggaccagtggtgcggctccctcatcggcctgaccgcccgcgccacctgggccacgaacatccaggtcgcgatcaaccaggtgcggcgcctgatcgggaacgagaactacctcgactacatgaccagcatgaagcggttcaagaacgagtccgaccccgagggcgccctgtggtga

SEQ ID NO: 8937 - RNA, 9879 nt, synthetic construct
  misc_feature 1..9879: note = derived and/or modified CDS sequence (opt1) from DENV-1__KM403616__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgccggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtggtggtcaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtgcacaagcagtggttcctcgacctgccgctgccctggacctccggggccagcaccagccaggagacctggaaccggcaggacctcctggtcacgttcaagaccgcccacgcgaagaagcaggaggtggtggtcctgggctcccaggagggcgccatgcacaccgccctcaccggggccacggagatccagaccagcggcaccaccacgatcttcgccgggcacctgaagtgccgcctgaagatggacaagctcaccctgaagggcgtgtcctacgtgatgtgcaccgggagcttcaagctggagaaggaggtcgcggagacccagcacggcacggtgctggtgcaggtcaagtacgagggcaccgacgccccctgcaagatccccatctccacccaggacgagaagggggtgacccagaacggccggctcatcacggccaacccgatcgtgaccgacaaggagaagcccgtcaacatcgagaccgagccgcccttcggggagagctacatcgtgatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtcgggaagctggtgcaccaggtgttcggcaccgcctacggggtcctgttcagcggcgtgtcctggaccatgaagatcgggatcggcatcctcctgacgtggctgggcctcaacagccgctccaccagcctgtccatgacctgcatcgccgtggggatggtcaccctgtacctcggcgtgatggtgcaggccgacagcgggtgcgtcatcaactggaagggccgggagctgaagtgcgggtccggcatcttcgtgacgaacgaggtgcacacctggaccgagcagtacaagttccaggccgacagcccgaagcgcctgagcgcggccatcggcaaggcctgggaggagggggtctgcggcatccggtccgccacccgcctcgagaacatcatgtggaagcagatcagcaacgagctgaaccacatcctgctcgagaacgacatgaagttcaccgtggtggtcggggacgccaacggcatcctgacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtggaggactacggcttcggggtgttcaccaccaacatctggctgaagctccgggactcctacacccagatgtgcgaccaccgcctgatgagcgccgcgatcaaggactccaaggccgtccacgccgacatgggctactggatcgagagcgagaagaacgagacgtggaagctggcccgggcctccttcatcgaggtgaagacctgcatctggccccgcagccacaccctctggtccaacggcgtgctggagagcgagatgatcatccccaagatctacgggggcccgatctcccagcacaactaccggcccgggtacttcacccagacggcgggcccctggcacctggggaagctcgagctggacttcaacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggctgctctgcgtgagcatcatgatcgaggaggtcatgcggtcccgctggagccgcaagatgctgatgacgggcaccctggccgccttcttcctcctgatcatggggcagctgacctggaacgacctcatccggctgtgcatcatggtgggcgccaacgtgtccgaccgcatggggatgggcaccacgtacctggcgctcatggccaccttcaagatgcggccgatgttcgccgtcgggctgctgttccgccggctcaccagccgcgaggtgctgctgctcaccatcgggctgtccctggtcgccagcgtggagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcgtggaagaccatggccatggtgctgtccatcgtcagcctgttccccctctgcctgtccaccacgagccagaagaccacctggctgcccgtgctcctgggctccttcgggtgcaagccgctgaccatgttcctcatcaccgagaacaagatctggggccgcaagagctggcccctgaacgaggggatcatggccgtgggcatcgtctccatcctgctcagcagcctgctgaagaacgacgtgcccctcgccgggcccctgatcgcgggcggcatgctgatcgcctgctacgtgatctccgggagctccgccgacctcagcctggagcgcgccgccgaggtctcctgggaggaggaggcggagcacagcggcgcctcccacaacatcctggtggaggtgcaggacgacgggacgatgaagatcaaggacgaggagcgggacgacaccctcaccatcctgctgaaggccaccctcctggccgtcagcggcgtgtacccgatgtccatccccgccacgctgttcgtgtggtacttctggcagaagaagaagcagcgcagcggggtcctctgggacacccccagcccgcccgaggtggagcgggcggtgctggacgacggcatctaccgcatcctgcagcggggcctgctcgggcgcagccaggtcggcgtgggggtgttccaggacggcgtcttccacaccatgtggcacgtgacccgcggggccgtgctgatgtaccagggcaagcgcctggagccctcctgggccagcgtcaagaaggacctcatctcctacggcgggggctggcggttccaggggagctggaacacgggcgaggaggtccaggtgatcgccgtcgagcccgggaagaaccccaagaacgtgcagaccacccccggcaccttcaagacgcccgagggcgaggtgggggccatcgcgctggacttcaagcccggcacctccgggagccccatcgtcaaccgcgagggcaagatcgtgggcctgtacgggaacggcgtggtcaccacctccgggacgtacgtgagcgccatcgcccaggccaaggccagccaggagggcccgctccccgagatcgaggacgaggtgttcaagaagcggaacctgaccatcatggacctgcaccccgggtccggcaagacccgccggtacctcccggcgatcgtccgcgaggccatcaagcgcaagctgcggaccctgatcctcgcccccacgcgcgtggtggccagcgagatggcggaggccctgaagggcatgcccatccggtaccagaccaccgccgtcaagtccgagcacaccgggaaggagatcgtggacctgatgtgccacgccacgttcaccatgcgcctcctgagccccgtgcgggtcccgaactacaacatgatcatcatggacgaggcccacttcaccgaccccgcgtccatcgccgcccgcggctacatcagcacccgggtggggatgggcgaggccgccgcgatcttcatgacggccacgccgcccgggtccgtggaggccttcccgcagagcaacgccgtcatccaggacgaggagcgcgacatccccgagcggtcctggaacagcggctacgactggatcaccgacttccccggcaagaccgtgtggttcgtgccctccatcaagagcgggaacgacatcgccaactgcctgcgcaagaacggcaagcgggtcatccagctctcccgcaagacgttcgacaccgagtaccagaagaccaagaacaacgactgggactacgtggtgaccacggacatcagcgagatgggggcgaacttccgggccgaccgcgtcatcgacccgcggcgctgcctgaagcccgtgatcctgaaggacggccccgagcgggtcatcctcgccgggcccatgccggtgaccgccgcgtccgccgcccagcgccggggccgcatcggccgcaaccagaacaaggagggggaccagtacatctacatgggccagcccctgaacaacgacgaggaccacgcccactggaccgaggccaagatgctgctcgacaacatcaacacccccgaggggatcatccccgcgctgttcgagccggagcgggagaagtccgccgccatcgacggcgagtaccgcctgcgcggggaggcccgcaagacgttcgtggagctcatgcggcgcggcgacctgcccgtctggctgtcctacaaggtggccagcgagggcttccagtactccgaccggcgctggtgcttcgacggggagcggaacaaccaggtgctcgaggagaacatggacgtcgagatctggaccaaggagggcgagcgcaagaagctgcggccccgctggctggacgcgcggacctacagcgaccccctcgccctgcgcgagttcaaggagttcgccgccgggcggcgcagcgtgtccggcgacctgatcctcgagatcggcaagctgccgcagcacctgaccctccgggcccagaacgcgctggacaacctggtgatgctccacaacagcgagcagggcgggaaggcctaccgccacgccatggaggagctgcccgacaccatcgagacgctgatgctcctggccctgatcgcggtcctcaccgggggcgtgaccctgttcttcctgtccgggaagggcctcggcaagaccagcatcgggctgctgtgcgtgatggcctccagcgtcctcctgtggatggcctccgtggagccccactggatcgccgccagcatcatcctggagttcttcctcatggtgctgctgatccccgagccggaccggcagcgcacgccccaggacaaccagctcgcgtacgtcgtgatcggcctgctgttcatgatcctcaccgtggccgccaacgagatggggctgctggagaccaccaagaaggacctcggcatcgggcacgtcgtggccgagaaccaccaccacgccacgatgctggacatcgacctgcaccccgcgtccgcctggaccctctacgccgtggccaccaccatcatcacgccgatgatgcggcacaccatcgagaacaccaccgccaacatcagcctgacggcgatcgccaaccaggccgccatcctgatgggcctcgacaagggctggcccatctccaagatggacatcggggtccccctgctggccctcggctgctacagccaggtgaaccccctgaccctgaccgcggccgtgctcatgctggtcgcccactacgccatcatcgggccgggcctgcaggcgaaggccacccgcgaggcccagaagcgcacggccgccgggatcatgaagaaccccaccgtggacggcatcgtggcgatcgacctcgaccccgtcgtgtacgacgccaagttcgagaagcagctgggccagatcatgctgctcatcctgtgcacctcccagatcctgctcatgcggaccacgtgggccctgtgcgagagcatcaccctggccaccgggcccctcaccacgctgtgggagggctccccggggaagttctggaacaccaccatcgccgtgagcatggcgaacatcttccgcggctcctacctggccggcgccgggctcgccttcagcctgatgaagtccctgggcgggggccggcgcgggaccggcgcccagggcgagacgctcggggagaagtggaagcggcagctgaaccagctgagcaagagcgagttcaacacctacaagcgctccggcatcatggaggtcgaccggagcgaggcgaaggaggggctcaagcgcggcgagaccaccaagcacgccgtgtcccgggggacggccaagctgcgctggttcgtggagcggaacctggtcaagcccgagggcaaggtgatcgacctgggctgcgggcgcggcgggtggagctactactgcgccggcctcaagaaggtgaccgaggtcaaggggtacaccaagggcggccccgggcacgaggagcccatcccgatggcgacctacggctggaacatcgtgaagctgcactccgggcgggacgtgttcttcacgccgcccgagaagtgcgacacgctgctctgcgacatcggcgagagctcccccaacccgaccatcgaggaggggcgcaccctgcgggtcctgaagatggtggagccctggctccgcggcaaccagttctgcatcaagatcctgaacccctacatgcccagcgtggtcgagaccctggagcagatgcagcggaagcacggcgggatgctcgtgcgcaacccgctgtcccggaacagcacgcacgagatgtactgggtgtcctgcggcaccgggaacatcgtcagcgccgtgaacatgacctcccgcatgctgctcaaccgcttcaccatggcccaccggaagcccacgtacgagcgcgacgtggacctgggcgccggcacccggcacgtcgccgtggagcccgagatcgcgaacctggacatcatcgggcagcgcatcgagaacatcaagaacgagcacaagagcacctggcactacgacgaggacaacccctacaagacctgggcctaccacggctcctacgaggtgaagccgagcgggtccgccagctccatggtcaacggcgtggtccggctcctgacgaagccctgggacgtgatccccatggtgacccagatcgccatgaccgacaccacgcccttcgggcagcagcgcgtcttcaaggagaaggtggacacccggaccccgcgccccaagcggggcaccgcccagatcatggaggtgacggcgaagtggctgtggggcttcctcagccgcaacaagaagccccggatctgcacccgcgaggagttcacccggaaggtccgcagcaacgccgccatcggggccgtgttcgtggacgagaaccagtggaactccgccaaggaggcggtcgaggacgagcggttctgggacctggtgcaccgcgagcgggagctgcacaagcagggcaagtgcgcgacctgcgtgtacaacatgatggggaagcgcgagaagaagctcggcgagttcgggaaggccaagggcagccgggccatctggtacatgtggctgggcgcgcgcttcctggagttcgaggccctcgggttcatgaacgaggaccactggttctcccgggagaacagcctgtccggcgtcgagggggagggcctgcacaagctcgggtacatcctgcgcgacatcagcaagatcccgggcggcaacatgtacgccgacgacacggccgggtgggacacccgcatcaccgaggacgacctgcagaacgaggccaagatcaccgacatcatggagcccgagcacgcgctcctggccacgtccatcttcaagctgacctaccagaacaaggtggtgcgggtccagcgccccgccaagagcggcaccgtgatggacgtgatctcccggcgcgaccagcgggggagcggccaggtcggcacctacgggctcaacacgttcaccaacatggaggtgcagctgatccgccagatggagtccgagggcatcttcagcccctccgagctggagaacagcaacctcgccgagcgggtgctggactggctggagaagcacggggtcgagcgcctcaagcggatggccatctccggcgacgactgcgtggtgaagccgaccgacgaccgcttcgcgaccgccctgacggccctgaacgacatggggaaggtccggaaggacatcccccagtgggagcccagcaagggctggaacgactggcagcaggtccccttctgctcccaccacttccaccagctcatcatgaaggacggccgcgagatcgtggtcccgtgccggaaccaggacgagctggtggggcgcgcccgggtgagccagggcgccgggtggagcctgcgcgagaccgcgtgcctcggcaagtcctacgcccagatgtggcagctgatgtacttccaccggcgcgacctgcggctcgccgccaacgccatctgcagcgcggtccccgtgaactgggtgcccacctcccgcaccacctggagcatccacgcccaccaccagtggatgacgaccgaggacatgctgtccgtctggaaccgcgtgtggatcgaggagaacccctggatggaggacaagacccacgtgagctcctgggaggacgtcccgtacctggggaagcgggaggaccagtggtgcggcagcctcatcggcctgaccgcccgcgccacgtgggcgaccaacatccaggtggccatcaaccaggtgcggcgcctgatcgggaacgagaactacctcgactacatgacctccatgaagcggttcaagaacgagagcgaccccgagggcgccctgtggtga

SEQ ID NO: 8938 - RNA, 9879 nt, synthetic construct
  misc_feature 1..9879: note = derived and/or modified CDS sequence (opt1) from DENV-1__KM403617__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtggtggtcaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtgcacaagcagtggttcctcgacctgccgctgccctggacctccggggccagcaccagccaggagacctggaaccggcaggacctcctggtcacgttcaagaccgcccacgcgaagaagcaggaggtggtggtcctgggctcccaggagggcgccatgcacaccgccctcaccggggccacggagatccagaccagcggcaccaccacgatcttcgccgggcacctgaagtgccgcctgaagatggacaagctcaccctgaagggcgtgtcctacgtgatgtgcaccgggagcttcaagctggagaaggaggtcgcggagacccagcacggcacggtgctggtgcaggtcaagtacgagggcaccgacgccccctgcaagatccccatctccacccaggacgagaagggggtgacccagaacggccggctcatcacggccaacccgatcgtgaccgacaaggagaagcccgtcaacatcgagaccgagccgcccttcggggagagctacatcgtgatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtcgggaagctggtgcaccaggtgttcggcaccgcctacggggtcctgttcagcggcgtgtcctggaccatgaagatcgggatcggcatcctcctgacgtggctgggcctcaacagccgctccaccagcctgtccatgacctgcatcgccgtggggatggtcaccctgtacctcggcgtgatggtgcaggccgacagcgggtgcgtcatcaactggaagggccgggagctgaagtgcgggtccggcatcttcgtgacgaacgaggtgcacacctggaccgagcagtacaagttccaggccgacagcccgaagcgcctgagcgcggccatcggcaaggcctgggaggagggggtctgcggcatccggtccgccacccgcctcgagaacatcatgtggaagcagatcagcaacgagctgaaccacatcctgctcgagaacgacatgaagttcaccgtggtggtcggggacgccaacggcatcctgacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtggaggactacggcttcggggtgttcaccaccaacatctggctgaagctccgggactcctacacccagatgtgcgaccaccgcctgatgagcgccgcgatcaaggactccaaggccgtccacgccgacatgggctactggatcgagagcgagaagaacgagacgtggaagctggcccgggcctccttcatcgaggtgaagacctgcatctggccccgcagccacaccctctggtccaacggcgtgctggagagcgagatgatcatccccaagatctacgggggcccgatctcccagcacaactaccggcccgggtacttcacccagacggcgggcccctggcacctggggaagctcgagctggacttcaacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggctgctctgcgtgagcatcatgatcgaggaggtcatgcggtcccgctggagccgcaagatgctgatgacgggcaccctggccgtgttcttcctcctgatcatggggcagctgacctggaacgacctcatccggctgtgcatcatggtgggcgccaacgtctccgaccgcatggggatgggcaccacgtacctggccctcatggcgaccttcaagatgcggccgatgttcgccgtggggctgctgttccgccggctcaccagccgcgaggtcctgctgctcaccatcgggctgtccctggtggccagcgtggagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcctggaagaccatggcgatggtcctgtccatcgtgagcctgttccccctctgcctgtccaccacgagccagaagaccacctggctgcccgtgctcctgggctccttcgggtgcaagccgctgaccatgttcctcatcaccgagaacaagatctggggccgcaagagctggcccctgaacgaggggatcatggccgtcggcatcgtgtccatcctgctcagcagcctgctgaagaacgacgtgcccctcgccgggcccctgatcgccggcggcatgctgatcgcgtgctacgtcatctccgggagctccgccgacctcagcctggagcgcgccgccgaggtgtcctgggaggaggaggccgagcacagcggcgcgtcccacaacatcctggtggaggtccaggacgacgggacgatgaagatcaaggacgaggagcgggacgacaccctcaccatcctgctgaaggccaccctcctggccgtgagcggcgtgtacccgatgtccatccccgccacgctgttcgtctggtacttctggcagaagaagaagcagcgcagcggggtgctctgggacacccccagcccgcccgaggtggagcgggccgtcctggacgacggcatctaccgcatcctgcagcggggcctgctcgggcgcagccaggtgggcgtgggggtcttccaggacggcgtgttccacaccatgtggcacgtgacccgcggggcggtcctgatgtaccagggcaagcgcctggagccctcctgggccagcgtgaagaaggacctcatctcctacggcgggggctggcggttccaggggagctggaacacgggcgaggaggtgcaggtcatcgccgtggagcccgggaagaaccccaagaacgtgcagaccacccccggcaccttcaagacgcccgagggcgaggtcggggccatcgccctggacttcaagcccggcacctccgggagccccatcgtgaaccgcgagggcaagatcgtgggcctgtacgggaacggcgtcgtgaccacctccgggacgtacgtgagcgcgatcgcccaggccaaggccagccaggagggcccgctccccgagatcgaggacgaggtcttcaagaagcggaacctgaccatcatggacctgcaccccgggtccggcaagacccgccggtacctcccggccatcgtgcgcgaggcgatcaagcgcaagctgcggaccctgatcctcgcccccacgcgcgtggtcgccagcgagatggccgaggcgctgaagggcatgcccatccggtaccagaccaccgccgtgaagtccgagcacaccgggaaggagatcgtggacctgatgtgccacgccacgttcaccatgcgcctcctgagccccgtccgggtgccgaactacaacatgatcatcatggacgaggcccacttcaccgaccccgcctccatcgcggcccgcggctacatcagcacccgggtggggatgggcgaggccgccgccatcttcatgacggcgacgccgcccgggtccgtcgaggccttcccgcagagcaacgccgtgatccaggacgaggagcgcgacatccccgagcggtcctggaacagcggctacgactggatcaccgacttccccggcaagaccgtgtggttcgtcccctccatcaagagcgggaacgacatcgccaactgcctgcgcaagaacggcaagcgggtgatccagctctcccgcaagacgttcgacaccgagtaccagaagaccaagaacaacgactgggactacgtggtcaccacggacatcagcgagatgggggccaacttccgggcggaccgcgtgatcgacccgcggcgctgcctgaagcccgtcatcctgaaggacggccccgagcgggtgatcctcgccgggcccatgccggtgaccgccgcctccgcggcccagcgccggggccgcatcggccgcaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgggagaagtccgcggccatcgacggcgagtaccgcctgcgcggggaggcccgcaagacgttcgtcgagctcatgcggcgcggcgacctgcccgtgtggctgtcctacaaggtggccagcgagggcttccagtactccgaccggcgctggtgcttcgacggggagcggaacaaccaggtcctcgaggagaacatggacgtggagatctggaccaaggagggcgagcgcaagaagctgcggccccgctggctggacgcccggacctacagcgaccccctcgcgctgcgcgagttcaaggagttcgccgccgggcggcgcagcgtgtccggcgacctgatcctcgagatcggcaagctgccgcagcacctgaccctccgggcccagaacgccctggacaacctggtcatgctccacaacagcgagcagggcgggaaggcgtaccgccacgccatggaggagctgcccgacaccatcgagacgctgatgctcctggccctgatcgccgtgctcaccgggggcgtgaccctgttcttcctgtccgggaagggcctcggcaagaccagcatcgggctgctgtgcgtcatggcgtccagcgtgctcctgtggatggcctccgtggagccccactggatcgccgccagcatcatcctggagttcttcctcatggtcctgctgatccccgagccggaccggcagcgcacgccccaggacaaccagctcgcctacgtggtgatcggcctgctgttcatgatcctcaccgtcgcggccaacgagatggggctgctggagaccaccaagaaggacctcggcatcgggcacgtggtggccgagaaccaccaccacgccacgatgctggacatcgacctgcaccccgcctccgcgtggaccctctacgccgtcgccaccaccatcatcacgccgatgatgcggcacaccatcgagaacaccaccgccaacatcagcctgacggccatcgcgaaccaggccgccatcctgatgggcctcgacaagggctggcccatctccaagatggacatcggggtgcccctgctggccctcggctgctacagccaggtgaaccccctgaccctgaccgccgcggtcctcatgctggtggcccactacgccatcatcgggccgggcctgcaggccaaggcgacccgcgaggcccagaagcgcacggccgccgggatcatgaagaaccccaccgtggacggcatcgtcgccatcgacctcgaccccgtggtgtacgacgcgaagttcgagaagcagctgggccagatcatgctgctcatcctgtgcacctcccagatcctgctcatgcggaccacgtgggccctgtgcgagagcatcaccctggccaccgggcccctcaccacgctgtgggagggctccccggggaagttctggaacaccaccatcgccgtcagcatggccaacatcttccgcggctcctacctggcgggcgccgggctcgccttcagcctgatgaagtccctgggcgggggccggcgcgggaccggcgcccagggcgagacgctcggggagaagtggaagcggcagctgaaccagctgagcaagagcgagttcaacacctacaagcgctccggcatcatggaggtggaccggagcgaggccaaggaggggctcaagcgcggcgagaccaccaagcacgcggtgtcccgggggacggccaagctgcgctggttcgtcgagcggaacctggtgaagcccgagggcaaggtgatcgacctgggctgcgggcgcggcgggtggagctactactgcgccggcctcaagaaggtcaccgaggtgaaggggtacaccaagggcggccccgggcacgaggagcccatcccgatggccacctacggctggaacatcgtgaagctgcactccgggcgggacgtcttcttcacgccgcccgagaagtgcgacacgctgctctgcgacatcggcgagagctcccccaacccgaccatcgaggaggggcgcaccctgcgggtgctgaagatggtggagccctggctccgcggcaaccagttctgcatcaagatcctgaacccctacatgcccagcgtcgtggagaccctggagcagatgcagcggaagcacggcgggatgctcgtgcgcaacccgctgtcccggaacagcacgcacgagatgtactgggtctcctgcggcaccgggaacatcgtgagcgcggtgaacatgacctcccgcatgctgctcaaccgcttcaccatggcccaccggaagcccacgtacgagcgcgacgtcgacctgggcgccggcacccggcacgtggccgtggagcccgagatcgccaacctggacatcatcgggcagcgcatcgagaacatcaagaacgagcacaagagcacctggcactacgacgaggacaacccctacaagacctgggcgtaccacggctcctacgaggtcaagccgagcgggtccgccagctccatggtgaacggcgtcgtgcggctcctgacgaagccctgggacgtgatccccatggtcacccagatcgccatgaccgacaccacgcccttcgggcagcagcgcgtgttcaaggagaaggtggacacccggaccccgcgccccaagcggggcaccgcccagatcatggaggtcacggccaagtggctgtggggcttcctcagccgcaacaagaagccccggatctgcacccgcgaggagttcacccggaaggtgcgcagcaacgcggccatcggggccgtgttcgtcgacgagaaccagtggaactccgccaaggaggccgtggaggacgagcggttctgggacctggtgcaccgcgagcgggagctgcacaagcagggcaagtgcgcgacctgcgtctacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtggagggggagggcctgcacaagctcgggtacatcctgcgcgacatcagcaagatcccgggcggcaacatgtacgccgacgacacggccgggtgggacacccgcatcaccgaggacgacctgcagaacgaggccaagatcaccgacatcatggagcccgagcacgccctcctggcgacgtccatcttcaagctgacctaccagaacaaggtggtccgggtgcagcgccccgccaagagcggcaccgtgatggacgtcatctcccggcgcgaccagcgggggagcggccaggtgggcacctacgggctcaacacgttcaccaacatggaggtgcagctgatccgccagatggagtccgagggcatcttcagcccctccgagctggagaacagcaacctcgccgagcgggtcctggactggctggagaagcacggggtggagcgcctcaagcggatggccatctccggcgacgactgcgtggtcaagccgaccgacgaccgcttcgccaccgcgctgacggccctgaacgacatggggaaggtgcggaaggacatcccccagtgggagcccagcaagggctggaacgactggcagcaggtccccttctgctcccaccacttccaccagctcatcatgaaggacggccgcgagatcgtcgtgccgtgccggaaccaggacgagctggtggggcgcgcccgggtcagccagggcgccgggtggagcctgcgcgagaccgcctgcctcggcaagtcctacgcgcagatgtggcagctgatgtacttccaccggcgcgacctgcggctcgccgccaacgccatctgcagcgccgtgcccgtgaactgggtccccacctcccgcaccacctggagcatccacgcgcaccaccagtggatgacgaccgaggacatgctgtccgtgtggaaccgcgtgtggatcgaggagaacccctggatggaggacaagacccacgtcagctcctgggaggacgtgccgtacctggggaagcgggaggaccagtggtgcggcagcctcatcggcctgaccgcccgcgccacgtgggccaccaacatccaggtggcgatcaaccaggtccggcgcctgatcgggaacgagaactacctcgactacatgacctccatgaagcggttcaagaacgagagcgaccccgagggcgccctgtggtga

SEQ ID NO: 8939 - RNA, 9879 nt, synthetic construct
  misc_feature 1..9879: note = derived and/or modified CDS sequence (opt1) from DENV-1__KM403635__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgccggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcgccagccaggagacctggaaccggcaggacctcctggtgaccttcaagacggcgcacgccaagaagcaggaggtcgtggtgctgggctcccaggagggcgccatgcacaccgccctcaccggggccaccgagatccagacgagcggcaccaccaccatcttcgcggggcacctgaagtgccgcctgaagatggacaagctcacgctgaagggcgtctcctacgtgatgtgcaccgggagcttcaagctggagaaggaggtggccgagacccagcacggcaccgtcctggtccaggtgaagtacgagggcacggacgccccctgcaagatccccatctccacccaggacgagaagggggtcacccagaacggccggctcatcaccgccaacccgatcgtgacggacaaggagaagcccgtgaacatcgagaccgagccgcccttcggggagagctacatcgtcatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtggggaagctggtccaccaggtgttcggcaccgcctacggggtgctgttcagcggcgtctcctggaccatgaagatcgggatcggcatcctcctgacctggctgggcctcaacagccgctccacgagcctgtccatgacctgcatcgccgtggggatggtgaccctgtacctcggcgtcatggtgcaggccgacagcgggtgcgtgatcaactggaagggccgggagctgaagtgcgggtccggcatcttcgtcaccaacgaggtgcacacgtggaccgagcagtacaagttccaggcggacagcccgaagcgcctgagcgccgccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgcgaacggcatcctgacccaggggaagaagatgatccggccccagcccatggagcacaagtactcctggaagtcctggggcaaggccaagatcatcggcgccgacacgcagaacaccaccttcatcatcgacgggcccgacaccccggagtgccccgacgaccagcgcgcctggaacatctgggaggtcgaggactacggcttcggggtgttcacgaccaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtcaagacgtgcatctggccccgcagccacaccctctggtccaacggcgtgctggagagcgagatgatcatccccaagatctacgggggcccgatctcccagcacaactaccggcccgggtacttcacccagaccgccggcccctggcacctggggaagctcgagctggacttcaacctgtgcgagggcacgaccgtggtcgtggacgagcactgcggcaaccgcgggccgagcctccggaccaccacggtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggctgctctgcgtgagcatcatgatcgaggaggtgatgcggtcccgctggagccgcaagatgctgatgaccggcacgctggccgtcttcttcctcctgatcatggggcagctgacctggaacgacctcatccggctgtgcatcatggtgggcgccaacgtgtccgaccgcatggggatgggcaccacctacctggcgctcatggccacgttcaagatgcggccgatgttcgccgtcggcctgctgttccgccggctcaccagccgcgaggtgctgctgctcaccatcgggctgtccctggtcgccagcgtggagctccccaactccctggaggagctgggcgacgggctcgccatgggcatcatgatgctgaagctgctcaccgacttccagagccaccagctgtggacgaccctgctctccctgaccttcatcaagaccacgctgagcctcgactacgcgtggaagaccatggccatggtgctgtccatcgtcagcctgttccccctctgcctgtccaccaccagccagaagacgacctggctgcccgtgctcctgggctccttcgggtgcaagccgctgaccatgttcctcatcaccgagaacaagatctggggccgcaagagctggcccctgaacgaggggatcatggccgtgggcatcgtctccatcctgctcagcagcctgctgaagaacgacgtgcccctcgccgggcccctgatcgcgggcggcatgctgatcgcctgctacgtgatctccgggagctccgccgacctcagcctggagcgcgccgccgaggtctcctgggaggaggaggcggagcacagcggcgcctcccacaacatcctggtggaggtgcaggacgacgggaccatgaagatcaaggacgaggagcgggacgacacgctcaccatcctgctgaaggccaccctcctggccgtcagcggcgtgtacccgatgtccatccccgccaccctgttcgtgtggtacttctggcagaagaagaagcagcgcagcggggtcctctgggacacgcccagcccgcccgaggtggagcgggcggtgctggacgacggcatctaccgcatcctgcagcggggcctgctcgggcgcagccaggtcggcgtgggggtgttccaggacggcgtcttccacaccatgtggcacgtgacccgcggggccgtgctgatgtaccagggcaagcgcctggagccctcctgggccagcgtcaagaaggacctcatctcctacggcgggggctggcggttccaggggagctggaacaccggcgaggaggtccaggtgatcgccgtcgagcccgggaagaaccccaagaacgtgcagacgacccccggcaccttcaagacccccgagggcgaggtgggggccatcgcgctggacttcaagcccggcacgtccgggagccccatcgtcaaccgcgagggcaagatcgtgggcctgtacgggaacggcgtggtcaccacctccgggacctacgtgagcgccatcgcccaggccaaggccagccaggagggcccgctccccgagatcgaggacgaggtgttcaagaagcggaacctgacgatcatggacctgcaccccgggtccggcaagacccgccggtacctcccggcgatcgtccgcgaggccatcaagcgcaagctgcggaccctgatcctcgcccccacccgcgtggtggccagcgagatggcggaggccctgaagggcatgcccatccggtaccagacgaccgccgtcaagtccgagcacaccgggaaggagatcgtggacctgatgtgccacgccaccttcacgatgcgcctcctgagccccgtgcgggtcccgaactacaacatgatcatcatggacgaggcccacttcaccgaccccgcgtccatcgccgcccgcggctacatcagcacccgggtggggatgggcgaggccgccgcgatcttcatgaccgccacgccgcccgggtccgtggaggccttcccgcagagcaacgccgtcatccaggacgaggagcgcgacatccccgagcggtcctggaacagcggctacgactggatcaccgacttccccggcaagaccgtgtggttcgtgccctccatcaagagcgggaacgacatcgccaactgcctgcgcaagaacggcaagcgggtcatccagctctcccgcaagaccttcgacacggagtaccagaagaccaagaacaacgactgggactacgtggtgaccaccgacatcagcgagatgggggcgaacttccgggccgaccgcgtcatcgacccgcggcgctgcctgaagcccgtgatcctgaaggacggccccgagcgggtcatcctcgccgggcccatgccggtgacggccgcgtccgccgcccagcgccggggccgcatcggccgcaaccagaacaaggagggggaccagtacatctacatgggccagcccctgaacaacgacgaggaccacgcccactggaccgaggccaagatgctgctcgacaacatcaacacccccgaggggatcatccccgcgctgttcgagccggagcgggagaagtccgccgccatcgacggcgagtaccgcctgcgcggggaggcccgcaagaccttcgtggagctcatgcggcgcggcgacctgcccgtctggctgtcctacaaggtggccagcgagggcttccagtactccgaccggcgctggtgcttcgacggggagcggaacaaccaggtgctcgaggagaacatggacgtcgagatctggacgaaggagggcgagcgcaagaagctgcggccccgctggctggacgcgcggacctacagcgaccccctcgccctgcgcgagttcaaggagttcgccgccgggcggcgcagcgtgtccggcgacctgatcctcgagatcggcaagctgccgcagcacctgaccctccgggcccagaacgcgctggacaacctggtgatgctccacaacagcgagcagggcgggaaggcctaccgccacgccatggaggagctgcccgacaccatcgagaccctgatgctcctggccctgatcgcggtcctcaccggcggggtgaccctgttcttcctgtccgggaaggggctcggcaagaccagcatcgggctgctgtgcgtgatggcctccagcgtcctcctgtggatggcctccgtggagccccactggatcgccgccagcatcatcctggagttcttcctcatggtgctgctgatccccgagccggaccggcagcgcacgccccaggacaaccagctcgcgtacgtcgtgatcggcctgctgttcatgatcctcacggtggccgccaacgagatggggctgctggagaccaccaagaaggacctcggcatcgggcacgtcgtggccgagaaccaccaccacgccaccatgctggacatcgacctgcaccccgcgtccgcctggacgctctacgccgtggccaccaccatcatcaccccgatgatgcggcacacgatcgagaacaccaccgccaacatcagcctgaccgcgatcgccaaccaggccgccatcctgatgggcctcgacaagggctggcccatctccaagatggacatcggggtccccctgctggccctcggctgctacagccaggtgaaccccctgacgctgaccgcggccgtgctcatgctggtcgcccactacgccatcatcgggccgggcctgcaggcgaaggccacccgcgaggcccagaagcgcaccgccgccgggatcatgaagaaccccacggtggacggcatcgtggcgatcgacctcgaccccgtcgtgtacgacgccaagttcgagaagcagctgggccagatcatgctgctcatcctgtgcacctcccagatcctgctcatgcggaccacctgggccctgtgcgagagcatcacgctggccaccgggcccctcaccaccctgtgggagggctccccggggaagttctggaacacgaccatcgccgtgagcatggcgaacatcttccgcggctcctacctggccggcgccgggctcgccttcagcctgatgaagtccctgggcgggggccggcgcgggaccggcgcccagggcgagaccctcggggagaagtggaagcggcagctgaaccagctgagcaagagcgagttcaacacgtacaagcgctccggcatcatggaggtcgaccggagcgaggcgaaggaggggctcaagcgcggcgagaccaccaagcacgccgtgtcccgggggaccgccaagctgcgctggttcgtggagcggaacctggtcaagcccgagggcaaggtgatcgacctgggctgcgggcgcggcgggtggagctactactgcgccggcctcaagaaggtgacggaggtcaaggggtacaccaagggcggccccgggcacgaggagcccatcccgatggcgacctacggctggaacatcgtgaagctgcactccgggcgggacgtgttcttcacgccgcccgagaagtgcgacaccctgctctgcgacatcggcgagagctcccccaacccgacgatcgaggaggggcgcaccctgcgggtcctgaagatggtggagccctggctccgcggcaaccagttctgcatcaagatcctgaacccctacatgcccagcgtggtcgagaccctggagcagatgcagcggaagcacggcgggatgctcgtgcgcaacccgctgtcccggaacagcacccacgagatgtactgggtgtcctgcggcacggggaacatcgtcagcgccgtgaacatgacctcccgcatgctgctcaaccgcttcaccatggcccaccggaagcccacctacgagcgcgacgtggacctgggcgccggcacgcggcacgtcgccgtggagcccgagatcgcgaacctggacatcatcgggcagcgcatcgagaacatcaagaacgagcacaagagcacctggcactacgacgaggacaacccctacaagacctgggcctaccacggctcctacgaggtgaagccgagcgggtccgccagctccatggtcaacggcgtggtccggctcctgaccaagccctgggacgtgatccccatggtgacgcagatcgccatgaccgacaccacccccttcgggcagcagcgcgtcttcaaggagaaggtggacacgcggaccccgcgccccaagcggggcaccgcccagatcatggaggtgaccgcgaagtggctgtggggcttcctcagccgcaacaagaagccccggatctgcacgcgcgaggagttcacccggaaggtccgcagcaacgccgccatcggggccgtgttcgtggacgagaaccagtggaactccgccaaggaggcggtcgaggacgagcggttctgggacctggtgcaccgcgagcgggagctgcacaagcagggcaagtgcgcgacctgcgtgtacaacatgatggggaagcgcgagaagaagctcggcgagttcgggaaggccaagggcagccgggccatctggtacatgtggctgggcgcgcgcttcctggagttcgaggccctcgggttcatgaacgaggaccactggttctcccgggagaacagcctgtccggcgtcgagggggagggcctgcacaagctcgggtacatcctgcgcgacatcagcaagatcccgggcggcaacatgtacgccgacgacaccgccgggtgggacacgcgcatcaccgaggacgacctgcagaacgaggccaagatcaccgacatcatggagcccgagcacgcgctcctggccacctccatcttcaagctgacgtaccagaacaaggtggtgcgggtccagcgccccgccaagagcggcaccgtgatggacgtgatctcccggcgcgaccagcgggggagcggccaggtcggcacctacgggctcaacaccttcacgaacatggaggtgcagctgatccgccagatggagtccgagggcatcttcagcccctccgagctggagaacagcaacctcgccgagcgggtgctggactggctggagaagcacggggtcgagcgcctcaagcggatggccatctccggcgacgactgcgtggtgaagccgaccgacgaccgcttcgcgaccgccctgaccgccctgaacgacatggggaaggtccggaaggacatcccccagtgggagcccagcaagggctggaacgactggcagcaggtccccttctgctcccaccacttccaccagctcatcatgaaggacggccgcgagatcgtggtcccgtgccggaaccaggacgagctggtggggcgcgcccgggtgagccagggcgccgggtggagcctgcgcgagacggcgtgcctcggcaagtcctacgcccagatgtggcagctgatgtacttccaccggcgcgacctgcggctcgccgccaacgccatctgcagcgcggtccccgtgaactgggtgcccacctcccgcaccacctggagcatccacgcccaccaccagtggatgaccacggaggacatgctgtccgtctggaaccgcgtgtggatcgaggagaacccctggatggaggacaagacccacgtgagctcctgggaggacgtcccgtacctggggaagcgggaggaccagtggtgcggcagcctcatcggcctgaccgcccgcgccacctgggcgacgaacatccaggtggccatcaaccaggtgcggcgcctggtcgggaacgagaactacctcgactacatgacctccatgaagcggttcaagaacgagagcgaccccgagggcgccctgtggtga

SEQ ID NO: 8940 - RNA, 9879 nt, synthetic construct
  misc_feature 1..9879: note = derived and/or modified CDS sequence (opt1) from DENV-1__KM403621__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctgacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtcgaggactacggcttcggggtgttcaccaccaacatctggctgaagctccgggactcctacacccagatgtgcgaccaccgcctgatgagcgccgcgatcaaggactccaaggccgtgcacgccgacatgggctactggatcgagagcgagaagaacgagacgtggaagctggcccgggcctccttcatcgaggtcaagacctgcatctggccccgcagccacaccctctggtccaacggcgtgctggagagcgagatgatcatccccaagatctacgggggcccgatctcccagcacaactaccggcccgggtacttcacccagacggcgggcccctggcacctggggaagctcgagctggacttcaacctgtgcgagggcaccaccgtggtcgtggacgagcactgcggcaaccgcgggccgagcctccggaccacgaccgtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggctgctctgcgtgagcatcatgatcgaggaggtgatgcggtcccgctggagccgcaagatgctgatgacgggcaccctggccgtcttcttcctcctgatcatggggcagctgacctggaacgacctcatccggctgtgcatcatggtgggcgccaacgtgtccgaccgcatggggatgggcaccacgtacctggccctcatggcgaccttcaagatgcggccgatgttcgccgtcgggctgctgttccgccggctcaccagccgcgaggtgctgctgctcaccatcgggctgtccctggtcgccagcgtggagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcctggaagaccatggcgatggtgctgtccatcgtcagcctgttccccctctgcctgtccaccacgagccagaagaccacctggctgcccgtgctcctgggctccttcgggtgcaagccgctgaccatgttcctcatcaccgagaacaagatctggggccgcaagagctggcccctgaacgaggggatcatggccgtgggcatcgtctccatcctgctcagcagcctgctgaagaacgacgtgcccctcgccgggcccctgatcgccggcggcatgctgatcgcgtgctacgtgatctccgggagctccgccgacctcagcctggagcgcgccgccgaggtctcctgggaggaggaggccgagcacagcggcgcgtcccacaacatcctggtggaggtgcaggacgacgggacgatgaagatcaaggacgaggagcgggacgacaccctcaccatcctgctgaaggccaccctcctggccgtcagcggcgtgtacccgatgtccatccccgccacgctgttcgtgtggtacttctggcagaagaagaagcagcgcagcggggtcctctgggacacccccagcccgcccgaggtggagcgggccgtgctggacgacggcatctaccgcatcctgcagcggggcctgctcgggcgcagccaggtcggcgtgggggtgttccaggacggcgtcttccacaccatgtggcacgtgacccgcggggccgtgctgatgtaccagggcaagcgcctggagccctcctgggccagcgtcaagaaggacctcatctcctacggcgggggctggcggttccaggggagctggaacacgggcgaggaggtccaggtgatcgccgtcgagcccgggaagaaccccaagaacgtgcagaccacccccggcaccttcaagacgcccgagggcgaggtgggggccatcgccctggacttcaagcccggcacctccgggagccccatcgtcaaccgcgagggcaagatcgtgggcctgtacgggaacggcgtggtcaccacctccgggacgtacgtgagcgcgatcgcccaggccaaggccagccaggagggcccgctccccgagatcgaggacgaggtgttcaagaagcggaacctgaccatcatggacctgcaccccgggtccggcaagacccgccggtacctcccggccatcgtccgcgaggcgatcaagcgcaagctgcggaccctgatcctcgcccccacgcgcgtggtggccagcgagatggccgaggcgctgaagggcatgcccatccggtaccagaccaccgccgtcaagtccgagcacaccgggaaggagatcgtggacctgatgtgccacgccacgttcaccatgcgcctcctgagccccgtgcgggtcccgaactacaacatgatcatcatggacgaggcccacttcaccgaccccgcctccatcgcggcccgcggctacatcagcacccgggtggggatgggcgaggccgccgccatcttcatgacggcgacgccgcccgggtccgtggagagcttcccgcagtccaacgccgtcatccaggacgaggagcgcgacatccccgagcggagctggaactccggctacgactggatcaccgacttccccggcaagaccgtgtggttcgtgcccagcatcaagtccgggaacgacatcgccaactgcctgcgcaagaacggcaagcgggtcatccagctcagccgcaagacgttcgacaccgagtaccagaagaccaagaacaacgactgggactacgtggtgaccacggacatctccgagatgggggccaacttccgggccgaccgcgtcatcgacccgcggcgctgcctgaagcccgtgatcctgaaggacggccccgagcgggtcatcctcgcggggcccatgccggtgaccgccgccagcgccgcgcagcgccggggccgcatcggccgcaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgggagaagtccgccgcgatcgacggcgagtaccgcctgcgcggggaggcccgcaagacgttcgtggagctcatgcggcgcggcgacctgcccgtctggctgagctacaaggtggcctccgagggcttccagtacagcgaccggcgctggtgcttcgacggggagcggaacaaccaggtgctcgaggagaacatggacgtcgagatctggaccaaggagggcgagcgcaagaagctgcggccccgctggctggacgcccggacctacagcgaccccctcgccctgcgcgagttcaaggagttcgcggccgggcggcgctccgtgagcggcgacctgatcctcgagatcggcaagctgccgcagcacctgaccctccgggcccagaacgccctggacaacctggtgatgctccacaactccgagcagggcgggaaggcctaccgccacgcgatggaggagctgcccgacaccatcgagacgctgatgctcctggccctgatcgccgtcctcaccgggggcgtgaccctgttcttcctgagcgggaagggcctcggcaagacctccatcgggctgctgtgcgtgatggccagctccgtcctcctgtggatggcgagcgtggagccccactggatcgccgcctccatcatcctggagttcttcctcatggtgctgctgatccccgagccggaccggcagcgcacgccccaggacaaccagctcgcctacgtcgtgatcggcctgctgttcatgatcctcaccgtggccgcgaacgagatggggctgctggagaccaccaagaaggacctcggcatcgggcacgtcgtggccgagaaccaccaccacgccacgatgctggacatcgacctgcaccccgccagcgcctggaccctctacgcggtggccaccaccatcatcacgccgatgatgcggcacaccatcgagaacaccaccgccaacatctccctgacggccatcgccaaccaggcggccatcctgatgggcctcgacaagggctggcccatcagcaagatggacatcggggtccccctgctggccctcggctgctactcccaggtgaaccccctgaccctgaccgccgccgtgctcatgctggtcgcgcactacgccatcatcgggccgggcctgcaggccaaggccacccgcgaggcgcagaagcgcacggccgccgggatcatgaagaaccccaccgtggacggcatcgtggccatcgacctcgaccccgtcgtgtacgacgccaagttcgagaagcagctgggccagatcatgctgctcatcctgtgcaccagccagatcctgctcatgcggaccacgtgggcgctgtgcgagtccatcaccctggccaccgggcccctcaccacgctgtgggagggcagcccggggaagttctggaacaccaccatcgccgtgtccatggccaacatcttccgcggcagctacctggccggcgcggggctcgccttctccctgatgaagtccctgggcgggggccggcgcgggaccggcgcccagggcgagacgctcggggagaagtggaagcggcagctgaaccagctgagcaagtccgagttcaacacctacaagcgcagcggcatcatggaggtcgaccggtccgaggccaaggaggggctcaagcgcggcgagaccaccaagcacgccgtgagccgggggacggcgaagctgcgctggttcgtggagcggaacctggtcaagcccgagggcaaggtgatcgacctgggctgcgggcgcggcgggtggtcctactactgcgccggcctcaagaaggtgaccgaggtcaaggggtacaccaagggcggccccgggcacgaggagcccatcccgatggccacctacggctggaacatcgtgaagctgcacagcgggcgggacgtgttcttcacgccgcccgagaagtgcgacacgctgctctgcgacatcggcgagtccagccccaacccgaccatcgaggaggggcgcaccctgcgggtcctgaagatggtggagccctggctccgcggcaaccagttctgcatcaagatcctgaacccctacatgccctccgtggtcgagaccctggagcagatgcagcggaagcacggcgggatgctcgtgcgcaacccgctgagccggaactccacgcacgagatgtactgggtgagctgcggcaccgggaacatcgtctccgccgtgaacatgaccagccgcatgctgctcaaccgcttcaccatggcgcaccggaagcccacgtacgagcgcgacgtggacctgggcgccggcacccggcacgtcgccgtggagcccgagatcgccaacctggacatcatcgggcagcgcatcgagaacatcaagaacgagcacaagtccacctggcactacgacgaggacaacccctacaagacctgggcctaccacggcagctacgaggtgaagccgtccgggagcgcgtccagcatggtcaacggcgtggtccggctcctgacgaagccctgggacgtgatccccatggtgacccagatcgccatgaccgacaccacgcccttcgggcagcagcgcgtcttcaaggagaaggtggacacccggaccccgcgccccaagcggggcaccgcccagatcatggaggtgacggccaagtggctgtggggcttcctcagccgcaacaagaagccccggatctgcacccgcgaggagttcacccggaaggtccgctccaacgccgcgatcggggccgtgttcgtggacgagaaccagtggaacagcgccaaggaggccgtcgaggacgagcggttctgggacctggtgcaccgcgagcgggagctgcacaagcagggcaagtgcgcgacctgcgtgtacaacatgatggggaagcgcgagaagaagctcggcgagttcgggaaggcgaagggctcccgggccatctggtacatgtggctgggcgcccgcttcctggagttcgaggccctcgggttcatgaacgaggaccactggttcagccgggagaactccctgagcggcgtcgagggggagggcctgcacaagctcgggtacatcctgcgcgacatctccaagatcccgggcggcaacatgtacgcggacgacacggccgggtgggacacccgcatcaccgaggacgacctgcagaacgaggccaagatcaccgacatcatggagcccgagcacgccctcctggccacgagcatcttcaagctgacctaccagaacaaggtggtgcgggtccagcgccccgcgaagtccggcaccgtgatggacgtgatcagccggcgcgaccagcgggggtccggccaggtcggcacctacgggctcaacacgttcaccaacatggaggtgcagctgatccgccagatggagagcgagggcatcttctcccccagcgagctggagaactccaacctcgccgagcgggtgctggactggctggagaagcacggggtcgagcgcctcaagcggatggccatcagcggcgacgactgcgtggtgaagccgaccgacgaccgcttcgccaccgccctgacggcgctgaacgacatggggaaggtccggaaggacatcccccagtgggagccctccaagggctggaacgactggcagcaggtccccttctgcagccaccacttccaccagctcatcatgaaggacggccgcgagatcgtggtcccgtgccggaaccaggacgagctggtggggcgcgcccgggtgagccagggcgccgggtggtccctgcgcgagaccgcctgcctcggcaagagctacgcccagatgtggcagctgatgtacttccaccggcgcgacctgcggctcgcggccaacgccatctgctccgccgtccccgtgaactgggtgcccaccagccgcaccacctggtccatccacgcccaccaccagtggatgacgaccgaggacatgctgagcgtctggaaccgcgtgtggatcgaggagaacccctggatggaggacaagacccacgtgtccagctgggaggacgtcccgtacctggggaagcgggaggaccagtggtgcggctccctcatcggcctgaccgcgcgcgccacgtgggccaccaacatccaggtggccatcaaccaggtgcggcgcctgatcgggaacgagaactacctcgactacatgaccagcatgaagcggttcaagaacgagtccgaccccgagggcgcgctgtggtga

SEQ ID NO: 8941 - RNA, 9879 nt, synthetic construct
  misc_feature 1..9879: note = derived and/or modified CDS sequence (opt1) from DENV-1__KM403623__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtggagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgccccacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctgatcacggccaacccgatcgtgaccgacaaggagaagcccgtgaacatcgagaccgagccgcccttcggggagagctacatcgtcatcggcgccggcgagaaggcgctcaagctgtcctggttcaagaaggggagctccatcggcaagatgttcgaggccaccgcccgcggggcccggcgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccgctccaccagcctctccatgacctgcatcgccgtggggatggtgaccctgtacctgggcgtcatggtgcaggccgacagcgggtgcgtgatcaactggaagggccgggagctcaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctggagaacatcatgtggaagcagatcagcaacgagctcaaccacatcctgctggagaacgacatgaagttcaccgtcgtggtgggggacgccaacggcatcctcacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtcgaggactacggcttcggggtgttcaccaccaacatctggctgaagctgcgggactcctacacccagatgtgcgaccaccgcctcatgagcgccgcgatcaaggactccaaggccgtgcacgccgacatgggctactggatcgagagcgagaagaacgagacgtggaagctggcccgggcctccttcatcgaggtcaagacctgcatctggccccgcagccacaccctgtggtccaacggcgtgctcgagagcgagatgatcatccccaagatctacgggggcccgatctcccagcacaactaccggcccgggtacttcacccagacggcgggcccctggcacctggggaagctggagctcgacttcaacctgtgcgagggcaccaccgtggtcgtggacgagcactgcggcaaccgcgggccgagcctgcggaccacgaccgtgaccggcaagatcatccacgagtggtgctgccgctcctgcaccctgccgcccctgcggttccgcggggaggacggctgctggtacgggatggagatccggcccgtcaaggagaaggaggagaacctggtgcgcagcatggtgtccgccggcagcggcgaggtcgacagcttctccctcgggctgctgtgcgtgagcatcatgatcgaggaggtgatgcggtcccgctggagccgcaagatgctcatgacgggcaccctggccgtcttcttcctgctcatcatggggcagctgacctggaacgacctgatccggctctgcatcatggtgggcgccaacgtgtccgaccgcatggggatgggcaccacgtacctggccctgatggcgaccttcaagatgcggccgatgttcgccgtcggcctcctgttccgccggctgaccagccgcgaggtgctcctgctgaccatcgggctctccctggtcgccagcgtggagctgcccaactccctcgaggagctgggcgacgggctggccatgggcatcatgatgctcaagctgctgacggacttccagagccaccagctctggaccaccctgctgtccctcaccttcatcaagacgaccctgagcctggactacgcctggaagaccatggcgatggtgctctccatcgtcagcctgttccccctgtgcctctccaccacgagccagaagaccacctggctgcccgtgctgctcggctccttcgggtgcaagccgctgaccatgttcctgatcaccgagaacaagatctggggccgcaagagctggcccctcaacgaggggatcatggccgtgggcatcgtctccatcctgctgagcagcctcctgaagaacgacgtgcccctggccgggcccctcatcgccggcggcatgctgatcgcgtgctacgtgatctccgggagctccgccgacctgagcctcgagcgcgccgccgaggtctcctgggaggaggaggccgagcacagcggcgcgtcccacaacatcctggtggaggtgcaggacgacgggacgatgaagatcaaggacgaggagcgggacgacaccctgaccatcctcctgaaggccaccctgctcgccgtcagcggcgtgtacccgatgtccatccccgccacgctgttcgtgtggtacttctggcagaagaagaagcagcgcagcggggtcctgtgggacacccccagcccgcccgaggtggagcgggccgtgctcgacgacggcatctaccgcatcctgcagcggggcctgctggggcgcagccaggtcggcgtgggggtgttccaggacggcgtcttccacaccatgtggcacgtgacccgcggggccgtgctcatgtaccagggcaagcgcctggagccctcctgggccagcgtcaagaaggacctgatctcctacggcgggggctggcggttccaggggagctggaacacgggcgaggaggtccaggtgatcgccgtcgagcccgggaagaaccccaagaacgtgcagaccacccccggcaccttcaagacgcccgagggcgaggtgggggccatcgccctcgacttcaagcccggcacctccgggagccccatcgtcaaccgcgagggcaagatcgtgggcctgtacgggaacggcgtggtcaccacctccgggacgtacgtgagcgcgatcgcccaggccaaggccagccaggagggcccgctgcccgagatcgaggacgaggtgttcaagaagcggaacctcaccatcatggacctgcaccccgggtccggcaagacccgccggtacctgccggccatcgtccgcgaggcgatcaagcgcaagctccggaccctgatcctggcccccacgcgcgtggtggccagcgagatggccgaggcgctcaagggcatgcccatccggtaccagaccaccgccgtcaagtccgagcacaccgggaaggagatcgtggacctgatgtgccacgccacgttcaccatgcgcctgctcagccccgtgcgggtcccgaactacaacatgatcatcatggacgaggcccacttcaccgaccccgcctccatcgcggcccgcggctacatcagcacccgggtggggatgggcgaggccgccgccatcttcatgacggcgacgccgcccgggtccgtggagagcttcccgcagtccaacgccgtcatccaggacgaggagcgcgacatccccgagcggagctggaactccggctacgactggatcaccgacttccccggcaagaccgtgtggttcgtgcccagcatcaagtccgggaacgacatcgccaactgcctgcgcaagaacggcaagcgggtcatccagctgagccgcaagacgttcgacaccgagtaccagaagaccaagaacaacgactgggactacgtggtgaccacggacatctccgagatgggggccaacttccgggccgaccgcgtcatcgacccgcggcgctgcctcaagcccgtgatcctgaaggacggccccgagcgggtcatcctggcggggcccatgccggtgaccgccgccagcgccgcgcagcgccggggccgcatcggccgcaaccagaacaaggagggggaccagtacatctacatgggccagcccctcaacaacgacgaggaccacgcccactggaccgaggccaagatgctgctggacaacatcaacacccccgaggggatcatccccgccctcttcgagccggagcgggagaagtccgccgcgatcgacggcgagtaccgcctgcgcggggaggcccgcaagacgttcgtggagctgatgcggcgcggcgacctccccgtctggctgagctacaaggtggcctccgagggcttccagtacagcgaccggcgctggtgcttcgacggggagcggaacaaccaggtgctggaggagaacatggacgtcgagatctggaccaaggagggcgagcgcaagaagctccggccccgctggctggacgcccggacctacagcgaccccctggccctccgcgagttcaaggagttcgcggccgggcggcgctccgtgagcggcgacctgatcctggagatcggcaagctcccgcagcacctgaccctgcgggcccagaacgccctcgacaacctggtgatgctgcacaactccgagcagggcgggaaggcctaccgccacgcgatggaggagctccccgacaccatcgagacgctgatgctgctcgccctgatcgccgtcctgaccgggggcgtgaccctcttcttcctgagcgggaagggcctgggcaagacctccatcgggctcctgtgcgtgatggccagctccgtcctgctctggatggcgagcgtggagccccactggatcgccgcctccatcatcctggagttcttcctgatggtgctcctgatccccgagccggaccggcagcgcacgccccaggacaaccagctggcctacgtcgtgatcggcctcctgttcatgatcctgaccgtggccgcgaacgagatggggctcctggagaccaccaagaaggacctgggcatcgggcacgtcgtggccgagaaccaccaccacgccacgatgctcgacatcgacctgcaccccgccagcgcctggaccctgtacgcggtggccaccaccatcatcacgccgatgatgcggcacaccatcgagaacaccaccgccaacatctccctcacggccatcgccaaccaggcggccatcctgatgggcctggacaagggctggcccatcagcaagatggacatcggggtccccctcctggccctgggctgctactcccaggtgaaccccctcaccctgaccgccgccgtgctgatgctcgtcgcgcactacgccatcatcgggccgggcctgcaggccaaggccacccgcgaggcgcagaagcgcacggccgccgggatcatgaagaaccccaccgtggacggcatcgtggccatcgacctggaccccgtcgtgtacgacgccaagttcgagaagcagctcggccagatcatgctgctgatcctctgcaccagccagatcctgctgatgcggaccacgtgggcgctctgcgagtccatcaccctggccaccgggcccctgaccacgctctgggagggcagcccggggaagttctggaacaccaccatcgccgtgtccatggccaacatcttccgcggcagctacctggccggcgcggggctggccttctccctcatgaagtccctgggcgggggccggcgcgggaccggcgcccagggcgagacgctgggggagaagtggaagcggcagctcaaccagctgagcaagtccgagttcaacacctacaagcgcagcggcatcatggaggtcgaccggtccgaggccaaggaggggctgaagcgcggcgagaccaccaagcacgccgtgagccgggggacggcgaagctccgctggttcgtggagcggaacctggtcaagcccgagggcaaggtgatcgacctgggctgcgggcgcggcgggtggtcctactactgcgccggcctgaagaaggtgaccgaggtcaaggggtacaccaagggcggccccgggcacgaggagcccatcccgatggccacctacggctggaacatcgtgaagctccacagcgggcgggacgtgttcttcacgccgcccgagaagtgcgacacgctgctgtgcgacatcggcgagtccagccccaacccgaccatcgaggaggggcgcaccctccgggtcctgaagatggtggagccctggctgcgcggcaaccagttctgcatcaagatcctcaacccctacatgccctccgtggtcgagaccctggagcagatgcagcggaagcacggcgggatgctggtgcgcaacccgctcagccggaactccacgcacgagatgtactgggtgagctgcggcaccgggaacatcgtctccgccgtgaacatgaccagccgcatgctgctgaaccgcttcaccatggcgcaccggaagcccacgtacgagcgcgacgtggacctcggcgccggcacccggcacgtcgccgtggagcccgagatcgccaacctggacatcatcgggcagcgcatcgagaacatcaagaacgagcacaagtccacctggcactacgacgaggacaacccctacaagacctgggcctaccacggcagctacgaggtgaagccgtccgggagcgcgtccagcatggtcaacggcgtggtccggctgctcacgaagccctgggacgtgatccccatggtgacccagatcgccatgaccgacaccacgcccttcgggcagcagcgcgtcttcaaggagaaggtggacacccggaccccgcgccccaagcggggcaccgcccagatcatggaggtgacggccaagtggctgtggggcttcctgagccgcaacaagaagccccggatctgcacccgcgaggagttcacccggaaggtccgctccaacgccgcgatcggggccgtgttcgtggacgagaaccagtggaacagcgccaaggaggccgtcgaggacgagcggttctgggacctcgtgcaccgcgagcgggagctgcacaagcagggcaagtgcgcgacctgcgtgtacaacatgatggggaagcgcgagaagaagctgggcgagttcgggaaggcgaagggctcccgggccatctggtacatgtggctcggcgcccgcttcctggagttcgaggccctggggttcatgaacgaggaccactggttcagccgggagaactccctcagcggcgtcgagggggagggcctgcacaagctggggtacatcctccgcgacatctccaagatcccgggcggcaacatgtacgcggacgacacggccgggtgggacacccgcatcaccgaggacgacctgcagaacgaggccaagatcaccgacatcatggagcccgagcacgccctgctcgccacgagcatcttcaagctgacctaccagaacaaggtggtgcgggtccagcgccccgcgaagtccggcaccgtgatggacgtgatcagccggcgcgaccagcgggggtccggccaggtcggcacctacgggctgaacacgttcaccaacatggaggtgcagctcatccgccagatggagagcgagggcatcttctcccccagcgagctggagaactccaacctggccgagcgggtgctcgactggctggagaagcacggggtcgagcgcctgaagcggatggccatcagcggcgacgactgcgtggtgaagccgaccgacgaccgcttcgccaccgccctcacggcgctgaacgacatggggaaggtccggaaggacatcccccagtgggagccctccaagggctggaacgactggcagcaggtccccttctgcagccaccacttccaccagctgatcatgaaggacggccgcgagatcgtggtcccgtgccggaaccaggacgagctcgtggggcgcgcccgggtgagccagggcgccgggtggtccctgcgcgagaccgcctgcctgggcaagagctacgcccagatgtggcagctcatgtacttccaccggcgcgacctgcggctggcggccaacgccatctgctccgccgtccccgtgaactgggtgcccaccagccgcaccacctggtccatccacgcccaccaccagtggatgacgaccgaggacatgctcagcgtctggaaccgcgtgtggatcgaggagaacccctggatggaggacaagacccacgtgtccagctgggaggacgtcccgtacctggggaagcgggaggaccagtggtgcggctccctgatcggcctcaccgcgcgcgccacgtgggccaccaacatccaggtggccatcaaccaggtgcggcgcctgatcgggaacgagaactacctggactacatgaccagcatgaagcggttcaagaacgagtccgaccccgagggcgcgctctggtga

SEQ ID NO: 8942 - RNA, 9879 nt, synthetic construct
  misc_feature 1..9879: note = derived and/or modified CDS sequence (opt1) from DENV-1__KM403575__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctgacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtcgaggactacggcttcggggtgttcaccaccaacatctggctgaagctccgggactcctacacccagatgtgcgaccaccgcctgatgagcgccgcgatcaaggactccaaggccgtgcacgccgacatgggctactggatcgagagcgagaagaacgagacgtggaagctggcccgggcctccttcatcgaggtcaagacctgcatctggccccgcagccacaccctctggtccaacggcgtgctggagagcgagatgatcatccccaagatctacgggggcccgatctcccagcacaactaccggcccgggtacttcacccagacggcgggcccctggcacctggggaagctcgagctggacttcaacctgtgcgagggcaccaccgtggtcgtggacgagcactgcggcaaccgcgggccgagcctccggaccacgaccgtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggctgctctgcgtgagcatcatgatcgaggaggtgatgcggtcccgctggagccgcaagatgctgatgacgggcaccctggccgtcttcttcctcctgatcatggggcagctgacctggaacgacctcatccggctgtgcatcatggtgggcgccaacgtgtccgaccgcatggggatgggcaccacgtacctggccctcatggcgaccttcaagatgcggccgatgttcgccgtcgggctgctgttccgccggctcaccagccgcgaggtgctgctgctcaccatcgggctgtccctggtcgccagcgtggagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcctggaagaccatggcgatggtgctgtccatcgtcagcctgttccccctctgcctgtccaccacgagccagaagaccacctggctgcccgtgctcctgggctccttcgggtgcaagccgctgaccatgttcctcatcaccgagaacaagatctggggccgcaagagctggcccctgaacgaggggatcatggccgtgggcatcgtctccatcctgctcagcagcctgctgaagaacgacgtgcccctcgccgggcccctgatcgccggcggcatgctgatcgcgtgctacgtgatctccgggagctccgccgacctcagcctggagcgcgccgccgaggtctcctgggaggaggaggccgagcacagcggcgcgtcccacaacatcctggtggaggtgcaggacgacgggacgatgaagatcaaggacgaggagcgggacgacaccctcaccatcctgctgaaggccaccctcctggccgtcagcggcgtgtacccgatgtccatccccgccacgctgttcgtgtggtacttctggcagaagaagaagcagcgcagcggggtcctctgggacacccccagcccgcccgaggtggagcgggccgtgctggacgacggcatctaccgcatcctgcagcggggcctgctcgggcgcagccaggtcggcgtgggggtgttccaggacggcgtcttccacaccatgtggcacgtgacccgcggggcggtgctgatgtaccagggcaagcgcctggagccctcctgggccagcgtcaagaaggacctcatctcctacggcgggggctggcggttccaggggagctggaacacgggcgaggaggtccaggtgatcgccgtcgagcccgggaagaaccccaagaacgtgcagaccacccccggcaccttcaagacgcccgagggcgaggtgggggccatcgccctggacttcaagcccggcacctccgggagccccatcgtcaaccgcgagggcaagatcgtgggcctgtacgggaacggcgtggtcaccacctccgggacgtacgtgagcgcgatcgcccaggccaaggccagccaggagggcccgctccccgagatcgaggacgaggtgttcaagaagcggaacctgaccatcatggacctgcaccccgggtccggcaagacccgccggtacctcccggccatcgtccgcgaggcgatcaagcgcaagctgcggaccctgatcctcgcccccacgcgcgtggtggccagcgagatggccgaggcgctgaagggcatgcccatccggtaccagaccaccgccgtcaagtccgagcacaccgggaaggagatcgtggacctgatgtgccacgccacgttcaccatgcgcctcctgagccccgtgcgggtcccgaactacaacatgatcatcatggacgaggcccacttcaccgaccccgcctccatcgcggcccgcggctacatcagcacccgggtggggatgggcgaggccgccgccatcttcatgacggcgacgccgcccgggtccgtggaggccttcccgcagagcaacgccgtcatccaggacgaggagcgcgacatccccgagcggtcctggaacagcggctacgactggatcaccgacttccccggcaagaccgtgtggttcgtgccctccatcaagagcgggaacgacatcgccaactgcctgcgcaagaacggcaagcgggtcatccagctctcccgcaagacgttcgacaccgagtaccagaagaccaagaacaacgactgggactacgtggtgaccacggacatcagcgagatgggggccaacttccgggcggaccgcgtcatcgacccgcggcgctgcctgaagcccgtgatcctgaaggacggccccgagcgggtcatcctcgccgggcccatgccggtgaccgccgcctccgcggcccagcgccggggccgcatcggccgcaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgggagaagtccgcggccatcgacggcgagtaccgcctgcgcggggaggcccgcaagacgttcgtggagctcatgcggcgcggcgacctgcccgtctggctgtcctacaaggtggccagcgagggcttccagtactccgaccggcgctggtgcttcgacggggagcggaacaaccaggtgctcgaggagaacatggacgtcgagatctggaccaaggagggcgagcgcaagaagctgcggccccgctggctggacgcccggacctacagcgaccccctcgcgctgcgcgagttcaaggagttcgccgccgggcggcgcagcgtgtccggcgacctgatcctcgagatcggcaagctgccgcagcacctgaccctccgggcccagaacgccctggacaacctggtgatgctccacaacagcgagcagggcgggaaggcgtaccgccacgccatggaggagctgcccgacaccatcgagacgctgatgctcctggccctgatcgccgtcctcaccgggggcgtgaccctgttcttcctgtccgggaagggcctcggcaagaccagcatcgggctgctgtgcgtgatggcgtccagcgtcctcctgtggatggcctccgtggagccccactggatcgccgccagcatcatcctggagttcttcctcatggtgctgctgatccccgagccggaccggcagcgcacgccccaggacaaccagctcgcctacgtcgtgatcggcctgctgttcatgatcctcaccgtggcggccaacgagatggggctgctggagaccaccaagaaggacctcggcatcgggcacgtcgtggccgagaaccaccaccacgccacgatgctggacatcgacctgcaccccgcctccgcgtggaccctctacgccgtggccaccaccatcatcacgccgatgatgcggcacaccatcgagaacaccaccgccaacatcagcctgacggccatcgcgaaccaggccgccatcctgatgggcctcgacaagggctggcccatctccaagatggacatcggggtccccctgctggccctcggctgctacagccaggtgaaccccctgaccctgaccgccgcggtgctcatgctggtcgcccactacgccatcatcgggccgggcctgcaggccaaggcgacccgcgaggcccagaagcgcacggccgccgggatcatgaagaaccccaccgtggacggcatcgtggccatcgacctcgaccccgtcgtgtacgacgcgaagttcgagaagcagctgggccagatcatgctgctcatcctgtgcacctcccagatcctgctcatgcggaccacgtgggccctgtgcgagagcatcaccctggccaccgggcccctcaccacgctgtgggagggctccccggggaagttctggaacaccaccatcgccgtgagcatggccaacatcttccgcggctcctacctggcgggcgccgggctcgccttcagcctgatgaagtccctgggcgggggccggcgcgggaccggcgcccagggcgagacgctcggggagaagtggaagcggcagctgaaccagctgagcaagagcgagttcaacacctacaagcgctccggcatcatggaggtcgaccggagcgaggccaaggaggggctcaagcgcggcgagaccaccaagcacgcggtgtcccgggggacggccaagctgcgctggttcgtggagcggaacctggtcaagcccgagggcaaggtgatcgacctgggctgcgggcgcggcgggtggagctactactgcgccggcctcaagaaggtgaccgaggtcaaggggtacaccaagggcggccccgggcacgaggagcccatcccgatggccacctacggctggaacatcgtgaagctgcactccgggcgggacgtgttcttcacgccgcccgagaagtgcgacacgctgctctgcgacatcggcgagagctcccccaacccgaccatcgaggaggggcgcaccctgcgggtcctgaagatggtggagccctggctccgcggcaaccagttctgcatcaagatcctgaacccctacatgcccagcgtggtcgagaccctggagcagatgcagcggaagcacggcgggatgctcgtgcgcaacccgctgtcccggaacagcacgcacgagatgtactgggtgtcctgcggcaccgggaacatcgtcagcgcggtgaacatgacctcccgcatgctgctcaaccgcttcaccatggcccaccggaagcccacgtacgagcgcgacgtggacctgggcgccggcacccggcacgtcgccgtggagcccgagatcgccaacctggacatcatcgggcagcgcatcgagaacatcaagaacgagcacaagagcacctggcactacgacgaggacaacccctacaagacctgggcgtaccacggctcctacgaggtgaagccgagcgggtccgccagctccatggtcaacggcgtggtccggctcctgacgaagccctgggacgtgatccccatggtgacccagatcgccatgaccgacaccacgcccttcgggcagcagcgcgtcttcaaggagaaggtggacacccggaccccgcgccccaagcggggcaccgcccagatcatggaggtgacggccaagtggctgtggggcttcctcagccgcaacaagaagccccggatctgcacccgcgaggagttcacccggaaggtccgcagcaacgcggccatcggggccgtgttcgtggacgagaaccagtggaactccgccaaggaggccgtcgaggacgagcggttctgggacctggtgcaccgcgagcgggagctgcacaagcagggcaagtgcgcgacctgcgtgtacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtcgagggggagggcctgcacaagctcgggtacatcctgcgcgacatcagcaagatcccgggcggcaacatgtacgccgacgacacggccgggtgggacacccgcatcaccgaggacgacctgcagaacgaggccaagatcaccgacatcatggagcccgagcacgccctcctggcgacgtccatcttcaagctgacctaccagaacaaggtggtgcgggtccagcgccccgccaagagcggcaccgtgatggacgtgatctcccggcgcgaccagcgggggagcggccaggtcggcacctacgggctcaacacgttcaccaacatggaggtgcagctgatccgccagatggagtccgagggcatcttcagcccctccgagctggagaacagcaacctcgccgagcgggtgctggactggctggagaagcacggggtcgagcgcctcaagcggatggccatctccggcgacgactgcgtggtgaagccgaccgacgaccgcttcgccaccgcgctgacggccctgaacgacatggggaaggtccggaaggacatcccccagtgggagcccagcaagggctggaacgactggcagcaggtccccttctgctcccaccacttccaccagctcatcatgaaggacggccgcgagatcgtggtcccgtgccggaaccaggacgagctggtggggcgcgcccgggtgagccagggcgccgggtggagcctgcgcgagaccgcctgcctcggcaagtcctacgcgcagatgtggcagctgatgtacttccaccggcgcgacctgcggctcgccgccaacgccatctgcagcgccgtccccgtgaactgggtgcccacctcccgcaccacctggagcatccacgcgcaccaccagtggatgacgaccgaggacatgctgtccgtctggaaccgcgtgtggatcgaggagaacccctggatggaggacaagacccacgtgagctcctgggaggacgtcccgtacctggggaagcgggaggaccagtggtgcggcagcctcatcggcctgaccgcccgcgccacgtgggccaccaacatccaggtggcgatcaaccaggtgcggcgcctgatcgggaacgagaactacctcgactacatgacctccatgaagcggttcaagaacgagagcgaccccgagggcgccctgtggtga

SEQ ID NO: 8943 - RNA, 9879 nt, synthetic construct
  misc_feature 1..9879: note = derived and/or modified CDS sequence (opt1) from DENV-1__KM403586__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgccccacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgaggtccagctgaccgactacggggccctgaccctcgactgcagcccccggaccggcctggacttcaacgagatggtgctgctcacgatgaaggagaagtcctggctggtgcacaagcagtggttcctggacctcccgctgccctggacctccggggccagcaccagccaggagacctggaaccggcaggacctgctcgtcacgttcaagaccgcccacgcgaagaagcaggaggtggtggtcctgggctcccaggagggcgccatgcacaccgccctgaccggggccacggagatccagaccagcggcaccaccacgatcttcgccgggcacctcaagtgccgcctgaagatggacaagctgaccctcaagggcgtgtcctacgtgatgtgcaccgggagcttcaagctggagaaggaggtcgcggagacccagcacggcacggtgctggtgcaggtcaagtacgagggcaccgacgccccctgcaagatccccatctccacccaggacgagaagggggtgacccagaacggccggctgatcacggccaacccgatcgtgaccgacaaggagaagcccgtcaacatcgagaccgagccgcccttcggggagagctacatcgtgatcggcgccggcgagaaggcgctcaagctgtcctggttcaagaaggggagctccatcggcaagatgttcgaggccaccgcccgcggggcccggcgcatggccatcctgggcgacacggcgtgggacttcgggagcatcggcggcgtgttcacctccgtcgggaagctcgtgcaccaggtgttcggcaccgcctacggggtcctgttcagcggcgtgtcctggaccatgaagatcgggatcggcatcctgctcacgtggctgggcctgaacagccgctccaccagcctctccatgacctgcatcgccgtggggatggtcaccctgtacctgggcgtgatggtgcaggccgacagcgggtgcgtcatcaactggaagggccgggagctcaagtgcgggtccggcatcttcgtgacgaacgaggtgcacacctggaccgagcagtacaagttccaggccgacagcccgaagcgcctgagcgcggccatcggcaaggcctgggaggagggggtctgcggcatccggtccgccacccgcctggagaacatcatgtggaagcagatcagcaacgagctcaaccacatcctgctggagaacgacatgaagttcaccgtggtggtcggggacgcctacggcatcctcacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtggaggactacggcttcggggtgttcaccaccaacatctggctgaagctgcgggactcctacacccagatgtgcgaccaccgcctcatgagcgccgcgatcaaggactccaaggccgtccacgccgacatgggctactggatcgagagcgagaagaacgagacgtggaagctggcccgggcctccttcatcgaggtgaagacctgcatctggccccgcagccacaccctgtggtccaacggcgtgctcgagagcgagatgatcatccccaagatctacgggggcccgatctcccagcacaactaccggcccgggtacttcacccagacggcgggcccctggcacctggggaagctggagctcgacttcaacctgtgcgagggcaccaccgtcgtggtggacgagcactgcggcaaccgcgggccgagcctgcggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctggtgcgcagcatggtctccgccggcagcggcgaggtggacagcttctccctcgggctgctgtgcgtgagcatcatgatcgaggaggtcatgcggtcccgctggagccgcaagatgctcatgacgggcaccctggccgtgttcttcctgctcatcatggggcagctgacctggaacgacctgatccggctctgcatcatggtgggcgccaacgtctccgaccgcatggggatgggcaccacgtacctggccctgatggcgaccttcaagatgcggccgatgttcgccgtgggcctcctgttccgccggctgaccagccgcgaggtcctcctgctgaccatcgggctctccctggtggccagcgtggagctgcccaactccctcgaggagctgggcgacgggctggccatgggcatcatgatgctcaagctgctgacggacttccagagccaccagctctggaccaccctgctgtccctcaccttcatcaagacgaccctgagcctggactacgcctggaagaccatggcgatggtcctctccatcgtgagcctgttccccctgtgcctctccaccacgagccagaagaccacctggctgcccgtgctgctcggctccttcgggtgcaagccgctgaccatgttcctgatcaccgagaacaagatctggggccgcaagagctggcccctcaacgaggggatcatggccgtcggcatcgtgtccatcctgctgagcagcctcctgaagaacgacgtgcccctggccgggcccctcatcgccggcggcatgctgatcgcgtgctacgtcatctccgggagctccgccgacctgagcctcgagcgcgccgccgaggtgtcctgggaggaggaggccgagcacagcggcgcgtcccacaacatcctggtggaggtccaggacgacgggacgatgaagatcaaggacgaggagcgggacgacaccctgaccatcctcctgaaggccaccctgctcgccgtgagcggcgtgtacccgatgtccatccccgccacgctgttcgtctggtacttctggcagaagaagaagcagcgcagcggggtgctgtgggacacccccagcccgcccgaggtggagcgggccgtcctcgacgacggcatctaccgcatcctgcagcggggcctgctggggcgcagccaggtgggcgtgggggtcttccaggacggcgtgttccacaccatgtggcacgtgacccgcggggcggtcctcatgtaccagggcaagcgcctggagccctcctgggccagcgtgaagaaggacctgatctcctacggcgggggctggcggttccaggggagctggaacacgggcgaggaggtgcaggtcatcgccgtggagcccgggaagaaccccaagaacgtgcagaccacccccggcaccttcaagacgcccgagggcgaggtcggggccatcgccctcgacttcaagcccggcacctccgggagccccatcgtgaaccgcgagggcaagatcgtgggcctgtacgggaacggcgtcgtgaccacctccgggacgtacgtgagcgcgatcgcccaggccaaggccagccaggagggcccgctgcccgagatcgaggacgaggtcttcaagaagcggaacctcaccatcatggacctgcaccccgggtccggcaagacccgccggtacctgccggccatcgtgcgcgaggcgatcaagcgcaagctccggaccctgatcctggcccccacgcgcgtggtcgccagcgagatggccgaggcgctcaagggcatgcccatccggtaccagaccaccgccgtgaagtccgagcacaccgggaaggagatcgtggacctgatgtgccacgccacgttcaccatgcgcctgctcagccccgtccgggtgccgaactacaacatgatcatcatggacgaggcccacttcaccgaccccgcctccatcgcggcccgcggctacatcagcacccgggtggggatgggcgaggccgccgccatcttcatgacggcgacgccgcccgggtccgtcgaggccttcccgcagagcaacgccgtgatccaggacgaggagcgcgacatccccgagcggtcctggaacagcggctacgactggatcaccgacttccccggcaagaccgtgtggttcgtcccctccatcaagagcgggaacgacatcgccaactgcctgcgcaagaacggcaagcgggtgatccagctgtcccgcaagacgttcgacaccgagtaccagaagaccaagaacaacgactgggactacgtggtcaccacggacatcagcgagatgggggccaacttccgggcggaccgcgtgatcgacccgcggcgctgcctcaagcccgtcatcctgaaggacggccccgagcgggtgatcctggccgggcccatgccggtgaccgccgcctccgcggcccagcgccggggccgcatcggccgcaaccagaacaaggagggggaccagtacatctacatgggccagcccctcaacaacgacgaggaccacgcccactggaccgaggccaagatgctgctggacaacatcaacacccccgaggggatcatccccgccctcttcgagccggagcgggagaagtccgcggccatcgacggcgagtaccgcctgcgcggggaggcccgcaagacgttcgtcgagctgatgcggcgcggcgacctccccgtgtggctgtcctacaaggtggccagcgagggcttccagtactccgaccggcgctggtgcttcgacggggagcggaacaaccaggtcctggaggagaacatggacgtggagatctggaccaaggagggcgagcgcaagaagctccggccccgctggctggacgcccggacctacagcgaccccctggcgctccgcgagttcaaggagttcgccgccgggcggcgcagcgtgtccggcgacctgatcctggagatcggcaagctcccgcagcacctgaccctgcgggcccagaacgccctcgacaacctggtcatgctgcacaacagcgagcagggcgggaaggcgtaccgccacgccatggaggagctccccgacaccatcgagacgctgatgctgctcgccctgatcgccgtgctgaccgggggcgtgaccctcttcttcctgtccgggaagggcctgggcaagaccagcatcgggctcctgtgcgtcatggcgtccagcgtgctgctctggatggcctccgtggagccccactggatcgccgccagcatcatcctggagttcttcctgatggtcctcctgatccccgagccggaccggcagcgcacgccccaggacaaccagctggcctacgtggtgatcggcctcctgttcatgatcctgaccgtcgcggccaacgagatggggctcctggagaccaccaagaaggacctgggcatcgggcacgtggtggccgagaaccaccaccacgccacgatgctcgacatcgacctgcaccccgcctccgcgtggaccctgtacgccgtcgccaccaccatcatcacgccgatgatgcggcacaccatcgagaacaccaccgccaacatcagcctcacggccatcgcgaaccaggccgccatcctgatgggcctggacaagggctggcccatctccaagatggacatcggggtgcccctcctggccctgggctgctacagccaggtgaaccccctcaccctgaccgccgcggtcctgatgctcgtggcccactacgccatcatcgggccgggcctgcaggccaaggcgacccgcgaggcccagaagcgcacggccgccgggatcatgaagaaccccaccgtggacggcatcgtcgccatcgacctggaccccgtggtgtacgacgcgaagttcgagaagcagctcggccagatcatgctgctgatcctctgcacctcccagatcctgctgatgcggaccacgtgggccctctgcgagagcatcaccctggccaccgggcccctgaccacgctctgggagggctccccggggcgcttctggaacaccaccatcgccgtcagcatggccaacatcttccggggctcctacctggcgggcgccgggctggccttcagcctcatgaagtccctgggcgggggccgccgggggaccggcgcccagggcgagacgctgggggagaagtggaagcgccagctcaaccagctgagcaagagcgagttcaacacctacaagcggtccggcatcatggaggtggaccgcagcgaggccaaggaggggatgaagcggggcgagaccaccaagcacgcggtgtcccgcgggacggccaagctgcggtggttcgtcgagcgcaacctcgtgaagcccgagggcaaggtgatcgacctgggctgcgggcggggcgggtggagctactactgcgccggcctgaagaaggtcaccgaggtgaaggggtacaccaagggcggccccgggcacgaggagcccatcccgatggccacctacggctggaacatcgtgaagctgcactccgggcgcgacgtcttcttcacgccgcccgagaagtgcgacacgctcctgtgcgacatcggcgagagctcccccaacccgaccatcgaggaggggcggaccctgcgcgtgctcaagatggtggagccctggctgcggggcaaccagttctgcatcaagatcctgaacccctacatgcccagcgtcgtggagaccctcgagcagatgcagcgcaagcacggcgggatgctggtgcggaacccgctgtcccgcaacagcacgcacgagatgtactgggtctcctgcggcaccgggaacatcgtgagcgcggtgaacatgacctcccgcatgctcctgaaccggttcaccatggcccaccgcaagcccacgtacgagcgggacgtcgacctgggcgccggcacccgccacgtggccgtggagcccgagatcgccaacctcgacatcatcgggcagcggatcgagaacatcaagaacgagcacaagagcacctggcactacgacgaggacaacccctacaagacctgggcgtaccacggctcctacgaggtcaagccgagcgggtccgccagctccatggtgaacggcgtcgtgcgcctgctgacgaagccctgggacgtgatccccatggtcacccagatcgccatgaccgacaccacgcccttcgggcagcagcgggtgttcaaggagaaggtggacacccgcaccccgcggcccaagcgcggcaccgcccagatcatggaggtcacggccaagtggctctggggcttcctgagccggaacaagaagccccgcatctgcacccgggaggagttcacccgcaaggtgcggagcaacgcggccatcggggccgtgttcgtcgacgagaaccagtggaactccgccaaggaggccgtggaggacgagcgcttctgggacctggtgcaccgggagcgcgagctccacaagcagggcaagtgcgcgacctgcgtctacaacatgatggggaagcgggagaagaagctgggcgagttcgggaaggccaagggcagccgcgccatctggtacatgtggctgggcgcccggttcctcgagttcgaggcgctggggttcatgaacgaggaccactggttctcccgcgagaacagcctgtccggcgtggagggggagggcctccacaagctggggtacatcctgcgcgacatcagcaagatcccgggcggcaacatgtacgccgacgacacggccgggtgggacacccggatcaccgaggacgacctccagaacgaggccaagatcaccgacatcatggagcccgagcacgccctgctggcgacgtccatcttcaagctcacctaccagaacaaggtggtccgcgtgcagcggcccgccaagagcggcaccgtgatggacgtcatctcccgccgggaccagcgcgggagcggccaggtgggcacctacgggctgaacacgttcaccaacatggaggtgcagctgatccggcagatggagtccgagggcatcttcagcccctccgagctcgagaacagcaacctggccgagcgcgtcctggactggctcgagaagcacggggtggagcggctgaagcgcatggccatctccggcgacgactgcgtggtcaagccgaccgacgaccggttcgccaccgcgctgacggccctcaacgacatggggaaggtgcgcaaggacatcccccagtgggagcccagcaagggctggaacgactggcagcaggtccccttctgctcccaccacttccaccagctgatcatgaaggacggccgggagatcgtcgtgccgtgccgcaaccaggacgagctggtggggcgggcccgcgtcagccagggcgccgggtggagcctccgggagaccgcctgcctgggcaagtcctacgcgcagatgtggcagctgatgtacttccaccgccgggacctccgcctggccgccaacgccatctgcagcgccgtgcccgtgaactgggtccccacctcccgcaccacctggagcatccacgcgcaccaccagtggatgacgaccgaggacatgctgtccgtgtggaaccgggtgtggatcgaggagaacccctggatggaggacaagacccacgtcagctcctgggaggacgtgccgtacctcgggaagcgcgaggaccagtggtgcggcagcctgatcggcctgaccgcccgggccacgtgggccaccaacatccaggtggcgatcaaccaggtccgccggctcatcgggaacgagaactacctggactacatgacctccatgaagcgcttcaagaacgagagcgaccccgagggcgccctgtggtga

SEQ ID NO: 8944 - RNA, 9879 nt, synthetic construct
  misc_feature 1..9879: note = derived and/or modified CDS sequence (opt1) from DENV-1__KM403602__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctcttcaagacctccgcgggggtgaacatgtgcaccctgatcgccatggacctgggcgagctctgcgaggacacgatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccatcaccctcgactgcagcccccgcaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctgatcacggccaacccgatcgtgaccgacaaggagaagcccgtgaacatcgagaccgagccgcccttcggggagagctacatcgtcatcggcgccggcgagaaggcgctcaagctgtcctggttcaagaaggggagctccatcggcaagatgttcgaggccaccgcccgcggggcccggcgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccgctccaccagcctctccatgacctgcatcgccgtggggatggtgaccctgtacctgggcgtcatggtgcaggccgacagcgggtgcgtgatcaactggaagggccgggagctcaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctggagaacatcatgtggaagcagatcagctccgagctcaaccacatcctgctggagaacgacatgaagttcaccgtcgtggtgggggacgccaacggcatcctcacgcaggggaagaagatgatccggccccagcccatggagcacaagtacagctggaagtcctggggcaaggcgaagatcatcggcgccgacacccagaacaccaccttcatcatcgacgggcccgacacgccggagtgccccgacgaccagcgcgcctggaacatctgggaggtcgaggactacggcttcggggtgttcaccaccaacatctggctgaagctgcgggacagctacacccagatgtgcgaccaccgcctcatgtccgccgcgatcaaggacagcaaggccgtgcacgccgacatgggctactggatcgagtccgagaagaacgagacgtggaagctggcccgggccagcttcatcgaggtcaagacctgcatctggccccgctcccacaccctgtggagcaacggcgtgctcgagtccgagatgatcatccccaagatctacgggggcccgatcagccagcacaactaccggcccgggtacttcacccagacggcgggcccctggcacctggggaagctggagctcgacttcaacctgtgcgagggcaccaccgtggtcgtggacgagcactgcggcaaccgcgggccgtccctgcggaccacgaccgtgaccggcaagatcatccacgagtggtgctgccgcagctgcaccctgccgcccctgcggttccgcggggaggacggctgctggtacgggatggagatccggcccgtcaaggagaaggaggagaacctggtgcgctccatggtgagcgccggcagcggcgaggtcgactccttcagcctcgggctgctgtgcgtgtccatcatgatcgaggaggtgatgcggagccgctggtccaagaagatgctcatgacgggcaccctggccgtcttcttcctgctcatcatggggcagctgacctggaacgacctgatccgcctctgcatcatggtgggcgccaacgtgagcgaccggatggggatgggcaccacgtacctggccctgatggcgaccttcaagatgcgcccgatgttcgccgtcgggctcctgttccggcgcctgacctcccgggaggtgctcctgctgaccatcgggctcagcctggtcgcctccgtggagctgcccaacagcctcgaggagctgggcgacgggctggccatgggcatcatgatgctcaagctgctgacggacttccagtcccaccagctctggaccaccctgctgagcctcaccttcatcaagacgaccctgtccctggactacgcctggaagaccatggcgatggtgctcagcatcgtctccctgttccccctgtgcctcagcaccacgtcccagaagaccacctggctgcccgtgctgctcggcagcttcgggtgcaagccgctgaccatgttcctgatcaccgagaacaagatctggggccgcaagtcctggcccctcaacgaggggatcatggccgtgggcatcgtcagcatcctgctgagctccctcctgaagaacgacgtgcccctggccgggcccctcatcgccggcggcatgctgatcgcgtgctacgtgatcagcgggtccagcgccgacctgtccctcgagcgggccgccgaggtcagctgggaggaggaggccgagcactccggcgcgagccacaacatcctggtggaggtgcaggacgacgggacgatgaagatcaaggacgaggagcgcgacgacaccctgaccatcctcctgaaggccaccctgctcgccgtctccggcgtgtacccgatgagcatccccgccacgctgttcgtgtggtacttctggcagaagaagaagcagcggtccggggtcctgtgggacacccccagcccgcccgaggtggagcgcgccgtgctcgacgacggcatctaccggatcctgcagcgcggcctgctggggcggtcccaggtcggcgtgggggtgttccaggacggcgtcttccacaccatgtggcacgtgacccgcggggcggtgctcatgtaccagggcaagcggctggagcccagctgggcctccgtcaagaaggacctgatcagctacggcgggggctggcgcttccaggggtcctggaacacgggcgaggaggtccaggtgatcgccgtcgagcccgggaagaaccccaagaacgtgcagaccacccccggcaccttcaagacgcccgagggcgaggtgggggccatcgccctcgacttcaagcccggcaccagcgggtcccccatcgtcaaccgggagggcaagatcgtgggcctgtacgggaacggcgtggtcaccaccagcgggacgtacgtgagcgcgatcgcccaggccaaggcctcccaggagggcccgctgcccgagatcgaggacgaggtgttcaagaagcgcaacctcaccatcatggacctgcaccccgggagcggcaagacccggcgctacctgccggccatcgtccgggaggcgatcaagcgcaagctccgcaccctgatcctggcccccacgcgggtggtggcctccgagatggccgaggcgctcaagggcatgcccatccgctaccagaccaccgccgtcaagagcgagcacaccgggaaggagatcgtggacctgatgtgccacgccacgttcaccatgcggctgctctcccccgtgcgcgtcccgaactacaacatgatcatcatggacgaggcccacttcaccgaccccgccagcatcgcggcccggggctacatctccacccgcgtggggatgggcgaggccgccgccatcttcatgacggcgacgccgcccgggagcgtggaggccttcccgcagtccaacgccgtcatccaggacgaggagcgggacatccccgagcgcagctggaactccggctacgactggatcaccgacttccccggcaagaccgtgtggttcgtgcccagcatcaagtccgggaacgacatcgccaactgcctgcggaagaacggcaagcgcgtcatccagctgagccggaagacgttcgacaccgagtaccagaagaccaagaacaacgactgggactacgtggtgaccacggacatctccgagatgggggccaacttccgcgcggaccgggtcatcgacccgcgccggtgcctcaagcccgtgatcctgaaggacggccccgagcgcgtcatcctggccgggcccatgccggtgaccgccgccagcgcggcccagcggcgcggccggatcggccgcaaccagaacaaggagggggaccagtacatctacatgggccagcccctcaacaacgacgaggaccacgcccactggaccgaggccaagatgctgctggacaacatcaacacccccgaggggatcatccccgccctcttcgagccggagcgcgagaagtccgcggccatcgacggcgagtaccggctgcgcggggaggcccggaagacgttcgtggagctgatgcgccggggcgacctccccgtctggctgagctacaaggtggcctccgagggcttccagtacagcgaccgccggtggtgcttcgacggggagcgcaacaaccaggtgctggaggagaacatggacgtcgagatctggaccaaggagggcgagcggaagaagctccgcccccggtggctggacgcccgcacctacagcgaccccctggcgctccgggagttcaaggagttcgccgccgggcgccggtccgtgagcggcgacctgatcctggagatcggcaagctcccgcagcacctgaccctgcgcgcccagaacgccctcgacaacctggtgatgctgcacaactccgagcagggcgggaaggcgtaccggcacgccatggaggagctccccgacaccatcgagacgctgatgctgctcgccctgatcgccgtcctgaccgggggcgtgaccctcttcttcctgagcgggaagggcctgggcaagacctccatcgggctcctgtgcgtgatggcgagctccgtcctgctctggatggccagcgtggagccccactggatcgccgcctccatcatcctggagttcttcctgatggtgctcctgatccccgagccggaccgccagcggacgccccaggacaaccagctggcctacgtcgtgatcggcctcctgttcatgatcctgaccgtggcggccaacgagatggggctcctggagaccaccaagaaggacctgggcatcgggcacgtcgtggccgagaaccaccaccacgccacgatgctcgacatcgacctgcaccccgccagcgcgtggaccctgtacgccgtggccaccaccatcatcacgccgatgatgcgccacaccatcgagaacaccaccgccaacatctccctcacggccatcgcgaaccaggccgccatcctgatgggcctggacaagggctggcccatcagcaagatggacatcggggtccccctcctggccctgggctgctactcccaggtgaaccccctcaccctgaccgccgcggtgctgatgctcgtcgcccactacgccatcatcgggccgggcctgcaggccaaggcgacccgggaggcccagaagcgcacggccgccgggatcatgaagaaccccaccgtggacggcatcgtggccatcgacctggaccccgtcgtgtacgacgcgaagttcgagaagcagctcggccagatcatgctgctgatcctctgcaccagccagatcctgctgatgcgcaccacgtgggccctctgcgagtccatcaccctggccaccgggcccctgaccacgctctgggagggcagcccggggaagttctggaacaccaccatcgccgtgtccatggccaacatcttccggggcagctacctggcgggcgccgggctggccttctccctcatgaagtccctgggcgggggccgccgggggaccggcgcccagggcgagacgctgggggagaagtggaagcgccagctcaaccagctgagcaagtccgagttcaacacctacaagcggagcggcatcatggaggtcgaccgctccgaggccaaggaggggctgaagcggggcgagaccaccaagcacgcggtgagccgcgggacggccaagctccggtggttcgtggagcgcaacctggtcaagcccgagggcaaggtgatcgacctgggctgcgggcggggcgggtggtcctactactgcgccggcctgaagaaggtgaccgaggtcaaggggtacaccaagggcggccccgggcacgaggagcccatcccgatggccacctacggctggaacatcgtgaagctccacagcgggcgcgacgtgttcttcacgccgcccgagaagtgcgacacgctgctgtgcgacatcggcgagtccagccccaacccgaccatcgaggaggggcggaccctccgcgtcctgaagatggtggagccctggctgcggggcaaccagttctgcatcaagatcctcaacccctacatgccctccgtggtcgagaccctggagcagatgcagcgcaagcacggcgggatgctggtgcggaacccgctcagccgcaactccacgcacgagatgtactgggtgagctgcggcaccgggaacatcgtctccgcggtgaacatgaccagccggatgctgctgaaccgcttcaccatggcccaccgcaagcccacgtacgagcgggacgtggacctcggcgccggcacccgccacgtcgccgtggagcccgagatcgccaacctggacatcatcgggcagcggatcgagaacatcaagaacgagcacaagtccacctggcactacgacgaggacaacccctacaagacctgggcgtaccacggcagctacgaggtgaagccgtccgggagcgcctccagcatggtcaacggcgtggtccgcctgctcacgaagccctgggacgtgatccccatggtgacccagatcgccatgaccgacaccacgcccttcgggcagcagcgggtcttcaaggagaaggtggacacccgcaccccgcggcccaagcgcggcaccgcccagatcatggaggtgacggccaagtggctgtggggcttcctgagccggaacaagaagccccgcatctgcacccgggaggagttcacccgcaaggtccggtccaacgcggccatcggggccgtgttcgtggacgagaaccagtggaacagcgccaaggaggccgtcgaggacgagcgcttctgggacctcgtgcaccgggagcgcgagctgcacaagcagggcaagtgcgcgacctgcgtgtacaacatgatggggaagcgggagaagaagctgggcgagttcgggaaggccaagggctcccgcgccatctggtacatgtggctcggcgcccggttcctggagttcgaggcgctggggttcatgaacgaggaccactggttcagccgcgagaactccctcagcggcgtcgagggggagggcctgcacaagctggggtacatcctccgggacatctccaagatcccgggcggcaacatgtacgccgacgacacggccgggtgggacacccgcatcaccgaggacgacctgcagaacgaggccaagatcaccgacatcatggagcccgagcacgccctgctcgcgacgagcatcttcaagctgacctaccagaacaaggtggtgcgcgtccagcggcccgccaagtccggcaccgtgatggacgtgatcagccgccgggaccagcgcgggtccggccaggtcggcacctacgggctgaacacgttcaccaacatggaggtgcagctcatccggcagatggagagcgagggcatcttctcccccagcgagctggagaactccaacctggccgagcgcgtgctcgactggctggagaagcacggggtcgagcggctgaagcgcatggccatcagcggcgacgactgcgtggtgaagccgaccgacgaccggttcgccaccgcgctcacggccctgaacgacatggggaaggtccgcaaggacatcccccagtgggagccctccaagggctggaacgactggcagcaggtccccttctgcagccaccacttccaccagctgatcatgaaggacggccgggagatcgtggtcccgtgccgcaaccaggacgagctcgtggggcgggcccgcgtgagccagggcgccgggtggtccctgcgggagaccgcctgcctgggcaagagctacgcgcagatgtggcagctcatgtacttccaccgccgggacctgcgcctggccgccaacgccatctgctccgccgtccccgtgaactgggtgcccaccagccggaccacctggtccatccacgcgcaccaccagtggatgacgaccgaggacatgctcagcgtctggaaccgcgtgtggatcgaggagaacccctggatggaggacaagacccacgtgtccagctgggaggacgtcccgtacctggggaagcgcgaggaccagtggtgcggctccctgatcggcctcaccgcccgggccacgtgggccaccaacatccaggtggcgatcaaccaggtgcgccggctgatcgggaacgagaactacctggactacatgaccagcatgaagcgcttcaagaacgagtccgaccccgagggcgccctctggtga

SEQ ID NO: 8945 - RNA, 9879 nt, synthetic construct
  misc_feature 1..9879: note = derived and/or modified CDS sequence (opt1) from DENV-1__KM403582__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgccggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgaccggcgctccgtggccctggcgccccacgtgggcctggggctcgagacgcggaccgagacctggatgagctccgagggcgcctggcgccagatccagcgggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccgccggatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccaccacccgcctcgagaacatcatgtggaagcagatcagcaacgagctgaaccacatcctgctcgagaacgacatgaagttcacggtcgtggtgggggacgccaacggcatcctgacccaggggaagaagatgatccggccccagcccatggagcacaagtactcctggaagtcctggggcaaggccaagatcatcggcgcggacacccagaacaccacgttcatcatcgacgggcccgacaccccggagtgccccgacgaccagcgcgcctggaacatctgggaggtcgaggactacggcttcggggtgttcaccaccaacatctggctgaagctccgggactcctacacgcagatgtgcgaccaccgcctgatgagcgccgccatcaaggactccaaggcggtgcacgccgacatgggctactggatcgagagcgagaagaacgagacctggaagctggcccgggcctccttcatcgaggtcaagacctgcatctggccccgcagccacaccctctggtccaacggcgtgctggagagcgagatggtgatccccaagatctacgggggcccgatctcccagcacaactaccggcccgggtacttcacgcagaccgccggcccctggcacctggggaagctcgagctggacttcaacctgtgcgagggcaccaccgtcgtggtggacgagcactgcggcaaccgcgggccgagcctccggacgaccaccgtcaccggcaagatcatccacgagtggtgctgccgctcctgcacgctgccgcccctgcggttccgcggggaggacggctgctggtacgggatggagatccggcccgtgaaggagaaggaggagaacctcgtgcgcagcatggtctccgcgggcagcggcgaggtggacagcttctccctggggctgctctgcgtgagcatcatgatcgaggaggtcatgcgctcccggtggagccgcaagatgctgatgaccggcaccctggccatcttcttcctcctgatcatggggcagctgacctggaacgacctcatccggctgtgcatcatggtgggcgccaacgtgtccgaccgcatggggatgggcacgacctacctggccctcatggccaccttcaagatgcggccgatgttcgcggtcgggctgctgttccgccggctcaccagccgcgaggtgctgctgctcacgatcgggctgtccctggtcgccagcgtggagctccccaactccctggaggagctgggcgacgggctcgccatgggcatcatgatgctgaagctgctcaccgacttccagagccaccagctgtggaccaccctgctctccctgacgttcatcaagaccaccctgagcctcgactacgcctggaagaccatggccatggtgctgtccatcgtcagcctgttccccctctgcctgtccacgaccagccagaagaccacctggctgcccgtgctcctgggctccttcgggtgcaagccgctgaccatgttcctcatcacggagaacaagatctggggccgcaagagctggcccctgaacgaggggatcatggcggtgggcatcgtctccatcctgctcagcagcctgctgaagaacgacgtgcccctcgccgggcccctgatcgccggcggcatgctgatcgcctgctacgtgatctccgggagctccgcggacctcagcctggagcgcgccgccgaggtctcctgggaggaggaggccgagcacagcggcgcctcccacaacatcctggtggaggtgcaggacgacgggaccatgaagatcaaggacgaggagcgggacgacaccctcaccatcctgctgaaggcgacgctcctggccgtcagcggcgtgtacccgatgtccatccccgccaccctgttcgtgtggtacttctggcagaagaagaagcagcgcagcggggtcctctgggacacccccagcccgcccgaggtggagcgggccgtgctggacgacggcatctaccgcatcctgcagcggggcctgctcgggcgcagccaggtcggcgtgggggtgttccaggacggcgtcttccacaccatgtggcacgtgacgcgcggggccgtgctgatgtaccagggcaagcgcctggagccctcctgggcgagcgtcaagaaggacctcatctcctacggcgggggctggcggttccaggggagctggaacaccggcgaggaggtccaggtgatcgccgtcgagcccgggaagaaccccaagaacgtgcagaccacccccggcacgttcaagacccccgagggcgaggtgggggccatcgccctggacttcaagcccggcacctccgggagccccatcgtcaaccgcgagggcaagatcgtgggcctgtacgggaacggcgtggtcaccacgtccgggacctacgtgagcgccatcgcgcaggccaaggccagccaggagggcccgctccccgagatcgaggacgaggtgttcaagaagcggaacctgaccatcatggacctgcaccccgggtccggcaagacccgccgctacctcccggccatcgtccgggaggccatcaagcgcaagctgcggacgctgatcctcgcgcccacccgcgtggtggccagcgagatggccgaggccctgaagggcatgcccatccggtaccagaccaccgcggtcaagtccgagcacacggggaaggagatcgtggacctgatgtgccacgccaccttcaccatgcgcctcctgagccccgtgcgggtcccgaactacaacatgatcatcatggacgaggcccacttcaccgaccccgcctccatcgccgcgcgcggctacatcagcacgcgggtggggatgggcgaggccgccgccatcttcatgaccgccacgccgcccgggtccgtggaggcgttcccgcagagcaacgccgtcatccaggacgaggagcgcgacatccccgagcggtcctggaacagcggctacgactggatcaccgacttccccggcaagacggtgtggttcgtgccctccatcaagagcgggaacgacatcgccaactgcctgcgcaagaacggcaagcgggtcatccagctctcccgcaagaccttcgacaccgagtaccagaagaccaagaacaacgactgggactacgtggtgacgaccgacatcagcgagatgggggccaacttccgggccgaccgcgtcatcgacccgcggcgctgcctgaagcccgtgatcctgaaggacggccccgagcgggtcatcctcgcggggcccatgccggtgaccgccgcctccgccgcgcagcgccgcggccggatcggccgcaaccagaacaaggagggggaccagtacatctacatgggccagcccctgaacaacgacgaggaccacgcccactggaccgaggccaagatgctgctcgacaacatcaacacgcccgaggggatcatccccgccctgttcgagccggagcgggagaagtccgccgcgatcgacggcgagtaccgcctgcgcggggaggcccgcaagaccttcgtggagctcatgcggcgcggcgacctgcccgtctggctgtcctacaaggtggccagcgagggcttccagtactccgaccggcgctggtgcttcgacggggagcggaacaaccaggtgctcgaggagaacatggacgtcgagatctggaccaaggagggcgagcgcaagaagctgcggccccgctggctggacgcccggacctacagcgaccccctcgccctgcgcgagttcaaggagttcgcggccgggcggcgcagcgtgtccggcgacctgatcctcgagatcggcaagctgccgcagcacctgaccctccgggcccagaacgccctggacaacctggtgatgctccacaacagcgagcagggcgggaaggcctaccgccacgcgatggaggagctgcccgacacgatcgagaccctgatgctcctggccctgatcgccgtcctcaccgggggcgtgaccctgttcttcctgtccgggaagggcctcggcaagacgagcatcgggctgctgtgcgtgatggcctccagcgtcctcctgtggatggcgtccgtggagccccactggatcgccgccagcatcatcctggagttcttcctcatggtgctgctgatccccgagccggaccggcagcgcacgccccaggacaaccagctcgcctacgtcgtgatcggcctgctgttcatgatcctcaccgtggccgcgaacgagatggggctgctggagaccacgaagaaggacctcggcatcgggcacgtcgtggccgagaaccaccaccacgccaccatgctggacatcgacctgcaccccgcctccgcctggaccctctacgcggtggccaccacgatcatcaccccgatgatgcgccacaccatcgagaacaccacggccaacatcagcctgaccgccatcgccaaccaggcggccatcctgatgggcctcgacaagggctggcccatctccaagatggacatcggggtccccctgctggccctcggctgctacagccaggtgaaccccctgaccctgaccgccgccgtgctcatgctggtcgcgcactacgccatcatcgggccgggcctgcaggccaaggccacgcgggaggcgcagaagcgcaccgccgccgggatcatgaagaaccccaccgtggacggcatcgtggccatcgacctcgaccccgtcgtgtacgacgccaagttcgagaagcagctgggccagatcatgctgctcatcctgtgcacctcccagatcctgctcatgcggacgacctgggcgctgtgcgagagcatcaccctggccaccgggcccctcacgaccctgtgggagggctccccggggaagttctggaacaccaccatcgccgtgagcatggccaacatcttccgcggctcctacctggccggcgcggggctcgccttcagcctgatgaagtccctgggcgggggccggcgcgggacgggcgcccagggcgagaccctcggggagaagtggaagcggcagctgaaccagctgagcaagagcgagttcaacacctacaagcgctccggcatcatggaggtcgaccggagcgaggccaaggaggggctcaagcgcggcgagaccacgaagcacgccgtgtcccgggggaccgcgaagctgcgctggttcgtggagcggaacctggtcaagcccgagggcaaggtgatcgacctgggctgcgggcgcggcgggtggagctactactgcgccggcctcaagaaggtgaccgaggtcaaggggtacaccaagggcggccccgggcacgaggagcccatcccgatggccacctacggctggaacatcgtgaagctgcactccgggcgggacgtgttcttcacgccgcccgagaagtgcgacaccctgctctgcgacatcggcgagagctcccccaacccgaccatcgaggaggggcgcaccctgcgggtcctgaagatggtggagccctggctccgcggcaaccagttctgcatcaagatcctgaacccctacatgcccagcgtggtcgagacgctggagcagatgcagcggaagcacggcgggatgctcgtgcgcaacccgctgtcccgcaacagcacccacgagatgtactgggtgtcctgcggcaccgggaacatcgtcagcgccgtgaacatgacctcccggatgctgctcaaccgcttcacgatggcgcaccggaagcccacctacgagcgcgacgtggacctgggcgccggcacccggcacgtcgccgtggagcccgagaccgccaacctggacatcatcgggcagcgcatcgagaacatcaagaacgagcacaagagcacgtggcactacgacgaggacaacccctacaagacctgggcctaccacggctcctacgaggtgaagccgagcgggtccgcgagctccatggtcaacggcgtggtccggctcctgaccaagccctgggacgtgatccccatggtgacccagatcgccatgacggacaccacccccttcgggcagcagcgcgtcttcaaggagaaggtggacacccggacgccgcgccccaagcggggcaccgcccagatcatggaggtgaccgccaagtggctgtggggcttcctcagccgcaacaagaagccccggatctgcacccgcgaggagttcacgcggaaggtccgcagcaacgccgcgatcggggccgtgttcgtggacgagaaccagtggaactccgccaaggaggccgtcgaggacgagcggttctgggacctggtgcaccgcgagcgggagctgcacaagcagggcaagtgcgcgacctgcgtgtacaacatgatggggaagcgcgagaagaagctcggcgagttcgggaaggcgaagggcagccgggccatctggtacatgtggctgggcgcccgcttcctggagttcgaggccctcgggttcatgaacgaggaccactggttctcccgcgagaacagcctgtccggcgtcgagggggagggcctgcacaagctcgggtacatcctgcgggacatcagcaagatcccgggcggcaacatgtacgcggacgacaccgccgggtgggacacccgcatcacggaggacgacctgcagaacgaggccaagatcaccgacatcatggagcccgagcacgccctcctggccacctccatcttcaagctgacctaccagaacaaggtggtgcgggtccagcgccccgccaagagcggcacggtgatggacgtgatctcccggcgcgaccagcgggggagcggccaggtcggcacctacgggctcaacaccttcaccaacatggaggtgcagctgatccgccagatggagtccgagggcatcttcagcccctccgagctggagaacagcaacctcgcggagcgggtgctggactggctggagaagcacggggtcgagcgcctcaagcggatggccatctccggcgacgactgcgtggtgaagccgacggacgaccgcttcgccaccgccctgaccgcgctgaacgacatggggaaggtccggaaggacatcccccagtgggagcccagcaagggctggaacgactggcagcaggtccccttctgctcccaccacttccaccagctcatcatgaaggacggccgcgagatcgtggtcccgtgccggaaccaggacgagctggtggggcgcgcccgggtgagccagggcgccgggtggagcctgcgcgagaccgcctgcctcggcaagtcctacgcccagatgtggcagctgatgtacttccaccggcgcgacctgcgcctcgcggccaacgccatctgcagcgccgtccccgtgaactgggtgcccacctcccggacgacctggagcatccacgcccaccaccagtggatgaccaccgaggacatgctgtccgtctggaaccgcgtgtggatcgaggagaacccctggatggaggacaagacgcacgtgagctcctgggaggacgtcccgtacctggggaagcgggaggaccagtggtgcggcagcctcatcggcctgaccgcgcgcgccacctgggccaccaacatccaggtggccatcaaccaggtgcggcgcctgatcgggaacgagaactacctcgactacatgacgtccatgaagcggttcaagaacgagagcgaccccgagggcgcgctgtggtga

SEQ ID NO: 8946 - RNA, 9879 nt, synthetic construct
  misc_feature 1..9879: note = derived and/or modified CDS sequence (opt1) from DENV-1__KM403577__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtggagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgccccacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctgatcacggccaacccgatcgtgaccgacaaggagaagcccgtgaacatcgagaccgagccgcccttcggggagagctacatcgtcatcggcgccggcgagaaggcgctcaagctgtcctggttcaagaaggggagctccatcggcaagatgttcgaggccaccgcccgcggggcccggcgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccgctccaccagcctctccatgacctgcatcgccgtggggatggtgaccctgtacctgggcgtcatggtgcaggccgacagcgggtgcgtgatcaactggaagggccgggagctcaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctggagaacatcatgtggaagcagatcagcaacgagctcaaccacatcctgctggagaacgacatgaagttcaccgtcgtggtgggggacgccaacggcatcctcacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtcgaggactacggcttcggggtgttcaccaccaacatctggctgaagctgcgggactcctacacccagatgtgcgaccaccgcctcatgagcgccgcgatcaaggactccaaggccgtgcacgccgacatgggctactggatcgagagcgagaagaacgagacgtggaagctggcccgggcctccttcatcgaggtcaagacctgcatctggccccgcagccacaccctgtggtccaacggcgtgctcgagagcgagatgatcatccccaagatctacgggggcccgatctcccagcacaactaccggcccgggtacttcacccagacggcgggcccctggcacctggggaagctggagctcgacttcaacctgtgcgagggcaccaccgtggtcgtggacgagcactgcggcaaccgcgggccgagcctgcggaccacgaccgtgaccggcaagatcatccacgagtggtgctgccgctcctgcaccctgccgcccctgcggttccgcggggaggacggctgctggtacgggatggagatccggcccgtcaaggagaaggaggagaacctggtgcgcagcatggtgtccgccggcagcggcgaggtcgacagcttctccctcgggctgctgtgcgtgagcatcatgatcgaggaggtgatgcggtcccgctggagccgcaagatgctcatgacgggcaccctggccgtcttcttcctgctcatcatggggcagctgacctggaacgacctgatccggctctgcatcatggtgggcgccaacgtgtccgaccgcatggggatgggcaccacgtacctggccctgatggcgaccttcaagatgcggccgatgttcgccgtcggcctcctgttccgccggctgaccagccgcgaggtgctcctgctgaccatcgggctctccctggtcgccagcgtggagctgcccaactccctcgaggagctgggcgacgggctggccatgggcatcatgatgctcaagctgctgacggacttccagagccaccagctctggaccaccctgctgtccctcaccttcatcaagacgaccctgagcctggactacgcctggaagaccatggcgatggtgctctccatcgtcagcctgttccccctgtgcctctccaccacgagccagaagaccacctggctgcccgtgctgctcggctccttcgggtgcaagccgctgaccatgttcctgatcaccgagaacaagatctggggccgcaagagctggcccctcaacgaggggatcatggccgtgggcatcgtctccatcctgctgagcagcctcctgaagaacgacgtgcccctggccgggcccctcatcgccggcggcatgctgatcgcgtgctacgtgatctccgggagctccgccgacctgagcctcgagcgcgccgccgaggtctcctgggaggaggaggccgagcacagcggcgcgtcccacaacatcctggtggaggtgcaggacgacgggacgatgaagatcaaggacgaggagcgggacgacaccctgaccatcctcctgaaggccaccctgctcgccgtcagcggcgtgtacccgatgtccatccccgccacgctgttcgtgtggtacttctggcagaagaagaagcagcgcagcggggtcctgtgggacacccccagcccgcccgaggtggagcgggccgtgctcgacgacggcatctaccgcatcctgcagcggggcctgctggggcgcagccaggtcggcgtgggggtgttccaggacggcgtcttccacaccatgtggcacgtgacccgcggggcggtgctcatgtaccagggcaagcgcctggagccctcctgggccagcgtcaagaaggacctgatctcctacggcgggggctggcggttccaggggagctggaacacgggcgaggaggtccaggtgatcgccgtcgagcccgggaagaaccccaagaacgtgcagaccacccccggcaccttcaagacgcccgagggcgaggtgggggccatcgccctcgacttcaagcccggcacctccgggagccccatcgtcaaccgcgagggcaagatcgtgggcctgtacgggaacggcgtggtcaccacctccgggacgtacgtgagcgcgatcgcccaggccaaggccagccaggagggcccgctgcccgagatcgaggacgaggtgttcaagaagcggaacctcaccatcatggacctgcaccccgggtccggcaagacccgccggtacctgccggccatcgtccgcgaggcgatcaagcgcaagctccggaccctgatcctggcccccacgcgcgtggtggccagcgagatggccgaggcgctcaagggcatgcccatccggtaccagaccaccgccgtcaagtccgagcacaccgggaaggagatcgtggacctgatgtgccacgccacgttcaccatgcgcctgctcagccccgtgcgggtcccgaactacaacatgatcatcatggacgaggcccacttcaccgaccccgcctccatcgcggcccgcggctacatcagcacccgggtggggatgggcgaggccgccgccatcttcatgacggcgacgccgcccgggtccgtggaggccttcccgcagagcaacgccgtcatccaggacgaggagcgcgacatccccgagcggtcctggaacagcggctacgactggatcaccgacttccccggcaagaccgtgtggttcgtgccctccatcaagagcgggaacgacatcgccaactgcctgcgcaagaacggcaagcgggtcatccagctgtcccgcaagacgttcgacaccgagtaccagaagaccaagaacaacgactgggactacgtggtgaccacggacatcagcgagatgggggccaacttccgggcggaccgcgtcatcgacccgcggcgctgcctcaagcccgtgatcctgaaggacggccccgagcgggtcatcctggccgggcccatgccggtgaccgccgcctccgcggcccagcgccggggccgcatcggccgcaaccagaacaaggagggggaccagtacatctacatgggccagcccctcaacaacgacgaggaccacgcccactggaccgaggccaagatgctgctggacaacatcaacacccccgaggggatcatccccgccctcttcgagccggagcgggagaagtccgcggccatcgacggcgagtaccgcctgcgcggggaggcccgcaagacgttcgtggagctgatgcggcgcggcgacctccccgtctggctgtcctacaaggtggccagcgagggcttccagtactccgaccggcgctggtgcttcgacggggagcggaacaaccaggtgctggaggagaacatggacgtcgagatctggaccaaggagggcgagcgcaagaagctccggccccgctggctggacgcccggacctacagcgaccccctggcgctccgcgagttcaaggagttcgccgccgggcggcgcagcgtgtccggcgacctgatcctggagatcggcaagctcccgcagcacctgaccctgcgggcccagaacgccctcgacaacctggtgatgctgcacaacagcgagcagggcgggaaggcgtaccgccacgccatggaggagctccccgacaccatcgagacgctgatgctgctcgccctgatcgccgtcctgaccgggggcgtgaccctcttcttcctgtccgggaagggcctgggcaagaccagcatcgggctcctgtgcgtgatggcgtccagcgtcctgctctggatggcctccgtggagccccactggatcgccgccagcatcatcctggagttcttcctgatggtgctcctgatccccgagccggaccggcagcgcacgccccaggacaaccagctggcctacgtcgtgatcggcctcctgttcatgatcctgaccgtggcggccaacgagatggggctcctggagaccaccaagaaggacctgggcatcgggcacgtcgtggccgagaaccaccaccacgccacgatgctcgacatcgacctgcaccccgcctccgcgtggaccctgtacgccgtggccaccaccatcatcacgccgatgatgcggcacaccatcgagaacaccaccgccaacatcagcctcacggccatcgcgaaccaggccgccatcctgatgggcctggacaagggctggcccatctccaagatggacatcggggtccccctcctggccctgggctgctacagccaggtgaaccccctcaccctgaccgccgcggtgctgatgctcgtcgcccactacgccatcatcgggccgggcctgcaggccaaggcgacccgcgaggcccagaagcgcacggccgccgggatcatgaagaaccccaccgtggacggcatcgtggccatcgacctggaccccgtcgtgtacgacgcgaagttcgagaagcagctcggccagatcatgctgctgatcctctgcacctcccagatcctgctgatgcggaccacgtgggccctctgcgagagcatcaccctggccaccgggcccctgaccacgctctgggagggctccccggggaagttctggaacaccaccatcgccgtgagcatggccaacatcttccgcggctcctacctggcgggcgccgggctggccttcagcctcatgaagtccctgggcgggggccggcgcgggaccggcgcccagggcgagacgctgggggagaagtggaagcggcagctcaaccagctgagcaagagcgagttcaacacctacaagcgctccggcatcatggaggtcgaccggagcgaggccaaggaggggctgaagcgcggcgagaccaccaagcacgcggtgtcccgggggacggccaagctccgctggttcgtggagcggaacctggtcaagcccgagggcaaggtgatcgacctgggctgcgggcgcggcgggtggagctactactgcgccggcctgaagaaggtgaccgaggtcaaggggtacaccaagggcggccccgggcacgaggagcccatcccgatggccacctacggctggaacatcgtgaagctccactccgggcgggacgtgttcttcacgccgcccgagaagtgcgacacgctgctgtgcgacatcggcgagagctcccccaacccgaccatcgaggaggggcgcaccctccgggtcctgaagatggtggagccctggctgcgcggcaaccagttctgcatcaagatcctcaacccctacatgcccagcgtggtcgagaccctggagcagatgcagcggaagcacggcgggatgctggtgcgcaacccgctctcccggaacagcacgcacgagatgtactgggtgtcctgcggcaccgggaacatcgtcagcgcggtgaacatgacctcccgcatgctgctgaaccgcttcaccatggcccaccggaagcccacgtacgagcgcgacgtggacctcggcgccggcacccggcacgtcgccgtggagcccgagatcgccaacctggacatcatcgggcagcgcatcgagaacatcaagaacgagcacaagagcacctggcactacgacgaggacaacccctacaagacctgggcgtaccacggctcctacgaggtgaagccgagcgggtccgccagctccatggtcaacggcgtggtccggctgctcacgaagccctgggacgtgatccccatggtgacccagatcgccatgaccgacaccacgcccttcgggcagcagcgcgtcttcaaggagaaggtggacacccggaccccgcgccccaagcggggcaccgcccagatcatggaggtgacggccaagtggctgtggggcttcctgagccgcaacaagaagccccggatctgcacccgcgaggagttcacccggaaggtccgcagcaacgcggccatcggggccgtgttcgtggacgagaaccagtggaactccgccaaggaggccgtcgaggacgagcggttctgggacctcgtgcaccgcgagcgggagctgcacaagcagggcaagtgcgcgacctgcgtgtacaacatgatggggaagcgcgagaagaagctgggcgagttcgggaaggccaagggcagccgggccatctggtacatgtggctcggcgcccgcttcctggagttcgaggcgctggggttcatgaacgaggaccactggttctcccgggagaacagcctctccggcgtcgagggggagggcctgcacaagctggggtacatcctccgcgacatcagcaagatcccgggcggcaacatgtacgccgacgacacggccgggtgggacacccgcatcaccgaggacgacctgcagaacgaggccaagatcaccgacatcatggagcccgagcacgccctgctcgcgacgtccatcttcaagctgacctaccagaacaaggtggtgcgggtccagcgccccgccaagagcggcaccgtgatggacgtgatctcccggcgcgaccagcgggggagcggccaggtcggcacctacgggctgaacacgttcaccaacatggaggtgcagctcatccgccagatggagtccgagggcatcttcagcccctccgagctggagaacagcaacctggccgagcgggtgctcgactggctggagaagcacggggtcgagcgcctgaagcggatggccatctccggcgacgactgcgtggtgaagccgaccgacgaccgcttcgccaccgcgctcacggccctgaacgacatggggaaggtccggaaggacatcccccagtgggagcccagcaagggctggaacgactggcagcaggtccccttctgctcccaccacttccaccagctgatcatgaaggacggccgcgagatcgtggtcccgtgccggaaccaggacgagctcgtggggcgcgcccgggtgagccagggcgccgggtggagcctgcgcgagaccgcctgcctgggcaagtcctacgcgcagatgtggcagctcatgtacttccaccggcgcgacctgcggctggccgccaacgccatctgcagcgccgtccccgtgaactgggtgcccacctcccgcaccacctggagcatccacgcgcaccaccagtggatgacgaccgaggacatgctctccgtctggaaccgcgtgtggatcgaggagaacccctggatggaggacaagacccacgtgagctcctgggaggacgtcccgtacctggggaagcgggaggaccagtggtgcggcagcctgatcggcctcaccgcccgcgccacgtgggccaccaacatccaggtggcgatcaaccaggtgcggcgcctgatcgggaacgagaactacctggactacatgacctccatgaagcggttcaagaacgagagcgaccccgagggcgccctctggtga

SEQ ID NO: 8947 - RNA, 9879 nt, synthetic construct
  misc_feature 1..9879: note = derived and/or modified CDS sequence (opt1) from DENV-1__KM403631__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctcatcacggccaacccgatcgtgaccgacaaggagaagcccatcaacatcgagaccgagccgcccttcggggagagctacatcgtgatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtcttcacctccgtggggaagctggtgcaccaggtcttcggcaccgcctacggggtgctgttcagcggcgtgtcctggaccatgaagatcgggatcggcatcctcctgacgtggctgggcctcaacagccgctccaccagcctgtccatgacctgcatcgccgtcgggatggtgaccctgtacctcggcgtgatggtccaggccgacagcgggtgcgtgatcaactggaagggccgggagctgaagtgcgggtccggcatcttcgtgacgaacgaggtccacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtggtcgtgggggacgccaacggcatcctgacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtggaggactacggcttcggggtcttcaccaccaacatctggctgaagctccgggactcctacacccagatgtgcgaccaccgcctgatgagcgccgcgatcaaggactccaaggccgtgcacgccgacatgggctactggatcgagagcgagaagaacgagacgtggaagctggcccgggcctccttcatcgaggtgaagacctgcatctggccccgcagccacaccctctggtccaacggcgtcctggagagcgagatgatcatccccaagatctacgggggcccgatctcccagcacaactaccggcccgggtacttcacccagacggcgggcccctggcacctggggaagctcgagctggacttcaacctgtgcgagggcaccaccgtggtggtcgacgagcactgcggcaaccgcgggccgagcctccggaccacgaccgtgaccggcaagatcatccacgagtggtgctgccgctcctgcaccctgccgcccctgcggttccgcggggaggacggctgctggtacgggatggagatccggcccgtgaaggagaaggaggagaacctcgtccgcagcatggtgtccgccggcagcggcgaggtggacagcttctccctggggctgctctgcgtcagcatcatgatcgaggaggtgatgcggtcccgctggagccgcaagatgctgatgacgggcaccctggccgtgttcttcctcctgatcatggggcagctgacctggaacgacctcatccggctgtgcatcatggtcggcgccaacgtgtccgaccgcatggggatgggcaccacgtacctggccctcatggcgaccttcaagatgcggccgatgttcgccgtggggctgctgttccgccggctcaccagccgcgaggtcctgctgctcaccatcgggctgtccctggtggccagcgtcgagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcctggaagaccatggcgatggtgctgtccatcgtgagcctgttccccctctgcctgtccaccacgagccagaagaccacctggctgcccgtcctcctgggctccttcgggtgcaagccgctgaccatgttcctcatcaccgagaacaagatctggggccgcaagagctggcccctgaacgaggggatcatggccgtgggcatcgtgtccatcctgctcagcagcctgctgaagaacgacgtccccctcgccgggcccctgatcgccggcggcatgctgatcgcgtgctacgtgatctccgggagctccgccgacctcagcctggagcgcgccgccgaggtgtcctgggaggaggaggccgagcacagcggcgcgtcccacaacatcctggtcgaggtgcaggacgacgggacgatgaagatcaaggacgaggagcgggacgacaccctcaccatcctgctgaaggccaccctcctggccgtgagcggcgtctacccgatgtccatccccgccacgctgttcgtgtggtacttctggcagaagaagaagcagcgcagcggggtgctctgggacacccccagcccgcccgaggtcgagcgggccgtgctggacgacggcatctaccgcatcctgcagcggggcctgctcgggcgcagccaggtgggcgtcggggtgttccaggacggcgtgttccacaccatgtggcacgtcacccgcggggcggtgctgatgtaccagggcaagcgcctggagccctcctgggccagcgtgaagaaggacctcatctcctacggcgggggctggcggttccaggggagctggaacacgggcgaggaggtccaggtgatcgccgtggagcccgggaagaaccccaagaacgtccagaccacccccggcaccttcaagacgcccgagggcgaggtgggggccatcgccctggacttcaagcccggcacctccgggagccccatcgtgaaccgcgagggcaagatcgtcggcctgtacgggaacggcgtggtgaccacctccgggacgtacgtcagcgcgatcgcccaggccaaggccagccaggagggcccgctccccgagatcgaggacgaggtgttcaagaagcggaacctgaccatcatggacctgcaccccgggtccggcaagacccgccggtacctcccggccatcgtgcgcgaggcgatcaagcgcaagctgcggaccctgatcctcgcccccacgcgcgtcgtggccagcgagatggccgaggcgctgaagggcatgcccatccggtaccagaccaccgccgtgaagtccgagcacaccgggaaggagatcgtcgacctgatgtgccacgccacgttcaccatgcgcctcctgagccccgtgcgggtgccgaactacaacatgatcatcatggacgaggcccacttcaccgaccccgcctccatcgcggcccgcggctacatcagcacccgggtcgggatgggcgaggccgccgccatcttcatgacggcgacgccgcccgggtccgtggaggccttcccgcagagcaacgccgtgatccaggacgaggagcgcgacatccccgagcggtcctggaacagcggctacgactggatcaccgacttccccggcaagaccgtctggttcgtgccctccatcaagagcgggaacgacatcgccaactgcctgcgcaagaacggcaagcgggtgatccagctctcccgcaagacgttcgacaccgagtaccagaagaccaagaacaacgactgggactacgtcgtgaccacggacatcagcgagatgggggccaacttccgggcggaccgcgtgatcgacccgcggcgctgcctgaagcccgtcatcctgaaggacggccccgagcgggtgatcctcgccgggcccatgccggtcaccgccgcctccgcggcccagcgccggggccgcatcggccgcaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgggagaagtccgcggccatcgacggcgagtaccgcctgcgcggggaggcccgcaagacgttcgtggagctcatgcggcgcggcgacctgcccgtgtggctgtcctacaaggtcgccagcgagggcttccagtactccgaccggcgctggtgcttcgacggggagcggaacaaccaggtgctcgaggagaacatggacgtggagatctggaccaaggagggcgagcgcaagaagctgcggccccgctggctggacgcccggacctacagcgaccccctcgcgctgcgcgagttcaaggagttcgccgccgggcggcgcagcgtctccggcgacctgatcctcgagatcggcaagctgccgcagcacctgaccctccgggcccagaacgccctggacaacctggtgatgctccacaacagcgagcagggcgggaaggcgtaccgccacgccatggaggagctgcccgacaccatcgagacgctgatgctcctggccctgatcgccgtgctcaccgggggcgtcaccctgttcttcctgtccgggaagggcctcggcaagaccagcatcgggctgctgtgcgtgatggcgtccagcgtgctcctgtggatggcctccgtcgagccccactggatcgccgccagcatcatcctggagttcttcctcatggtgctgctgatccccgagccggaccggcagcgcacgccccaggacaaccagctcgcctacgtggtcatcggcctgctgttcatgatcctcaccgtggcggccaacgagatggggctgctggagaccaccaagaaggacctcggcatcgggcacgtggtcgccgagaaccaccaccacgccacgatgctggacatcgacctgcaccccgcctccgcgtggaccctctacgccgtggccaccaccatcatcacgccgatgatgcggcacaccatcgagaacaccaccgccaacatcagcctgacggccatcgcgaaccaggccgccatcctgatgggcctcgacaagggctggcccatctccaagatggacatcggggtgcccctgctggccctcggctgctacagccaggtcaaccccctgaccctgaccgccgcggtgctcatgctggtggcccactacgccatcatcgggccgggcctgcaggccaaggcgacccgcgaggcccagaagcgcacggccgccgggatcatgaagaaccccaccgtcgacggcatcgtggccatcgacctcgaccccgtggtctacgacgcgaagttcgagaagcagctgggccagatcatgctgctcatcctgtgcacctcccagatcctgctcatgcggaccacgtgggccctgtgcgagagcatcaccctggccaccgggcccctcaccacgctgtgggagggctccccggggaagttctggaacaccaccatcgccgtgagcatggccaacatcttccgcggctcctacctggcgggcgccgggctcgccttcagcctgatgaagtccctgggcgggggccggcgcgggaccggcgcccagggcgagacgctcggggagaagtggaagcggcagctgaaccagctgagcaagagcgagttcaacacctacaagcgctccggcatcatggaggtggaccggagcgaggccaaggaggggctcaagcgcggcgagaccaccaagcacgcggtctcccgggggacggccaagctgcgctggttcgtggagcggaacctggtgaagcccgagggcaaggtcatcgacctgggctgcgggcgcggcgggtggagctactactgcgccggcctcaagaaggtgaccgaggtgaaggggtacaccaagggcggccccgggcacgaggagcccatcccgatggccacctacggctggaacatcgtcaagctgcactccgggcgggacgtgttcttcacgccgcccgagaagtgcgacacgctgctctgcgacatcggcgagagctcccccaacccgaccatcgaggaggggcgcaccctgcgggtgctgaagatggtcgagccctggctccgcggcaaccagttctgcatcaagatcctgaacccctacatgcccagcgtggtggagaccctggagcagatgcagcggaagcacggcgggatgctcgtccgcaacccgctgtcccggaacagcacgcacgagatgtactgggtgtcctgcggcaccgggaacatcgtgagcgcggtcaacatgacctcccgcatgctgctcaaccgcttcaccatggcccaccggaagcccacgtacgagcgcgacgtggacctgggcgccggcacccggcacgtggccgtcgagcccgagatcgccaacctggacatcatcgggcagcgcatcgagaacatcaagaacgagcacaagagcacctggcactacgacgaggacaacccctacaagacctgggcgtaccacggctcctacgaggtgaagccgagcgggtccgccagctccatggtgaacggcgtcgtgcggctcctgacgaagccctgggacgtcatccccatggtgacccagatcgccatgaccgacaccacgcccttcgggcagcagcgcgtgttcaaggagaaggtcgacacccggaccccgcgccccaagcggggcaccgcccagatcatggaggtgacggccaagtggctgtggggcttcctcagccgcaacaagaagccccggatctgcacccgcgaggagttcacccggaaggtgcgcagcaacgcggccatcggggccgtcttcgtggacgagaaccagtggaactccgccaaggaggccgtggaggacgagcggttctgggacctggtccaccgcgagcgggagctgcacaagcagggcaagtgcgcgacctgcgtgtacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtggagggggagggcctgcacaagctcgggtacatcctgcgcgacatcagcaagatcccgggcggcaacatgtacgccgacgacacggccgggtgggacacccgcatcaccgaggacgacctgcagaacgaggccaagatcaccgacatcatggagcccgagcacgccctcctggcgacgtccatcttcaagctgacctaccagaacaaggtcgtgcgggtgcagcgccccgccaagagcggcaccgtcatggacgtgatctcccggcgcgaccagcgggggagcggccaggtgggcacctacgggctcaacacgttcaccaacatggaggtccagctgatccgccagatggagtccgagggcatcttcagcccctccgagctggagaacagcaacctcgccgagcgggtgctggactggctggagaagcacggggtggagcgcctcaagcggatggccatctccggcgacgactgcgtcgtgaagccgaccgacgaccgcttcgccaccgcgctgacggccctgaacgacatggggaaggtgcggaaggacatcccccagtgggagcccagcaagggctggaacgactggcagcaggtccccttctgctcccaccacttccaccagctcatcatgaaggacggccgcgagatcgtggtgccgtgccggaaccaggacgagctggtcgggcgcgcccgggtgagccagggcgccgggtggagcctgcgcgagaccgcctgcctcggcaagtcctacgcgcagatgtggcagctgatgtacttccaccggcgcgacctgcggctcgccgccaacgccatctgcagcgccgtgcccgtcaactgggtgcccacctcccgcaccacctggagcatccacgcgcaccaccagtggatgacgaccgaggacatgctgtccgtgtggaaccgcgtctggatcgaggagaacccctggatggaggacaagacccacgtgagctcctgggaggacgtgccgtacctggggaagcgggaggaccagtggtgcggcagcctcatcggcctgaccgcccgcgccacgtgggccaccaacatccaggtcgcgatcaaccaggtgcggcgcctgatcgggaacgagaactacctcgactacatgacctccatgaagcggttcaagaacgagagcgaccccgagggcgccctgtggtga

SEQ ID NO: 8948 - RNA, 9879 nt, synthetic construct
  misc_feature 1..9879: note = derived and/or modified CDS sequence (opt1) from DENV-1__KM403632__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttccgctgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccgccaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccggctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccgcctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccgccgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccggtccaccagcctgtccatgacctgcatcgccgtggggatggtgaccctgtacctcggcgtcatggtgcaggccgacagcgggtgcgtgatcaactggaagggccgcgagctgaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcaccgtcgtggtgggggacgccaacggcatcctgacgcaggggaagaagatgatccgcccccagcccatggagcacaagtactcctggaagtcctggggcaaggcgaagatcatcggcgccgacacccagaacaccaccttcatcatcgacgggcccgacacgccggagtgccccgacgaccagcgggcctggaacatctgggaggtcgaggactacggcttcggggtgttcaccaccaacatctggctgaagctccgcgactcctacacccagatgtgcgaccaccggctgatgagcgccgcgatcaaggactccaaggccgtgcacgccgacatgggctactggatcgagagcgagaagaacgagacgtggaagctggcccgcgcctccttcatcgaggtcaagacctgcatctggccccggagccacaccctctggtccaacggcgtgctggagagcgagatgatcatccccaagatctacgggggcccgatctcccagcacaactaccgccccgggtacttcacccagacggcgggcccctggcacctggggaagctcgagctggacttcaacctgtgcgagggcaccaccgtggtcgtggacgagcactgcggcaaccgggggccgagcctccgcaccacgaccgtgaccggcaagatcatccacgagtggtgctgccggtcctgcaccctgccgcccctgcgcttccgcggggaggacggctgctggtacgggatggagatccgccccgtcaaggagaaggaggagaacctcgtgcggagcatggtgtccgccggcagcggcgaggtcgacagcttctccctggggctgctctgcgtgagcatcatgatcgaggaggtgatgcgctcccgctggagccggaagatgctgatgacgggcaccctggccgtcttcttcctcctgatcatggggcagctgacctggaacgacctcatccgcctgtgcatcatggtgggcgccaacgtgtccgaccggatggggatgggcaccacgtacctggccctcatggcgaccttcaagatgcgcccgatgttcgccgtcgggctgctgttccggcgcctcaccagccgggaggtgctgctgctcaccatcgggctgtccctggtcgccagcgtggagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcctggaagaccatggcgatggtgctgtccatcgtcagcctgttccccctctgcctgtccaccacgagccagaagaccacctggctgcccgtgctcctgggctccttcgggtgcaagccgctgaccatgttcctcatcaccgagaacaagatctggggccgcaagagctggcccctgaacgaggggatcatggccgtgggcatcgtctccatcctgctcagcagcctgctgaagaacgacgtgcccctcgccgggcccctgatcgccggcggcatgctgatcgcgtgctacgtgatctccgggagctccgccgacctcagcctggagcgggccgccgaggtctcctgggaggaggaggccgagcacagcggcgcgtcccacaacatcctggtggaggtgcaggacgacgggacgatgaagatcaaggacgaggagcgcgacgacaccctcaccatcctgctgaaggccaccctcctggccgtcagcggcgtgtacccgatgtccatccccgccacgctgttcgtgtggtacttctggcagaagaagaagcagcggagcggggtcctctgggacacccccagcccgcccgaggtggagcgcgccgtgctggacgacggcatctaccggatcctgcagcgcggcctgctcgggcggagccaggtcggcgtgggggtgttccaggacggcgtcttccacaccatgtggcacgtgacccgcggggcggtgctgatgtaccagggcaagcggctggagccctcctgggccagcgtcaagaaggacctcatctcctacggcgggggctggcgcttccaggggagctggaacacgggcgaggaggtccaggtgatcgccgtcgagcccgggaagaaccccaagaacgtgcagaccacccccggcaccttcaagacgcccgagggcgaggtgggggccatcgccctggacttcaagcccggcacctccgggagccccatcgtcaaccgggagggcaagatcgtgggcctgtacgggaacggcgtggtcaccacctccgggacgtacgtgagcgcgatcgcccaggccaaggccagccaggagggcccgctccccgagatcgaggacgaggtgttcaagaagcgcaacctgaccatcatggacctgcaccccgggtccggcaagacccggcgctacctcccggccatcgtccgcgaggcgatcaagcggaagctgcgcaccctgatcctcgcccccacgcgggtggtggccagcgagatggccgaggcgctgaagggcatgcccatccgctaccagaccaccgccgtcaagtccgagcacaccgggaaggagatcgtggacctgatgtgccacgccacgttcaccatgcggctcctgagccccgtgcgcgtcccgaactacaacatgatcatcatggacgaggcccacttcaccgaccccgcctccatcgcggcccggggctacatcagcacccgcgtggggatgggcgaggccgccgccatcttcatgacggcgacgccgcccgggtccgtggaggccttcccgcagagcaacgccgtcatccaggacgaggagcgggacatccccgagcgctcctggaacagcggctacgactggatcaccgacttccccggcaagaccgtgtggttcgtgccctccatcaagagcgggaacgacatcgccaactgcctgcggaagaacggcaagcgcgtcatccagctctcccggaagacgttcgacaccgagtaccagaagaccaagaacaacgactgggactacgtggtgaccacggacatcagcgagatgggggccaacttccgcgcggaccgggtcatcgacccgcgccggtgcctgaagcccgtgatcctgaaggacggccccgagcgcgtcatcctcgccgggcccatgccggtgaccgccgcctccgcggcccagcggcgcggccgcatcggccggaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgcgagaagtccgcggccatcgacggcgagtaccggctgcgcggggaggcccggaagacgttcgtggagctcatgcgccggggcgacctgcccgtctggctgtcctacaaggtggccagcgagggcttccagtactccgaccgccggtggtgcttcgacggggagcgcaacaaccaggtgctcgaggagaacatggacgtcgagatctggaccaaggagggcgagcggaagaagctgcgcccccggtggctggacgcccgcacctacagcgaccccctcgcgctgcgggagttcaaggagttcgccgccgggcgccggagcgtgtccggcgacctgatcctcgagatcggcaagctgccgcagcacctgaccctccgcgcccagaacgccctggacaacctggtgatgctccacaacagcgagcagggcgggaaggcgtaccggcacgccatggaggagctgcccgacaccatcgagacgctgatgctcctggccctgatcgccgtcctcaccgggggcgtgaccctgttcttcctgtccgggaagggcctcggcaagaccagcatcgggctgctgtgcgtgatggcgtccagcgtcctcctgtggatggcctccgtggagccccactggatcgccgccagcatcatcctggagttcttcctcatggtgctgctgatccccgagccggaccgccagcggacgccccaggacaaccagctcgcctacgtcgtgatcggcctgctgttcatgatcctcaccgtggcggccaacgagatggggctgctggagaccaccaagaaggacctcggcatcgggcacgtcgtggccgagaaccaccaccacgccacgatgctggacatcgacctgcaccccgcctccgcgtggaccctctacgccgtggccaccaccatcatcacgccgatgatgcgccacaccatcgagaacaccaccgccaacatcagcctgacggccatcgcgaaccaggccgccatcctgatgggcctcgacaagggctggcccatctccaagatggacatcggggtccccctgctggccctcggctgctacagccaggtgaaccccctgaccctgaccgccgcggtgctcatgctggtcgcccactacgccatcatcgggccgggcctgcaggccaaggcgacccgcgaggcccagaagcggacggccgccgggatcatgaagaaccccaccgtggacggcatcgtggccatcgacctcgaccccgtcgtgtacgacgcgaagttcgagaagcagctgggccagatcatgctgctcatcctgtgcacctcccagatcctgctcatgcgcaccacgtgggccctgtgcgagagcatcaccctggccaccgggcccctcaccacgctgtgggagggctccccggggaagttctggaacaccaccatcgccgtgagcatggccaacatcttccggggctcctacctggcgggcgccgggctcgccttcagcctgatgaagtccctgggcgggggccgccgggggaccggcgcccagggcgagacgctcggggagaagtggaagcgccagctgaaccagctgagcaagagcgagttcaacacctacaagcggtccggcatcatggaggtcgaccgcagcgaggccaaggaggggctcaagcggggcgagaccaccaagcacgcggtgtcccgcgggacggccaagctgcggtggttcgtggagcgcaacctggtcaagcccgagggcaaggtgatcgacctgggctgcgggcggggcgggtggagctactactgcgccggcctcaagaaggtgaccgaggtcaaggggtacaccaagggcggccccgggcacgaggagcccatcccgatggccacctacggctggaacatcgtgaagctgcactccgggcgcgacgtgttcttcacgccgcccgagaagtgcgacacgctgctctgcgacatcggcgagagctcccccaacccgaccatcgaggaggggcggaccctgcgcgtcctgaagatggtggagccctggctccggggcaaccagttctgcatcaagatcctgaacccctacatgcccagcgtggtcgagaccctggagcagatgcagcgcaagcacggcgggatgctcgtgcggaacccgctgtcccgcaacagcacgcacgagatgtactgggtgtcctgcggcaccgggaacatcgtcagcgcggtgaacatgacctcccgcatgctgctcaaccggttcaccatggcccaccgcaagcccacgtacgagcgggacgtggacctgggcgccggcacccgccacgtcgccgtggagcccgagatcgccaacctggacatcatcgggcagcggatcgagaacatcaagaacgagcacaagagcacctggcactacgacgaggacaacccctacaagacctgggcgtaccacggctcctacgaggtgaagccgagcgggtccgccagctccatggtcaacggcgtggtccgcctcctgacgaagccctgggacgtgatccccatggtgacccagatcgccatgaccgacaccacgcccttcgggcagcagcgggtcttcaaggagaaggtggacacccgcaccccgcggcccaagcgcggcaccgcccagatcatggaggtgacggccaagtggctgtggggcttcctcagccggaacaagaagccccgcatctgcacccgggaggagttcacccgcaaggtccggagcaacgcggccatcggggccgtgttcgtggacgagaaccagtggaactccgccaaggaggccgtcgaggacgagcgcttctgggacctggtgcaccgggagcgcgagctgcacaagcagggcaagtgcgcgacctgcgtgtacaacatgatggggaagcgggagaagaagctcggcgagttcgggaaggccaagggcagccgcgccatctggtacatgtggctgggcgcccggttcctggagttcgaggcgctcgggttcatgaacgaggaccactggttctcccgcgagaacagcctgtccggcgtcgagggggagggcctgcacaagctcgggtacatcctgcgcgacatcagcaagatcccgggcggcaacatgtacgccgacgacacggccgggtgggacacccggatcaccgaggacgacctgcagaacgaggccaagatcaccgacatcatggagcccgagcacgccctcctggcgacgtccatcttcaagctgacctaccagaacaaggtggtgcgcgtccagcggcccgccaagagcggcaccgtgatggacgtgatctcccgccgggaccagcgcgggagcggccaggtcggcacctacgggctcaacacgttcaccaacatggaggtgcagctgatccggcagatggagtccgagggcatcttcagcccctccgagctggagaacagcaacctcgccgagcgcgtgctggactggctggagaagcacggggtcgagcggctcaagcgcatggccatctccggcgacgactgcgtggtgaagccgaccgacgaccggttcgccaccgcgctgacggccctgaacgacatggggaaggtccgcaaggacatcccccagtgggagcccagcaagggctggaacgactggcagcaggtccccttctgctcccaccacttccaccagctcatcatgaaggacggccgggagatcgtggtcccgtgccgcaaccaggacgagctggtggggcgggcccgcgtgagccagggcgccgggtggagcctgcgggagaccgcctgcctcggcaagtcctacgcgcagatgtggcagctgatgtacttccaccgccgggacctgcgcctcgccgccaacgccatctgcagcgccgtccccgtgaactgggtgcccacctcccgcaccacctggagcatccacgcgcaccaccagtggatgacgaccgaggacatgctgtccgtctggaaccgggtgtggatcgaggagaacccctggatggaggacaagacccacgtgagctcctgggaggacgtcccgtacctggggaagcgcgaggaccagtggtgcggcagcctcatcggcctgaccgcccgggccacgtgggccaccaacatccaggtggcgatcaaccaggtgcgccggctgatcgggaacgagaactacctcgactacatgacctccatgaagcgcttcaagaacgagagcgaccccgagggcgccctgtggtga

SEQ ID NO: 8949 - RNA, 9879 nt, synthetic construct
  misc_feature 1..9879: note = derived and/or modified CDS sequence (opt1) from DENV-1__KM403583__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtcacctacgggacctgcagccagaccggcgagcaccggcgcgaccggcgctccgtggccctggcgccccacgtgggcctggggctcgagacccggaccgagacctggatgagctccgagggcgcctggcgccagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccgccggatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctgacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtcgaggactacggcttcggggtgttcaccaccaacatctggctgaagctccgggactcctacacccagatgtgcgaccaccgcctgatgagcgccgcgatcaaggactccaaggccgtgcacgccgacatgggctactggatcgagagcgagaagaacgagacgtggaagctggcccgggcctccttcatcgaggtcaagacctgcatctggccccgcagccacaccctctggtccaacggcgtgctggagagcgagatgatcatccccaagatctacgggggcccgatctcccagcacaactaccggcccgggtacttcacccagacggcgggcccctggcacctggggaagctcgagctggacttcaacctgtgcgagggcaccaccgtggtcgtggacgagcactgcggcaaccgcgggccgagcctccggaccacgaccgtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggctgctctgcgtgagcatcatgatcgaggaggtgatgcgctcccggtggagccgcaagatgctgatgacgggcaccctggccatcttcttcctcctgatcatggggcagctgacctggaacgacctcatccggctgtgcatcatggtcggcgccaacgtgtccgaccgcatggggatgggcaccacgtacctggccctcatggcgaccttcaagatgcggccgatgttcgccgtggggctgctgttccgccggctcaccagccgcgaggtcctgctgctcaccatcgggctgtccctggtggccagcgtcgagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcctggaagaccatggcgatggtgctgtccatcgtgagcctgttccccctctgcctgtccaccacgagccagaagaccacctggctgcccgtcctcctgggctccttcgggtgcaagccgctgaccatgttcctcatcaccgagaacaagatctggggccgcaagagctggcccctgaacgaggggatcatggccgtgggcatcgtgtccatcctgctcagcagcctgctgaagaacgacgtccccctcgccgggcccctgatcgccggcggcatgctgatcgcgtgctacgtgatctccgggagctccgccgacctcagcctggagcgcgccgccgaggtgtcctgggaggaggaggccgagcacagcggcgcgtcccacaacatcctggtcgaggtgcaggacgacgggacgatgaagatcaaggacgaggagcgggacgacaccctcaccatcctgctgaaggccaccctcctggccgtgagcggcgtctacccgatgtccatccccgccacgctgttcgtgtggtacttctggcagaagaagaagcagcgcagcggggtgctctgggacacccccagcccgcccgaggtcgagcgggccgtgctggacgacggcatctaccgcatcctgcagcggggcctgctcgggcgcagccaggtgggcgtcggggtgttccaggacggcgtgttccacaccatgtggcacgtcacccgcggggcggtgctgatgtaccagggcaagcgcctggagccctcctgggccagcgtgaagaaggacctcatctcctacggcgggggctggcggttccaggggagctggaacacgggcgaggaggtccaggtgatcgccgtggagcccgggaagaaccccaagaacgtccagaccacccccggcaccttcaagacgcccgagggcgaggtgggggccatcgccctggacttcaagcccggcacctccgggagccccatcgtgaaccgcgagggcaagatcgtcggcctgtacgggaacggcgtggtgaccacctccgggacgtacgtcagcgcgatcgcccaggccaaggccagccaggagggcccgctccccgagatcgaggacgaggtgttcaagaagcggaacctgaccatcatggacctgcaccccgggtccggcaagacccgccgctacctcccggccatcgtgcgggaggcgatcaagcgcaagctgcggaccctgatcctcgcccccacgcgcgtcgtggccagcgagatggccgaggcgctgaagggcatgcccatccggtaccagaccaccgccgtgaagtccgagcacaccgggaaggagatcgtcgacctgatgtgccacgccacgttcaccatgcgcctcctgagccccgtgcgggtgccgaactacaacatgatcatcatggacgaggcccacttcaccgaccccgcctccatcgcggcccgcggctacatcagcacccgggtcgggatgggcgaggccgccgccatcttcatgacggcgacgccgcccgggtccgtggaggccttcccgcagagcaacgccgtgatccaggacgaggagcgcgacatccccgagcggtcctggaacagcggctacgactggatcaccgacttccccggcaagaccgtctggttcgtgccctccatcaagagcgggaacgacatcgccaactgcctgcgcaagaacggcaagcgggtgatccagctctcccgcaagacgttcgacaccgagtaccagaagaccaagaacaacgactgggactacgtcgtgaccacggacatcagcgagatgggggccaacttccgggcggaccgcgtgatcgacccgcggcgctgcctgaagcccgtcatcctgaaggacggccccgagcgggtgatcctcgccgggcccatgccggtcaccgccgcctccgcggcccagcgccgcggccggatcggccgcaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgggagaagtccgcggccatcgacggcgagtaccgcctgcgcggggaggcccgcaagacgttcgtggagctcatgcggcgcggcgacctgcccgtgtggctgtcctacaaggtcgccagcgagggcttccagtactccgaccggcgctggtgcttcgacggggagcggaacaaccaggtgctcgaggagaacatggacgtggagatctggaccaaggagggcgagcgcaagaagctgcggccccgctggctggacgcccggacctacagcgaccccctcgcgctgcgcgagttcaaggagttcgccgccgggcggcgcagcgtctccggcgacctgatcctcgagatcggcaagctgccgcagcacctgaccctccgggcccagaacgccctggacaacctggtgatgctccacaacagcgagcagggcgggaaggcgtaccgccacgccatggaggagctgcccgacaccatcgagacgctgatgctcctggccctgatcgccgtgctcaccgggggcgtcaccctgttcttcctgtccgggaagggcctcggcaagaccagcatcgggctgctgtgcgtgatggcgtccagcgtgctcctgtggatggcctccgtcgagccccactggatcgccgccagcatcatcctggagttcttcctcatggtgctgctgatccccgagccggaccggcagcgcacgccccaggacaaccagctcgcctacgtggtcatcggcctgctgttcatgatcctcaccgtggcggccaacgagatggggctgctggagaccaccaagaaggacctcggcatcgggcacgtggtcgccgagaaccaccaccacgccacgatgctggacatcgacctgcaccccgcctccgcgtggaccctctacgccgtggccaccaccatcatcacgccgatgatgcgccacaccatcgagaacaccaccgccaacatcagcctgacggccatcgcgaaccaggccgccatcctgatgggcctcgacaagggctggcccatctccaagatggacatcggggtgcccctgctggccctcggctgctacagccaggtcaaccccctgaccctgaccgccgcggtgctcatgctggtggcccactacgccatcatcgggccgggcctgcaggccaaggcgacccgggaggcccagaagcgcacggccgccgggatcatgaagaaccccaccgtcgacggcatcgtggccatcgacctcgaccccgtggtctacgacgcgaagttcgagaagcagctgggccagatcatgctgctcatcctgtgcacctcccagatcctgctcatgcggaccacgtgggccctgtgcgagagcatcaccctggccaccgggcccctcaccacgctgtgggagggctccccggggaagttctggaacaccaccatcgccgtgagcatggccaacatcttccgcggctcctacctggcgggcgccgggctcgccttcagcctgatgaagtccctgggcgggggccggcgcgggaccggcgcccagggcgagacgctcggggagaagtggaagcggcagctgaaccagctgagcaagagcgagttcaacacctacaagcgctccggcatcatggaggtggaccggagcgaggccaaggaggggctcaagcgcggcgagaccaccaagcacgcggtctcccgggggacggccaagctgcgctggttcgtggagcggaacctggtgaagcccgagggcaaggtcatcgacctgggctgcgggcgcggcgggtggagctactactgcgccggcctcaagaaggtgaccgaggtgaaggggtacaccaagggcggccccgggcacgaggagcccatcccgatggccacctacggctggaacatcgtcaagctgcactccgggcgggacgtgttcttcacgccgcccgagaagtgcgacacgctgctctgcgacatcggcgagagctcccccaacccgaccatcgaggaggggcgcaccctgcgggtgctgaagatggtcgagccctggctccgcggcaaccagttctgcatcaagatcctgaacccctacatgcccagcgtggtggagaccctggagcagatgcagcggaagcacggcgggatgctcgtccgcaacccgctgtcccgcaacagcacgcacgagatgtactgggtgtcctgcggcaccgggaacatcgtgagcgcggtcaacatgacctcccggatgctgctcaaccgcttcaccatggcccaccggaagcccacgtacgagcgcgacgtggacctgggcgccggcacccggcacgtggccgtcgagcccgagatcgccaacctggacatcatcgggcagcgcatcgagaacatcaagaacgagcacaagagcacctggcactacgacgaggacaacccctacaagacctgggcgtaccacggctcctacgaggtgaagccgagcgggtccgccagctccatggtgaacggcgtcgtgcggctcctgacgaagccctgggacgtcatccccatggtgacccagatcgccatgaccgacaccacgcccttcgggcagcagcgcgtgttcaaggagaaggtcgacacccggaccccgcgccccaagcggggcaccgcccagatcatggaggtgacggccaagtggctgtggggcttcctcagccgcaacaagaagccccggatctgcacccgcgaggagttcacccggaaggtgcgcagcaacgcggccatcggggccgtcttcgtggacgagaaccagtggaactccgccaaggaggccgtggaggacgagcggttctgggacctggtccaccgcgagcgggagctgcacaagcagggcaagtgcgcgacctgcgtgtacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgcgagaacagcctgtccggcgtggagggggagggcctgcacaagctcgggtacatcctgcgggacatcagcaagatcccgggcggcaacatgtacgccgacgacacggccgggtgggacacccgcatcaccgaggacgacctgcagaacgaggccaagatcaccgacatcatggagcccgagcacgccctcctggcgacgtccatcttcaagctgacctaccagaacaaggtcgtgcgggtgcagcgccccgccaagagcggcaccgtcatggacgtgatctcccggcgcgaccagcgggggagcggccaggtgggcacctacgggctcaacacgttcaccaacatggaggtccagctgatccgccagatggagtccgagggcatcttcagcccctccgagctggagaacagcaacctcgccgagcgggtgctggactggctggagaagcacggggtggagcgcctcaagcggatggccatctccggcgacgactgcgtcgtgaagccgaccgacgaccgcttcgccaccgcgctgacggccctgaacgacatggggaaggtgcggaaggacatcccccagtgggagcccagcaagggctggaacgactggcagcaggtccccttctgctcccaccacttccaccagctcatcatgaaggacggccgcgagatcgtggtgccgtgccggaaccaggacgagctggtcgggcgcgcccgggtgagccagggcgccgggtggagcctgcgcgagaccgcctgcctcggcaagtcctacgcgcagatgtggcagctgatgtacttccaccggcgcgacctgcgcctcgccgccaacgccatctgcagcgccgtgcccgtcaactgggtgcccacctcccggaccacctggagcatccacgcgcaccaccagtggatgacgaccgaggacatgctgtccgtgtggaaccgcgtctggatcgaggagaacccctggatggaggacaagacccacgtgagctcctgggaggacgtgccgtacctggggaagcgggaggaccagtggtgcggcagcctcatcggcctgaccgcccgcgccacgtgggccaccaacatccaggtcgcgatcaaccaggtgcggcgcctgatcgggaacgagaactacctcgactacatgacctccatgaagcggttcaagaacgagagcgaccccgagggcgccctgtggtga

SEQ ID NO: 8950 - RNA, 9879 nt, synthetic construct
  misc_feature 1..9879: note = derived and/or modified CDS sequence (opt1) from DENV-1__KM403579__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctgacgcaggggaagaagatgatccggccccagcccatggagcacaagtactcctggaagtcctggggcaaggcgaagatcatcggcgccgacatccagaacaccaccttcatcatcgacgggcccgacaccccggagtgccccgacgaccagcgcgcctggaacatctgggaggtcgaggactacggcttcggggtgttcacgaccaacatctggctgaagctccgggactcctacacccagatgtgcgaccaccgcctgatgagcgccgcgatcaaggactccaaggccgtgcacgccgacatgggctactggatcgagagcgagaagaacgagacctggaagctggcccgggcctccttcatcgaggtcaagacgtgcatctggccccgcagccacaccctctggtccaacggcgtgctggagagcgagatgatcatccccaagatctacgggggcccgatctcccagcacaactaccggcccgggtacttcacccagaccgcgggcccctggcacctggggaagctcgagctggacttcaacctgtgcgagggcacgaccgtggtcgtggacgagcactgcggcaaccgcgggccgagcctccggaccaccacggtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggctgctctgcgtgagcatcatgatcgaggaggtgatgcggtcccgctggagccgcaagatgctgatgaccggcacgctggccgtcttcttcctcctgatcatggggcagctgacctggaacgacctcatccggctgtgcatcatggtgggcgccaacgtgtccgaccgcatggggatgggcaccacctacctggccctcatggcgacgttcaagatgcggccgatgttcgccgtcggcctgctgttccgccggctcaccagccgcgaggtgctgctgctcaccatcgggctgtccctggtcgccagcgtggagctccccaactccctggaggagctgggcgacgggctcgccatgggcatcatgatgctgaagctgctcaccgacttccagagccaccagctgtggacgaccctgctctccctgaccttcatcaagaccacgctgagcctcgactacgcctggaagaccatggcgatggtgctgtccatcgtcagcctgttccccctctgcctgtccaccaccagccagaagacgacctggctgcccgtgctcctgggctccttcgggtgcaagccgctgaccatgttcctcatcaccgagaacaagatctggggccgcaagagctggcccctgaacgaggggatcatggccgtgggcatcgtctccatcctgctcagcagcctgctgaagaacgacgtgcccctcgccgggcccctgatcgccggcggcatgctgatcgcgtgctacgtgatctccgggagctccgccgacctcagcctggagcgcgccgccgaggtctcctgggaggaggaggccgagcacagcggcgcgtcccacaacatcctggtggaggtgcaggacgacgggaccatgaagatcaaggacgaggagcgggacgacacgctcaccatcctgctgaaggccaccctcctggccgtcagcggcgtgtacccgatgtccatccccgccaccctgttcgtgtggtacttctggcagaagaagaagcagcgcagcggggtcctctgggacacgcccagcccgcccgaggtggagcgggccgtgctggacgacggcatctaccgcatcctgcagcggggcctgctcgggcgcagccaggtcggcgtgggggtgttccaggacggcgtcttccacaccatgtggcacgtgacccgcggggcggtgctgatgtaccagggcaagcgcctggagccctcctgggccagcgtcaagaaggacctcatctcctacggcgggggctggcggttccaggggagctggaacaccggcgaggaggtccaggtgatcgccgtcgagcccgggaagaaccccaagaacgtgcagacgacccccggcaccttcaagacccccgagggcgaggtgggggccatcgccctggacttcaagcccggcacgtccgggagccccatcgtcaaccgcgagggcaagatcgtgggcctgtacgggaacggcgtggtcaccacctccgggacctacgtgagcgcgatcgcccaggccaaggccagccaggagggcccgctccccgagatcgaggacgaggtgttcaagaagcggaacctgacgatcatggacctgcaccccgggtccggcaagacccgccggtacctcccggccatcgtccgcgaggcgatcaagcgcaagctgcggaccctgatcctcgcccccacccgcgtggtggccagcgagatggccgaggcgctgaagggcatgcccatccggtaccagacgaccgccgtcaagtccgagcacaccgggaaggagatcgtggacctgatgtgccacgccaccttcacgatgcgcctcctgagccccgtgcgggtcccgaactacaacatgatcatcatggacgaggcccacttcaccgaccccgcctccatcgcggcccgcggctacatcagcacccgggtggggatgggcgaggccgccgccatcttcatgaccgcgacgccgcccgggtccgtggaggccttcccgcagagcaacgccgtcatccaggacgaggagcgcgacatccccgagcggtcctggaacagcggctacgactggatcaccgacttccccggcaagaccgtgtggttcgtgccctccatcaagagcgggaacgacatcgccaactgcctgcgcaagaacggcaagcgggtcatccagctctcccgcaagaccttcgacacggagtaccagaagaccaagaacaacgactgggactacgtggtgaccaccgacatcagcgagatgggggccaacttccgggcggaccgcgtcatcgacccgcggcgctgcctgaagcccgtgatcctgaaggacggccccgagcgggtcatcctcgccgggcccatgccggtgacggccgcctccgcggcccagcgccggggccgcatcggccgcaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgggagaagtccgcggccatcgacggcgagtaccgcctgcgcggggaggcccgcaagaccttcgtggagctcatgcggcgcggcgacctgcccgtctggctgtcctacaaggtggccagcgagggcttccagtactccgaccggcgctggtgcttcgacggggagcggaacaaccaggtgctcgaggagaacatggacgtcgagatctggacgaaggagggcgagcgcaagaagctgcggccccgctggctggacgcccggacctacagcgaccccctcgcgctgcgcgagttcaaggagttcgccgccgggcggcgcagcgtgtccggcgacctgatcctcgagatcggcaagctgccgcagcacctgaccctccgggcccagaacgccctggacaacctggtgatgctccacaacagcgagcagggcgggaaggcgtaccgccacgccatggaggagctgcccgacaccatcgagaccctgatgctcctggccctgatcgccgtcctcaccggcggggtgaccctgttcttcctgtccgggaaggggctcggcaagaccagcatcgggctgctgtgcgtgatggcgtccagcgtcctcctgtggatggcctccgtggagccccactggatcgccgccagcatcatcctggagttcttcctcatggtgctgctgatccccgagccggaccggcagcgcacgccccaggacaaccagctcgcctacgtcgtgatcggcctgctgttcatgatcctcacggtggcggccaacgagatggggctgctggagaccaccaagaaggacctcggcatcgggcacgtcgtggccgagaaccaccaccacgccaccatgctggacatcgacctgcaccccgcctccgcgtggacgctctacgccgtggccaccaccatcatcaccccgatgatgcggcacacgatcgagaacaccaccgccaacatcagcctgaccgccatcgcgaaccaggccgccatcctgatgggcctcgacaagggctggcccatctccaagatggacatcggggtccccctgctggccctcggctgctacagccaggtgaaccccctgacgctgaccgccgcggtgctcatgctggtcgcccactacgccatcatcgggccgggcctgcaggccaaggcgacccgcgaggcccagaagcgcaccgccgccgggatcatgaagaaccccacggtggacggcatcgtggccatcgacctcgaccccgtcgtgtacgacgcgaagttcgagaagcagctgggccagatcatgctgctcatcctgtgcacctcccagatcctgctcatgcggaccacctgggccctgtgcgagagcatcacgctggccaccgggcccctcaccaccctgtgggagggctccccggggaagttctggaacacgaccatcgccgtgagcatggccaacatcttccgcggctcctacctggcgggcgccgggctcgccttcagcctgatgaagtccctgggcgggggccggcgcgggaccggcgcccagggcgagaccctcggggagaagtggaagcggcagctgaaccagctgagcaagagcgagttcaacacgtacaagcgctccggcatcatggaggtcgaccggagcgaggccaaggaggggctcaagcgcggcgagaccaccaagcacgcggtgtcccgggggaccgccaagctgcgctggttcgtggagcggaacctggtcaagcccgagggcaaggtgatcgacctgggctgcgggcgcggcgggtggagctactactgcgccggcctcaagaaggtgacggaggtcaaggggtacaccaagggcggccccgggcacgaggagcccatcccgatggccacctacggctggaacatcgtgaagctgcactccgggcgggacgtgttcttcacgccgcccgagaagtgcgacaccctgctctgcgacatcggcgagagctcccccaacccgacgatcgaggaggggcgcaccctgcgggtcctgaagatggtggagccctggctccgcggcaaccagttctgcatcaagatcctgaacccctacatgcccagcgtggtcgagaccctggagcagatgcagcggaagcacggcgggatgctcgtgcgcaacccgctgtcccggaacagcacccacgagatgtactgggtgtcctgcggcacggggaacatcgtcagcgcggtgaacatgacctcccgcatgctgctcaaccgcttcaccatggcccaccggaagcccacctacgagcgcgacgtggacctgggcgccggcacgcggcacgtcgccgtggagcccgagatcgccaacctggacatcatcgggcagcgcatcgagaacatcaagaacgagcacaagagcacctggcactacgacgaggacaacccctacaagacctgggcgtaccacggctcctacgaggtgaagccgagcgggtccgccagctccatggtcaacggcgtggtccggctcctgaccaagccctgggacgtgatccccatggtgacgcagatcgccatgaccgacaccacccccttcgggcagcagcgcgtcttcaaggagaaggtggacacgcggaccccgcgccccaagcggggcaccgcccagatcatggaggtgaccgccaagtggctgtggggcttcctcagccgcaacaagaagccccggatctgcacgcgcgaggagttcacccggaaggtccgcagcaacgcggccatcggggccgtgttcgtggacgagaaccagtggaactccgccaaggaggccgtcgaggacgagcggttctgggacctggtgcaccgcgagcgggagctgcacaagcagggcaagtgcgcgacctgcgtgtacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtcgagggggagggcctgcacaagctcgggtacatcctgcgcgacatcagcaagatcccgggcggcaacatgtacgccgacgacaccgccgggtgggacacgcgcatcaccgaggacgacctgcagaacgaggccaagatcaccgacatcatggagcccgagcacgccctcctggcgacctccatcttcaagctgacgtaccagaacaaggtggtgcgggtccagcgccccgccaagagcggcaccgtgatggacgtgatctcccggcgcgaccagcgggggagcggccaggtcggcacctacgggctcaacaccttcacgaacatggaggtgcagctgatccgccagatggagtccgagggcatcttcagcccctccgagctggggaacagcaacctcgccgagcgggtgctggactggctggagaagcacggcgtcgagcgcctcaagcggatggccatctccggggacgactgcgtggtgaagccgaccgacgaccgcttcgccaccgcgctgaccgccctgaacgacatgggcaaggtccggaaggacatcccccagtgggagcccagcaagggctggaacgactggcagcaggtccccttctgctcccaccacttccaccagctcatcatgaaggacgggcgcgagatcgtggtcccgtgccggaaccaggacgagctggtgggccgcgcccgggtgagccagggggccggctggagcctgcgcgagacggcctgcctcgggaagtcctacgcgcagatgtggcagctgatgtacttccaccggcgcgacctgcggctcgccgccaacgccatctgcagcgccgtccccgtgaactgggtgcccacctcccgcaccacctggagcatccacgcgcaccaccagtggatgaccacggaggacatgctgtccgtctggaaccgcgtgtggatcgaggagaacccctggatggaggacaagacccacgtgagctcctgggaggacgtcccgtacctgggcaagcgggaggaccagtggtgcggcagcctcatcgggctgaccgcccgcgccacctgggccacgaacatccaggtggcgatcaaccaggtgcggaagctgatcggcaacgagaactacctcgactacatgacctccatgaagcgcttcaagaacgagagcgaccccgagggggccctgtggtga

SEQ ID NO: 8951 - RNA, 9879 nt, synthetic construct
  misc_feature 1..9879: note = derived and/or modified CDS sequence (opt1) from DENV-1__HM469968__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgccctgctgacgtggctcggcctgaactcccgcagcacctccctgagcatgacctgcatcgccgtggggctcgtgaccctgtacctgggcgtcatggtgcaggcggactccgggtgcgtgatcaactggaagggccgggagctcaagtgcgggagcggcatcttcgtcacgaacgaggtgcacacctggaccgagcagtacaagttccaggccgacagcccgaagcgcctgtccgccgccatcggcaaggcctgggaggagggggtgtgcggcatccggagcgcgacccgcctggagaacatcatgtggaagcagatctccaacgagctcaaccacatcctgctggagaacgacatgaagttcaccgtcgtggtgggggacgtcgccggcatcctcgcccaggggaagaagatgatccggccccagcccatggagtacaagtacagctggaagtcctggggcaaggccaagatcatcggcgcggacgtgcagaacacgaccttcatcatcgacgggcccaacaccccggagtgccccgacgaccagcgcgcctggaacatctgggaggtggaggactacggcttcgggatcttcaccacgaacatctggctgaagctgcgggacagctacacccaggtctgcgaccaccgcctcatgtccgccgccatcaaggacagcaaggccgtgcacgcggacatgggctactggatcgagtccgagaagaacgagacctggaagctggcccgggccagcttcatcgaggtgaagacctgcatctggcccaagtcccacacgctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtggtcgacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcaccctggcggtgttcttcctgctcatcatggggcagctgacgtggaacgacctgatccgcctctgcatcatggtgggcgccaacgccagcgaccgcatggggatgggcaccacctacctggccctgatggccaccttcaagatgcggccgatgttcgcggtcggcctcctgttccgccggctgacgtcccgcgaggtgctcctgctgaccatcgggctcagcctggtggcctccgtcgagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcgtggaagaccatggccatggtgctgagcatcgtctccctcttccccctgtgcctgagcacgacctcccagaagaccacctggctccccgtgctgctgggcagcctcgggtgcaagccgctgacgatgttcctgatcgccgagaacaagatctggggccggaagtcctggcccctcaacgaggggatcatggccgtgggcatcgtcagcatcctgctgagctccctcctgaagaacgacgtgcccctggccgggcccctcatcgcgggcggcatgctgatcgcctgctacgtgatcagcgggtccagcgccgacctgtccctcgagaaggccgccgaggtcagctgggaggaggaggcggagcactccggcgccagccacaacatcctggtggaggtgcaggacgacgggaccatgaagatcaaggacgaggagcgcgacgacaccctgaccatcctcctgaaggccaccctgctcgccgtctccggcgtgtacccgctgagcatccccgccacgctgttcgtgtggtacttctggcagaagaagaagcagcggtccggggtcctctgggacacccccagcccgcccgaggtggagcgcgcggtgctggacgacggcatctaccggatcatgcagcgcggcctgctggggcggtcccaggtcggcgtgggggtgttccaggagaacgtcttccacaccatgtggcacgtgacccgcggcgccgtgctcatgtaccaggggaagcggctggagcccagctgggcctccgtcaagaaggacctgatcagctacggcggcgggtggcgcctccagggctcctggaacacgggggaggaggtccaggtgatcgccgtcgagcccggcaagaaccccaagaacgtgcagaccgcccccgggaccttcaagacccccgagggcgaggtgggcgcgatcgccctggacttcaagcccgggacgagcggctcccccatcgtcaaccgggaggggaagatcgtgggcctgtacggcaacggggtggtcaccaccagcggcacctacgtgagcgccatcgcccaggcgaaggcctcccaggaggggccgctccccgagatcgaggacgaggtgttccgcaagcggaacctgacgatcatggacctgcaccccggcagcgggaagacccgccggtacctcccggccatcgtccgcgaggccatcaagcggaagctgcgcaccctgatcctcgcccccacccgcgtggtggcgtccgagatggccgaggccctgaagggcatgcccatccggtaccagacgaccgccgtcaagagcgagcacaccggcaaggagatcgtggacctgatgtgccacgccaccttcacgatgcgcctcctgtcccccgtgcgggtcccgaactacaacatgatcatcatggacgaggcgcacttcaccgaccccagctccatcgccgcccgcgggtacatcagcacccgggtgggcatgggggaggccgccgcgatcttcatgaccgccacgccgcccggctccgtggaggccttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgcgaactgcctgcgcaagaacgggaagcgggtcatccagctctcccgcaagaccttcgacacggagtaccagaagaccaagaacaacgactgggactacgtggtgaccaccgacatcagcgagatgggcgccaacttccgggccgaccgcgtcatcgacccgcggcgctgcctgaagcccgtgatcctgaaggacgggcccgagcgggtgatcctcgccggccccatgccggtcacggtggcctccgcggcccagcgccgggggcgcatcggccggaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgcgagaagtccgcggccatcgacggggagtaccgcctgcggggcgaggcccgcaagaccttcgtcgagctcatgcggcgcggggacctgcccgtgtggctgtcctacaaggtggccagcgagggcttccagtacagcgaccggcgctggtgcttcgacggcgagcggaacaaccaggtcctcgaggagaacatggacgtggagatctggacgaaggagggggagcgcaagaagctgcggccccgctggctggacgcccggacctactccgaccccctcgcgctgcgcgagttcaaggagttcgccgccggccggcgcagcgtgtccggggacctgatcctcgagatcggcaagctgccgcagcacctgacccagcgggcccagaacgcgctcgacaacctggtcatgctgcacaacagcgagcagggcgggcgcgcctaccggcacgccatggaggagctccccgacaccatcgagacgctgatgctgctcgccctgatcgccgtgctgaccggcggggtgaccctcttcttcctgtccggccgcgggctgggcaagaccagcatcggcctcctgtgcgtcatggcgtccagcgtgctgctctggatggcctccgtggagccccactggatcgccgccagcatcatcctggagttcttcctgatggtcctcctgatccccgagccggaccggcagcgcacgccccaggacaaccagctggcctacgtggtgatcgggctcctgttcatgatcctgacggtcgcggccaacgagatgggcctcctggagaccaccaagaaggacctggggatcggccacgtggccgtggagaaccaccaccacgccgccatgctcgacgtcgacctgcaccccgcgtccgcctggaccctgtacgccgtggccacgaccatcatcaccccgatgatgcggcacaccatcgagaacacgaccgccaacatcagcctcaccgcgatcgccaaccaggccgccatcctgatggggctggacaagggctggcccatctccaagatggacatcggcgtgcccctcctggcgctggggtgctacagccaggtcaaccccctcaccctgacggccgccgtgctgatgctcgtggcccactacgccatcatcggcccggggctgcaggcgaaggccacccgcgaggcccagaagcgcaccgccgccggcatcatgaagaaccccaccgtcgacgggatcgtggcgatcgacctggaccccgtggtctacgacgccaagttcgagaagcagctcggccagatcatgctgctgatcctctgcacgtcccagatcctgctgatgcggaccacctgggccctctgcgagagcatcaccctggccacgggccccctgaccaccctctgggaggggtccccgggcaagttctggaacaccacgatcgccgtgagcatggcgaacatcttccgcgggtcctacctggccggcgccggcctggccttcagcctcatgaagtccctcgggggcgggcggcgcgggaccggggcgcagggcgagaccctgggcgagaagtggaagcggcagctcaaccagctgtccaagagcgagttcaacacctacaagcgctccgggatcatggaggtggaccggagcgaggccaaggagggcctgaagcgcggggagacgaccaagcacgccgtctcccggggcaccgccaagctccgctggttcgtggagcggaacctggtgaagcccgaggggaaggtcatcgacctgggctgcggccgcgggggctggagctactactgcgccgggctgaagaaggtgaccgaggtgaagggctacacgaagggcgggcccggccacgaggagcccatcccgatggcgacctacgggtggaacctcgtcaagctgcactccggcaaggacgtgttcttcatcccgcccgagaagtgcgacaccctgctctgcgacatcggggagagctcccccaacccgaccatcgaggagggccggacgctgcgcgtgctgaagatggtcgagccctggctccgggggaaccagttctgcatcaagatcctgaacccctacatgcccagcgtggtggagaccctggagcagatgcagcgcaagtacggcggcatgctcgtccggaacccgctgtcccgcaacagcacccacgagatgtactgggtgtcctgcgggaccggcaacatcgtgagcgccgtcaacatgacctcccggatgctgctcaaccgcttcacgatggcccaccgcaagcccacctacgagcgggacgtggacctgggggccggcacccgccacgtggccgtcgagcccgaggtggcgaacctggacatcatcggccagcggatcgagaacatcaagcacgagcacaagagcacctggcactacgacgaggacaacccctacaagacgtgggcctaccacgggtcctacgaggtgaagccgagcggctccgccagcagcatggtcaacggggtggtcaagctcctgaccaagccctgggacgtgatccccatggtgacccagatcgccatgaccgacacgacccccttcggccagcagcgcgtcttcaaggagaaggtggacacccggaccccgaaggccaagcgcgggacggcgcagatcatggaggtgaccgcccggtggctgtggggcttcctctcccgcaacaagaagccccggatctgcacccgcgaggagttcacccggaaggtccgcagcaacgccgccatcggcgcggtgttcgtggacgagaaccagtggaactccgccaaggaggccgtcgaggacgagcggttctgggacctggtgcaccgcgagcgggagctgcacaagcaggggaagtgcgccacgtgcgtgtacaacatgatgggcaagcgcgagaagaagctcggggagttcggcaaggccaaggggagccgggcgatctggtacatgtggctgggcgcccgcttcctggagttcgaggccctcggcttcatgaacgaggaccactggttctcccgggagaacagcctgtccggggtcgagggcgaggggctgcacaagctcggctacatcctgcgcgacatcagcaagatccccgggggcaacatgtacgccgacgacaccgccggctgggacacccggatcaccgaggacgacctgcagaacgaggcgaagatcacggacatcatggagccggagcacgccctcctggccaaggccatcttcaagctgacctaccagaacaaggtggtgcgcgtccagcgccccgccaagaacgggaccgtgatggacgtgatctcccggcgcgaccagcggggcagcgggcaggtcggcacctacggcctcaacacgttcaccaacatggaggcgcagctgatccgccagatggagtccgaggggatcttcctgcccagcgagctcgagacccccaacctggccgagcgggtgctggactggctcgagaagtacggcgtggagcgcctgaagcggatggccatctccggggacgactgcgtcgtgaagccgatcgacgaccgcttcgccaccgccctgacggcgctcaacgacatgggcaaggtgcggaaggacatcccccagtgggagcccagcaaggggtggaacgactggcagcaggtccccttctgctcccaccacttccaccagctgatcatgaaggacggccgcgagatcgtggtgccgtgccggaaccaggacgagctggtcggccgcgcccgggtgagccagggggccggctggtccctccgcgagaccgcctgcctgggcaagagctacgcgcagatgtggcagctgatgtacttccaccggcgcgacctccggctggccgccaacgccatctgcagcgccgtgcccgtcgactgggtgcccacctcccgcaccacgtggagcatccacgcgcaccaccagtggatgaccaccgaggacatgctgtccgtgtggaaccgggtctggatcgaggagaacccctggatggaggacaagacccacatcagctcctgggaggacgtgccgtacctcggcaagcgcgaggaccagtggtgcgggagcctgatcggcctgacggcccgcgccacctgggccaccaacatccaggtggccatcaaccaggtccggcgcctcatcggcaacgagaactacctggactacatgacctccatgaagcggttcaagaacgagagcgaccccgagggggcgctgtggtga

SEQ ID NO: 8952 - RNA, 9879 nt, synthetic construct
  misc_feature 1..9879: note = derived and/or modified CDS sequence (opt1) from DENV-1__KC172834__SS-prME
  source 1..9879: mol_type = other RNA
agcgtgaccatgctgctgatgctgatgcccaccgccctggccttccacctcaccacccggggcggggagccccacatgatcgtcagcaagcaggagcggggcaagagcctgctgttcaagacctccgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtcacctacgggacctgcagccaggccggcgagcaccggcgggacaagcggtccgtggccctcgcgccccacgtgggcctggggctggagacccggacggagacctggatgagctccgagggcgcctggaagcagatccagcgggtcgagacctgggccctccgccaccccgggttcaccgtgatcgcgctgttcctggcccacgccatcggcacgagcatcacccagaaggggatcatcttcatcctcctgatgctggtgaccccctccatggccatgcggtgcgtcggcatcggcagccgcgacttcgtggaggggctctccggcgccacctgggtggacgtcgtgctggagcacgggagctgcgtgacgaccatggcgaaggacaagcccaccctggacatcgagctcctgaagaccgaggtcacgaaccccgccgtgctgcggaagctctgcatcgaggccaagatctccaacaccaccaccgacagccgctgccccacgcagggcgaggccaccctggtggaggagcaggacgccaacttcgtctgccggcgcaccttcgtggaccggggctgggggaacggctgcgggctgttcggcaaggggtccctcctgacctgcgcgaagttcaagtgcgtgacgaagctggagggcaagatcgtccagtacgagaacctcaagtacagcgtgatcgtgaccgtccacaccggcgaccagcaccaggtggggaacgagtccaccgagcacggcacgaccgccaccatcacgccccaggcccccaccacggagatccagctgaccgactacggggccctgaccctcgactgcagcccccgcaccggcctggacttcaacgagatggtcctgctcacgatgaaggagaagtcctggctggtgcacaagcagtggttcctggacctcccgctgccctggaccagcggggccagcacctcccaggagacctggaaccggcaggacctgctcgtgacgttcaagaccgcgcacgccaagaagcaggaggtcgtggtgctgggcagccaggagggcgccatgcacaccgccctgaccggggccacggagatccagacctccggcaccaccacgatcttcgcggggcacctcaagtgccgcctgaagatggacaagctgaccctcaagggcatgagctacgtcatgtgcaccgggtccttcaagctggagaaggaggtggccgagacccagcacggcacggtgctggtccagatcaagtacgagggcaccgacgccccctgcaagatccccttcagcacccaggacgagaagggggtgacccagaacggccggctgatcacggccaacccgatcgtgaccgacaaggagaagcccgtcaacatcgaggcggagccgcccttcggggagtcctacatcgtgatcggcgccggcgagaaggccctcaagctgagctggttcaagaaggggtccagcatcggcaagatgttcgaggccaccgcccgcggggcgcggcgcatggccatcctgggcgacaccgcctgggacttcgggtccatcggcggcgtgttcacgagcgtcgggaagctcgtgcaccagatcttcggcaccgcctacggggtgctgttctccggcgtcagctggaccatgaagatcgggatcggcgtgctgctcacctggctgggcctgaactcccgcagcacgtccctcagcatgacctgcatcgccgtggggctggtcaccctgtacctcggcgtgatggtgcaggcggactccgggtgcgtcatcaactggaagggccgggagctgaagtgcgggagcggcatcttcgtgaccaacgaggtgcacacgtggaccgagcagtacaagttccaggccgacagcccgaagcgcctgtccgccgccatcggcaaggcctgggaggagggggtctgcggcatccggagcgcgacccgcctcgagaacatcatgtggaagcagatctccaacgagctgaaccacatcctgctcgagaacgacatgaagttcaccgtggtggtcggggacgtggccggcatcctggcccaggggaagaagatgatccggccccagcccatggagtacaagtacagctggaagtcctggggcaaggccaagatcatcggcgcggacgtgcagaacagcaccttcatcatcgacgggcccaacacgccggagtgccccgacgaccagcgcgcctggaacatctgggaggtcgaggactacggcttcgggatcttcaccaccaacatctggctgaagctccgggactcctacacccaggtgtgcgaccaccgcctgatgagcgccgccatcaaggactccaaggccgtgcacgcggacatgggctactggatcgagagcgagaagaacgagacgtggaagctggcccgggcctccttcatcgaggtcaagacctgcatctggcccaagagccacaccctctggtccaacggcgtgctggagagcgagatgatcatccccaagatctacgggggcccgatctcccagcacaactaccgccccgggtacttcacccagacggccggcccctggcacctggggaagctcgagctggacttcgacctgtgcgagggcaccaccgtggtcgtggacgagcactgcggcaaccgggggccgagcctccgcaccacgaccgtgaccggcaagatcatccacgagtggtgctgccggtcctgcaccctgccgcccctgcgcttccgcggggaggacggctgctggtacgggatggagatccgccccgtcaaggagaaggaggagaacctcgtgaagtccatggtgagcgccggctccggcgaggtcgacagcttctccctggggctgctctgcatcagcatcatgatcgaggaggtgatgcggtcccgctggagccggaagatgctgatgacgggcaccctggcggtgttcttcctcctgatcatggggcagctgacctggaacgacctcatccgcctgtgcatcatggtcggcgccaacgcctccgaccgcatggggatgggcaccacgtacctggccctcatggccaccttcaagatgcggccgatgttcgcggtgggcctgctgttccgccggctcaccagccgcgaggtgctgctgctcaccatcgggctgtccctggtcgccagcgtggagctccccaactccctggaggagctgggcgacgggctcgccatgggcatcatgatcctgaagctgctcacggacttccagagccaccagctgtgggccaccctgctctccctgaccttcatcaagaccacgttcagcctgcactacgcgtggaagaccatggccatggtcctctccatcgtgagcctgttccccctgtgcctctccaccaccagccagaagacgacctggctgcccgtgctgctcggctccctggggtgcaagccgctgaccatgttcctcatcgccgagaacaagatctggggccgcaagagctggcccctgaacgaggggatcatggccgtcggcatcgtgagcatcctgctctccagcctgctgaagaacgacgtgcccctcgccgggcccctgatcgcgggcggcatgctgatcgcctgctacgtcatctccgggagctccgccgacctcagcctggagaaggccgccgaggtgtcctgggaggaggaggcggagcacagcggcgcctcccacaacatcctggtggaggtccaggacgacgggaccatgaagatcaaggacgaggagcgcgacgacacgctcaccatcctgctgaaggccaccctcctggccgtgagcggcgtgtacccgctgtccatccccgccaccctcttcgtctggtacttctggcagaagaagaagcagcggagcggggtgctgtgggacacccccagcccgcccgaggtggagcgcgcggtcctggacgacggcatctaccggatcatgcagcgcggcctgctcgggcggagccaggtgggcgtgggggtcttccaggagaacgtgttccacacgatgtggcacgtgacccgcggcgccgtcctgatgtaccaggggaagcggctggagccctcctgggccagcgtgaagaaggacctcatctcctacggcggcgggtggcgcttccagggcagctggaacaccggggaggaggtgcaggtcatcgccgtggagcccggcaagaaccccaagaacgtgcagaccgcccccgggacgttcaagacccccgagggcgaggtcggcgcgatcgccctggacttcaagcccgggacctccggcagccccatcgtgaaccgggaggggaagatcgtgggcctgtacggcaacggggtcgtgaccacgagcggcacctacgtgtccgccatcgcccaggcgaaggccagccaggaggggccgctccccgagatcgaggacgaggtcttccgcaagcggaacctgaccatcatggacctgcaccccggctccgggaagacccgccggtacctcccggccatcgtgcgcgaggccatcaagcggaagctgcgcacgctgatcctcgcccccacccgcgtggtcgcgagcgagatggccgaggccctgaagggcatgcccatccggtaccagaccaccgccgtgaagtccgagcacacgggcaaggagatcgtggacctgatgtgccacgccaccttcaccatgcgcctcctgagccccgtccgggtgccgaactacaacatgatcatcatggacgaggcgcacttcaccgacccctccagcatcgccgcccgcgggtacatctccacgcgggtgggcatgggggaggccgccgcgatcttcatgaccgccacgccgcccggcagcatggaggccttcccgcagtccaacgccgtcatccaggacgaggagcgcgacatccccgagcggagctggaacctggggcacgagtggatcaccgacttccccggcaagacggtgtggttcgtgccctccatcaaggcgggcaacgacatcgccaactgcctccgcaagaacgggaagcgggtcatccagctgagccgcaagaccttcgacaccgagtaccagaagaccaagaacaacgactgggactacgtggtgacgaccgacatctccgagatgggcgccaacttccgggccgaccgcgtcatcgacccgcggcgctgcctgaagcccgtgatcctcaaggacgggcccgagcgggtgatcctggccggccccatgccggtcaccgtggcgagcgccgcccagcgccgggggcgcatcggccggaaccacaacaaggagggcgaccagtacatctacatggggcagcccctgaacaacgacgaggaccacgcccactggaccgaggccaagatgctcctggacaacatcaacacgcccgagggcatcatccccgcgctgttcgagccggagcgcgagaagtccgccgccatcgacggggagtaccgcctccggggcgaggcccgcaagaccttcgtcgagctgatgcggcgcggggacctgcccgtgtggctcagctacaaggtggcctccgagggcttccagtacagcgaccggcgctggtgcttcgacggcgagcggaacaaccaggtcctggaggagaacatggacgtggagatctggaccaaggagggggagcgcaagaagctgcggccccgctggctcgacgcgcggacctacagcgaccccctggccctgcgcgagttcaaggagttcgccgccggccggcgctccgtgagcggggacctcatcctggagatcggcaagctgccgcagcacctcacgcagcgggcgcagaacgccctggacaacctggtcatcctccacaactccgagcagggcgggcgcgcctaccggcacgccatggaggagctgcccgacaccatcgagaccctgatgctcctggccctgatcgcggtgctcaccggcggggtgacgctgttcttcctgagcggcaaggggctcggcaagacctccatcggcctgctgtgcgtcatggccagctccgtgctcctgtggatggccagcgtggagccccactggatcgccgcctccatcatcctggagttcttcctcatggtcctgctgatccccgagccggaccgccagcggacgccccaggacaaccagctcgcgtacgtggtgatcgggctgctgttcatgatcctcaccgtcgccgccaacgagatgggcctgctggagaccacgaagaaggacctcgggatcggccacgtggccgtggagaaccaccaccacgccgcgatgctggacgtcgacctgcaccccgccagcgcctggaccctctacgccgtggccaccaccatcatcacgccgatgatgcgccacaccatcgagaacaccaccgcgaacatctccctgacggccatcgccaaccaggccgcgatcctgatggggctcgacaagggctggcccatcagcaagatggacatcggcgtgcccctgctggccctcgggtgctactcccaggtcaaccccctgaccctgaccgccgccgtgctcatgctggtggcccactacgcgatcatcggcccggggctgcaggccaaggccacccgggaggcccagaagcgcacggccgcgggcatcatgaagaaccccaccatcgacgggatcgtcgccatcgacctcgaccccgtggtgtacgacgccaagttcgagaagcagctgggccagatcatgctgctcatcctgtgcaccagccagatcctgctcatgcgcaccacgtgggccctgtgcgagtccatcaccctggccaccggccccctcaccacgctgtgggaggggagcccgggcaagttctggaacaccaccatcgcggtctccatggccaacatcttccgggggagctacctggccggcgccggcctcgcgttctccctgatgaagtccctcgggggcgggcgccgggggaccggggcccagggcgagacgctcggcgagaagtggaagcgccagctgaaccagctgagcaagtccgagttcaacacctacaagcggagcgggatcatggaggtggaccgctccgaggccaaggagggcctcaagcgcggggagaccaccaagcacgccgtgagccgcggcacggccaagctgcggtggttcgtcgagcgcaacctggtgaagcccgaggggaaggtgatcgacctgggctgcggccgcgggggctggtcctactactgcgcggggctcaagaaggtcaccgaggtgaagggctacaccaagggcggccccggccacgaggagcccatcccgatggccacctacgggtggaacctggtgaagctgcacagcggcaaggacgtcttcttcgtgccgcccgagaagtgcgacacgctcctgtgcgacatcggggagtccagccccaacccgaccatcgaggagggccgcaccctgcgggtgctcaagatggtcgagccctggctgcgcgggaaccagttctgcatcaagatcctgaacccctacatgccctccgtggtggagaccctcgagcagatgcagcggaagcacggcggcatgctggtccgcaacccgctgagccggaactccacgcacgagatgtactgggtgagctgcgggaccggcaacatcgtgtccgccgtcaacatgaccagccgcatgctcctgaaccggttcaccatggcccaccgcaagcccacctacgagcgcgacgtggacctgggggccggcacgcggcacgtggcggtcgagcccgaggtggccaacctcgacatcatcggccagcgcatcgagaacatcaagcacgagcacaagtccacctggcactacgacgaggacaacccctacaagacctgggcctaccacgggagctacgaggtgaagccgtccggcagcgcctccagcatggtcaacggggtggtcaagctgctgaccaagccctgggacgtgatccccatggtgacgcagatcgccatgaccgacaccacccccttcggccagcagcgggtcttcaaggagaaggtggacacgcgcaccccgaaggcgaagcgggggaccgcccagatcatggaggtgaccgcccgctggctctggggcttcctgagccggaacaagaagccccgcatctgcacgcgggaggagttcacccgcaaggtccggtccaacgccgcgatcggcgccgtgttcgtggacgagaaccagtggaacagcgccaaggaggccgtcgaggacgaccgcttctgggacctggtgcaccgggagcgcgagctccacaagcaggggaagtgcgcgacctgcgtgtacaacatgatgggcaagcgggagaagaagctgggggagttcggcaaggcgaaggggtcccgcgccatctggtacatgtggctgggcgcccggttcctcgagttcgaggccctgggcttcatgaacgaggaccactggttcagccgcgagaactccctgagcggggtcgagggcgaggggctccacaagctgggctacatcctgcgggacatctccaagatccccgggggcaacatgtacgccgacgacaccgcgggctgggacacgcgcatcaccgaggacgacctccagaacgaggccaagatcaccgacatcatggagccggagcacgccctgctggccaagagcatcttcaagctcacctaccagaacaaggtggtgcgggtccagcgccccgccaagaacgggacggtgatggacgtgatctcccgccgggaccagcgcggcagcgggcaggtcggcacctacggcctgaacaccttcaccaacatggaggcgcagctgatccggcagatggagtccgaggggatcttcagccccaacgagctcgagacgcccaacctggccgagcgcgtgctggactggctcgagaagtacggcgtggagcggctgaagcgcatggccatctccggggacgactgcgtcgtgaagccgatcgacgaccggttcgccaccgccctgaccgcgctcaacgacatgggcaaggtgcgcaaggacatcccccagtgggagcccagcaaggggtggaacgactggcagcaggtccccttctgctcccaccacttccaccagctgatcatgaaggacggccgggagatcgtggtgccgtgccgcaaccaggacgagctggtcggccgggcccgcgtgagccagggggccggctgggggctccgggagaccgcctgcctgggcaagtcctacgcgcagatgtggcagctgatgtacttccaccgccgggacctccgcctggccgccaacgccatctgcagcgccgtgcccgtcgactgggtgcccacgagccggaccacctggtccatccacgcgcaccaccagtggatgaccacggaggacatgctgagcgtgtggaaccgcgtctggatcgaggagaacccctggatggaggacaagacccggatctccagctgggaggacgtgccgtacctcgggaagcgcgaggaccagtggtgcggctccctgatcggcctgaccgcccgcgccacctgggccacgaacatccaggtggccatcaaccaggtccggcgcctcatcgggaacgagaactacagcgactacatgacctccatgaagcggttcaagaacgagagcgagcccgagggcgcgctgtggtga

SEQ ID NO: 8953 - RNA, 9879 nt, synthetic construct
  misc_feature 1..9879: note = derived and/or modified CDS sequence (opt1) from DENV-1__KJ933413__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcaccggggtgaacatgtgcaccctgatcgcgatggacctgggcgagctctgcgaggacaccatgacctacaagtgcccccgcatcaccgagaccgagcccgacgacgtggactgctggtgcaacgccaccgagacctgggtgacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtggagacctgggcgctgcgccaccccgggttcaccgtgatcgccctgttcctcgcccacgccatcggcaccagcatcacgcagaaggggatcatcttcatcctgctgatgctcgtgaccccctccatggcgatgcggtgcgtcggcatcggcaaccgcgacttcgtggaggggctgagcggcgccacctgggtggacgtcgtgctggagcacgggtcctgcgtgaccacgatggccaaggacaagcccaccctcgacatcgagctgctgaagaccgaggtcaccaaccccgccgtgctccggaagctgtgcatcgaggccaagatcagcaacacgaccaccgactcccgctgccccacccagggcgaggcgacgctggtggaggagcaggacaccaacttcgtctgccggcgcaccctcgtggaccggggctgggggaacggctgcgggctgttcggcaaggggagcctgatcacgtgcgccaagttcaagtgcgtgacgaagctcgagggcaagatcgtccagtacgagaacctgaagtactccgtgatcgtgaccgtccacaccggcgaccagcaccaggtggggaacgagaccaccgagcacggcacgaccgccaccatcacgccccaggcccccacgagcgagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggacctccggggcgagcaccagccaggagacctggaaccggcaggacctcctggtgacgttcaagaccgcccacgccaagaagcaggaggtcgtggtgctgggctcccaggagggcgccatgcacaccgccctcaccggggcgacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggccgagacccagcacggcacggtcctggtccaggtgaagtacgagggcaccgacgccccctgcaagatccccttcacctcccaggacgagaagggggtcacccagaacggccggctcatcacggccaacccgatcgtgaccgacaaggagaagcccgtgaacatcgaggcggagccgcccttcggggagagctacctggtcgtgggcgccggcgagaaggccctgaagctctcctggttcaagaaggggagctccatcggcaagatgttcgaggccaccgcgcgcggggcccggcgcatggccatcctgggcgacaccgcctgggacttcgggagcatcggcggcgtgttcacgtccgtcgggaagctgatccaccagatcttcggcaccgcctacggggtcctgttcagcggcgtgtcctggaccatgaagatcgggatcggcatcctgctgacctggctcggcctgaacagccgctccacgagcctgtccatgacctgcatcgcggtcgggatggtgaccctctacctgggcgtgatggtccaggccgacagcgggtgcgtgatcaactggaagggccgggagctgaagtgcgggtccggcatcttcgtgaccaacgaggtccacacctggacggagcagtacaagttccaggccgacagcccgaagcgcctcagcgccgccatcggcaaggcgtgggaggagggggtgtgcggcatccggtccgtgacccgcctggagaacatcatgtggaagcagatcagcaacgagctgaaccacatcctcctggagaacgacatgaagttcaccgtcgtggtgggggacgtcaacggcatcctggcccaggggaagaagatgatccggccccagcccatggagcacaagtactcctggaagtcctggggcaaggccaaggtgatcggcgccgacgtgcagaactccaccttcatcatcgacgggcccaacacgccggagtgccccgacgaccagcgcgcctggaacatctgggaggtcgaggactacggcttcgggatcttcaccaccaacatctggctcaagctgcgggacagctacacccaggtgtgcgaccaccgcctgatgtccgcggccatcaaggacagcaaggccgtgcacgccgacatgggctactggatcgagtccgagaagaacgagacgtggaagctcacccgggcgagcttcatcgaggtcaagacctgcgtgtggcccaagtcccacaccctgtggagcaacggcgtgctggagtccgagatgatcatccccaagatctacgggggcccgatcagccagcacaactaccgccccgggtacttcacgcagaccgccggcccctggcacctcgggaagctggagctggacttcggcctctgcgagggcaccaccgtcgtggtggacgagcactgcgggaaccggggcccgtccctgcgcacgaccaccgtcaccgggaagatcatccacgagtggtgctgccggagctgcacgctgccgcccctccgcttcaagggcgaggacgggtgctggtacggcatggagatccggcccgtgaaggagaaggaggagaacctggtgaagtccatggtcagcgccggcagcggggaggtggactccttcagcctgggcctcctgtgcatctccatcatgatcgaggaggtgatgcgcagccggtggtcccgcaagatgctgatgaccgggaccctcgccgtcttcctgctgctcatcatgggccagctgacctggaacgacctgatccggctctgcatcatggtgggggccaacgcgagcgacaagatgggcatgggcacgacctacctggccctgatggccaccttccgcatgcgcccgatgttcgccgtcgggctcctgttccggcgcctgacctcccgggaggtgctcctgctgacggtggggctcagcctggtcgcctccgtggagctgcccaacagcctcgaggagctgggggacggcctggccatgggcatcatgatgctcaagctgctgaccgacttccagtcccaccagctctgggccgccctgctgagcctcaccttcgtgaagaccacgttctccctgcactacgcctggaagaccatggccatgatcctgagcatcgtctccctcttccccctgtgcctgagcaccacctcccagaagacgacctggctccccgtgctgctggggagcctcggctgcaagccgctgaccatgttcctgatcaccgagaaccgcatctgggggcggaagtcctggcccctcaacgagggcatcatggcggtggggatcgtcagcatcctgctgagctccctcctgaagaacgacgtgcccctggccggccccctcatcgccggcgggatgctgatcgcctgctacgtgatcagcggctccagcgcggacctgtccctcgagaaggccgccgaggtcagctgggaggaggaggccgagcactccggggccagccacaacatcctggtggaggtgcaggacgacggcaccatgaagatcaaggacgaggagcgcgacgacacgctgaccatcctcctgaaggcgaccctgctcgccatctccggggtctacccgatgagcatccccgccaccctgttcgtgtggtacttctggcagaagaagaagcagcggtccggcgtgctgtgggacacgcccagcccgcccgaggtcgagcgcgccgtgctggacgacggcatctaccggatcctccagcgcgggctgctgggcaagtcccaggtgggggtcggcgtgttccaggagggggtgttccacaccatgtggcacgtcacccggggcgccgtgctcatgtaccagggcaagcgcctggagcccagctgggcgtccgtgaagaaggacctgatcagctacgggggcgggtggcggttccagggctcctggaacaccggggaggaggtccaggtgatcgccgtggagcccggcaagaaccccaagaacgtccagacggcccccggcaccttcaagacccccgagggggaggtgggcgccatcgccctcgacttcaagcccgggaccagcggctcccccatcgtgaaccgcgagggcaagatcgtcgggctgtacggcaacggggtggtgacgaccagcggcacctacgtcagcgcgatcgcccaggccaaggcctcccaggaggggccgctgcccgagatcgaggacgaggtgttccggaagcgcaacctcaccatcatggacctgcaccccggcagcggcaagacgcggcgctacctgccggccatcgtgcgggaggcgatcaagcgcaagctccggaccctggtcctggcccccacccgcgtggtggcctccgagatggccgaggcgctcaaggggatgcccatccgctaccagaccacggccgtcaagagcgagcacaccggcaaggagatcgtggacctgatgtgccacgccaccttcaccatgcggctgctctcccccgtgcgcgtcccgaactacaacatgatcatcatggacgaggcccacttcacggaccccgccagcatcgcggcccgggggtacatctccacccgcgtgggcatgggggaggccgccgccatcttcatgaccgcgacgccgcccggcagcatggaggccttcccgcagtccaacgccgccatccaggacgaggagcgggacatccccgagcgcagctggaactccggctacgactggatcacggacttccccgggaagaccgtgtggttcgtccccagcatcaagtccggcaacgacatcgccaactgcctgcggaagaacgggaagcgcgtggtgcagctgagccggaagaccttcgacaccgagtaccagaagacgaagaacaacgactgggactacgtcgtgaccaccgacatctccgagatgggcgcgaacttccgcgccgaccgggtcatcgacccgcgccggtgcctcaagcccgtgatcctgaaggacgggcccgagcgcgtgatcctggccggccccatgccggtcaccgtggccagcgcggcccagcggcgcggccggatcgggcgcaaccagaacaaggagggcgaccagtacatctacatggggcagcccctcaacaacgacgaggaccacgcccactggacggaggccaagatgctgctggacaacatcaacacccccgagggcatcatccccgccctcttcgagccggagcgggagaagtccgcggccatcgacggggagtaccgcctgcgcggcgaggcccggaagaccttcgtggagctgatgcgccggggcgacctccccgtctggctgagctacaaggtggcctccgaggggttccagtacagcgaccgccggtggtgcttcgacggcgagcgcaacaaccaggtgctggaggagaacatggacgtcgagatctggaccaaggagggggagcggaagaagctccgcccccggtggctggacgcccgcacgtacagcgaccccctggcgctccgggagttcaaggagttcgccgccggccgccggtccgtgagcggcgacctgatcctggagatcgggaagctcccgcagcacctgacccagcgcgcccagaacgccctggacaacctcgtgatgctgcacaactccgagcagggcgggaaggcgtaccggcacgccatggaggagctgcccgacaccatcgagaccctcatgctgctggccctcatcgccgtcctgaccggcggggtgacgctgttcttcctcagcggccgcggcctggggaagacctccatcggcctgctctgcgtgatggcgagctccgccctgctgtggatggccagcgtcgagccccactggatcgccgcctccatcatcctcgagttcttcctgatggtgctgctcatccccgagccggaccggcagcgcacgccccaggacaaccagctggcgtacgtggtcatcgggctcctcttcatgatcctgaccgtggccgccaacgagatgggcctgctcgagacgaccaagaaggacctggggatcggccacgtggccgccgagagccaccaccacgcggccatgctggacgtcgacctccaccccgcctccgcctggaccctgtacgccgtggcgaccacggtgatcaccccgatgatgcggcacaccatcgagaacaccacggccaacatcagcctgaccgccatcgccaaccaggccgcgatcctcatgggcctggacaaggggtggcccatctccaagatggacatcggcgtccccctgctcgccctggggtgctacagccaggtgaaccccctgaccctcaccgccgccgtgctgatgctggtcgcgcactacgccatcatcggcccggggctccaggccaaggccacgcgcgaggcccagaagcggaccgcggccggcatcatgaagaaccccaccgtggacggcatcgtggccatcgacctggaccccgtcgtgtacgacgccaagttcgagaagcagctggggcagatcatgctcctgatcctgtgcacctcccagatcctcctgatgcgcacgacctgggccctgtgcgagagcatcaccctcgcgaccggccccctgacgaccctgtgggaggggtccccgggcaagttctggaacaccaccatcgccgtgagcatggccaacatcttccgcggctcctacctcgccggggccggcctggcgttcagcctgatgaagtccctcgggggcgggcggcgcggcacgggcgcccagggggagaccctgggcgagaagtggaagcggcagctgaaccagctctccaagagcgagttcaacacctacaagcgctccgggatcatcgaggtcgaccggagcgaggccaaggagggcctgaagcgcggggagaccacgaagcacgccgtgtcccggggcaccgcgaagctgcgctggttcgtggagcggaacctggtcaagcccgagggcaaggtgatcgacctcgggtgcggccgcgggggctggagctactactgcgccgggctgaagaaggtgaccgaggtcaagggctacaccaagggcgggcccggccacgaggagcccatcccgatggccacgtacgggtggaacctggtgaagctccactccggcaaggacgtgttcttcacgccgcccgagaagtgcgacaccctgctgtgcgacatcggggagagctcccccaacccgaccatcgaggagggccggaccctccgcgtcctgaagatggtggagccctggctgcggggcaaccagttctgcatcaaggtgctcaacccctacatgcccagcgtcgtggagacgctggagcagatgcagcgcaagcacgggggcatgctggtgcggaacccgctctcccgcaacagcacccacgagatgtactgggtctcctgcgggaccggcaacatcgtgagcgccgtgaacatgacctcccggatgctgctgaaccgcttcacgatggcccaccggaagcccacctacgagcgcgacgtcgacctcggcgcggggacccgccacgtggccgtcgagcccgaggtggccaacctggacatcatcggccagcggatcgagaacatcaagaacgagcacaagagcacctggcactacgacgaggacaacccctacaagacgtgggcctaccacgggtcctacgaggtgaagccgagcggctccgccagcagcatggtcaacggggtggtgcgcctgctcaccaagccctgggacgtcatccccatggtgacccagatcgcgatgaccgacacgacccccttcggccagcagcgggtgttcaaggagaaggtcgacacccgcaccccgaaggccaagcggggcacggcccagatcatggaggtgaccgcccgctggctgtgggggttcctgtcccggaacaagaagccccgcatctgcacccgggaggagttcaccaagaaggtgcgcagcaacgccgcgatcggcgccgtcttcgtggacgagaaccagtggaactccgccaaggaggccgtggaggacgagcggttctgggacctcgtccaccgcgagcgggagctgcacaagcaggggaagtgcgcgacgtgcgtgtacaacatgatgggcaagcgcgagaagaagctgggggagttcggcaaggccaagggcagccgggccatctggtacatgtggctcggggcccgcttcctggagttcgaggccctgggcttcatgaacgaggaccactggttctcccgggagaacagcctctccggggtggagggcgaggggctgcacaagctgggctacatcctccgcgacatcagcaagatccccggcgggaacatgtacgcggacgacaccgccggctgggacacccggatcaccgaggacgacctgcagaacgaggccaagatcacggacatcatggagccggagcacgccctgctcgccacctccatcttcaagctgacctaccagaacaaggtcgtgcgcgtgcagcggcccgcgaagaacgggaccgtcatggacgtgatcagccgccgcgaccagcggggctccggccaggtggggacgtacggcctgaacaccttcaccaacatggaggcccagctcatccgccagatggagagcgaggggatcttcctgccctccgagctggagacccccaacctcgccgagcgggtcctggactggctggagaagtacggcatcgagcgcctcaagcggatggccatcagcggggacgactgcgtggtgaagccgatcgacgaccgcttcgccacggcgctgaccgccctgaacgacatgggcaaggtccggaaggacatcccccagtgggagccctccaagggctggaacgactggcagcaggtccccttctgcagccaccacttccaccagctcatcatgaaggacgggcgcgagatcgtggtcccgtgccggaaccaggacgagctggtgggccgcgcccgggtgtcccagggggccggctggagcctgcgcgagaccgcctgcctcggcaagagctacgcgcagatgtggcagctgatgtacttccaccggcgcgacctgcggctcgccgccaacgccatctgctccgcggtccccgtggactgggtgcccaccagccgcacgacctggtccatccacgcccaccaccagtggatgaccaccgaggacatgctgagcgtctggaaccgggtgtggatcgaggagaacccctggatggaggacaagacccacgtgtccagctgggaggacgtcccgtacctgggcaagcgcgaggaccagtggtgcggctccctcatcgggctgacggcccgggccacctgggccaccaacatccaggtggcgatcaaccaggtgcgccgcctgatcggcaacgagaactacctcgactacatgaccagcatgaagcggttcaagaacgagtccgaccccgagggggccctgtggtga

SEQ ID NO: 8954 - RNA, 9879 nt, synthetic construct
  misc_feature 1..9879: note = derived and/or modified CDS sequence (opt1) from DENV-1__KU666942__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgcccgacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgcccctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctcttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccaccgccatcggcaaggcctgggaggagggggtgtgcggcatccggagcgccacccgcctggagaacatcatgtggaagcagatctccaacgagctcaaccacatcctgctggagaacgggatgaagttcacggtcgtggtgggcgacgtcgccgggatcctcgcgcagggcaagaagatgatccggccccagcccatggagcacaagtacagctggaagtcctggggcaaggccaagatcatcggggccgacgtgcagaacaccaccttcatcatcgacggccccaacaccccggagtgccccgacgaccagcgcgcctggaacatctgggaggtggaggactacgggttcggcatcttcacgaccaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggggtcctcgagtccgagatgatcatccccaagatctacggcgggccgatcagccagcacaactaccgccccggctacttcacccagaccgccgggccctggcacctgggcaagctggagctcgacttcgacctgtgcgagggcacgaccgtggtggtcgacgagcactgcgggaaccggggcccgtccctgcgcaccaccacggtgaccgggaagatcatccacgagtggtgctgccggagctgcaccctgccgcccctccgctaccggggcgaggacgggtgctggtacggcatggagatccgccccgtgaaggagaaggaggagaacctggtcaagtccatggtgagcgccggcagcggggaggtggactccttcagcctcggcctgctgtgcatctccatcatgatcgaggaggtcatgcggagccgctggtcccggaagatgctcatgaccgggacgctggccgtgttcttcctgctcatcatgggccagctgacctggaacgacctgatccgcctctgcatcatggtgggggccaacgcgagcgaccgcatgggcatgggcaccacctacctggccctgatggccacgttcaagatgcggccgatgttcgccgtcgggctcctgttccgccggctgacctcccgcgaggtgctcctgctgaccatcggcctcagcctggtggcctccatggagctgcccaacagcctcgaggagctgggggacggcctggcgatgggcatcatgatcctcaagctgctgaccgacttccagtcccaccagctctgggccacgctgctgagcctcaccttcatcaagaccaccttctccctgcactacgcctggaagacgatcgccatggtcctgagcatcgtgtccctcttccccctgtgcctgagcaccacctcccagaagaccacgtggctccccgtcctgctggggagcctcggctgcaagccgctgaccatgttcctgatcgcggagaacaagatctgggggcggaagtcctggcccctcaacgagggcatcatggccgtggggatcgtgagcatcctgctgagctccctcctgaagaacgacgtccccctggccggccccctcatcgccggcgggatgctgatcgcctgctacgtgatcagcggctccagcgcggacctgtccctcgagaaggccgccgaggtgagctgggaggaggaggccgagcactccggggccagccacaacatcctggtcgaggtgcaggacgacggcaccatgaagatcaaggacgaggagcgcgacgacaccctgaccatcctcctgaaggcgacgctgctcgccgtgtccggggtctacccgctgagcatccccgccaccctgttcgtgtggtacttctggcagaagaagaagcagcggtccggcgtgctctgggacacccccagcccgcccgaggtcgagcgcgccgtgctggacgacggcatctaccggatcatgcagcgcgggctgctgggccggtcccaggtgggggtcggcgtgttccaggagaacgtgttccacaccatgtggcacgtcacgcgcggggccgtgctcatgtaccagggcaagcggctggagcccagctgggcgtccgtgaagaaggacctgatcagctacggcgggggctggcgcctccaggggtcctggaacaccggcgaggaggtccaggtgatcgccgtggagcccgggaagaaccccaagaacgtccagaccgcccccggcaccttcaagacgcccgagggcgaggtgggggccatcgccctggacttcaagcccggcaccagcgggtcccccatcgtgaaccgggagggcaagatcgtcggcctgtacgggaacggcgtggtgaccaccagcgggacgtacgtcagcgcgatcgcccaggccaaggcctcccaggagggcccgctccccgagatcgaggacgaggtgttccgcaagcggaacctgaccatcatggacctgcaccccgggagcggcaagacccgccggtacctcccggcgatcgtgcgcgaggccatcaagcggaagctgcgcaccctgatcctcgcccccacgcgcgtcgtggcctccgagatggccgaggcgctgaagggcatgcccatccggtaccagaccaccgccgtcaagagcgagcacaccgggaaggagatcgtcgacctgatgtgccacgccacgttcaccatgcgcctcctgtcccccgtgcgggtgccgaactacaacatgatcatcatggacgaggcccacttcaccgaccccagctccatcgccgcgcgcggctacatcagcacccgggtcgggatgggcgaggccgccgccatcttcatgacggccacgccgcccgggtccgtggaggcgttcccgcagagcaacgccgtgatccaggacgaggagcgcgacatccccgagcggtcctggaacagcggctacgagtggatcaccgacttccccggcaagaccgtctggttcgtgccctccatcaagagcgggaacgacatcgccaactgcctgcgcaagaacggcaagcgggtgatccagctctcccgcaagacgttcgacaccgagtaccagaagaccaagaacaacgactgggactacgtcgtgaccacggacatcagcgagatgggggccaacttccgggcggaccgcgtgatcgacccgcggcgctgcctgaagcccgtcatcctgaaggacggccccgagcgggtgatcctcgccgggcccatgccggtgaccgtcgcctccgccgcccagcgccggggccgcatcggccggaaccacaacaaggagggggaccagtacatctacatgggccagcccctgaacaacgacgaggaccacgcgcactggaccgaggccaagatgctgctcgacaacatcaacacccccgaggggatcatccccgccctgttcgagccggagcgcgagaagtccgccgccatcgacggcgagtaccgcctgcgcggggaggcgcgcaagacgttcgtggagctcatgcggcgcggcgacctgcccgtctggctgtcctacaaggtggccagcgagggcttccagtacagcgaccggcgctggtgcttcgacggggagcggaacaaccaggtgctcgaggagaacatggacgtcgagatctggaccaaggagggcgagcgcaagaagctgcggccccgctggctggacgcccggacctactccgaccccctcgccctgcgcgagttcaaggagttcgccgcggggcggcgcagcgtgtccggcgacctgatcctcgagatcggcaagctgccgcagcacctgacccagcgggcccagaacgccctcgacaacctggtgatgctgcacaacagcgagcagggcgggcgcgcctaccggcacgcgatggaggagctccccgacacgatcgagaccctgatgctgctcgccctgatcgccgtcctgaccgggggcgtgaccctcttcttcctgtccgggaagggcctgggcaagaccagcatcgggctcctgtgcgtgatggcctccagcgccctgctctggatggcgtccgtcgagccccactggatcgccgccagcatcatcctggagttcttcctgatggtgctcctgatccccgagccggaccgccagcggacgccccaggacaaccagctggcctacgtggtcatcggcctcctgttcatgatcctgaccgtggccgcgaacgagatggggctcctggagaccaccaagaaggacctgggcatcgggcacgtggccgtcgagaaccaccaccacgccgccatgctcgacgtggacctgcaccccgcctccgcgtggacgctgtacgccgtggccaccaccatcatcaccccgatgatgcgccacacgatcgagaacaccaccgccaacatcagcctcaccgccatcgcgaaccaggccgccatcctgatgggcctggacaagggctggcccatctccaagatggacatcggggtccccctcctggccctgggctgctacagccaggtgaaccccctcacgctgaccgcggccgtgctgatgctcgtcgcccactacgccatcatcgggccgggcctgcaggccaaggcgacccgggaggcccagaagcgcaccgccgccgggatcatgaagaaccccacggtggacggcatcgtggccatcgacctggaccccgtcgtgtacgacgcgaagttcgagaagcagctcggccagatcatgctgctgatcctctgcacctcccagatcctgctgatgcgcaccacctgggccctctgcgagagcatcacgctggccaccgggcccctgaccaccctctgggagggctccccggggaagttctggaacacgaccatcgccgtgagcatggccaacatcttccggggctcctacctggcgggcgccgggctggccttcagcctcatgaagtccctgggcgggggccgccgggggaccggcgcccagggcgagaccctgggggagaagtggaagcgccagctcaaccagctgtccaagagcgagttcaacacgtacaagcggtccggcatcatggaggtcgaccgcagcgaggcgaaggaggggctgaagcggggcgagaccaccaagcacgccgtgtcccgcgggaccgccaagctccggtggttcgtggagcgcaacctggtcaagcccgagggcaaggtgatcgacctgggctgcgggcggggcgggtggagctactactgcgccggcctgaagaaggtgacggaggtcaaggggtacaccaagggcggccccgggcacgaggagcccgtgccgatggccacctacggctggaacctcgtgaagctgcactccgggaaggacgtcttcttcatcccgcccgagaagtgcgacaccctgctctgcgacatcggcgagagctcccccaacccgacgatcgaggaggggcgcaccctgcgggtgctgaagatggtggagccctggctccgcggcaaccagttctgcatcaagatcctgaacccctacatgcccagcgtcgtggagaccctggagcagatgcagcggaagcacggcgggatgctcgtgcgcaacccgctgtcccggaacagcacccacgagatgtactgggtctcctgcggcaccgggaacatcgtgagcgcgatcaacatgacgtcccgcatgctgctcaaccggttcaccatggcccaccgcaagcccacctacgagcgcgacgtggacctgggcgccggcacccggcacgtcgccgtggagcccgaggtggccaacctggacatcatcgggcagcgcatcgagaacatcaagtgcgagcacaagagcacgtggcactacgacgaggacaacccctacaagacctgggcgtaccacggctcctacgaggtcaagccgagcgggtccgccagcagcatggtgaacggcgtggtcaagctcctgaccaagccctgggacgtgatccccatggtcacccagatcgccatgacggacaccacccccttcgggcagcagcgggtgttcaaggagaaggtggacacccgcacgccgaaggccaagcggggcaccgcccagatcatggaggtcaccgcgcgctggctgtggggcttcctctcccggaacaagaagccccgcatctgcacccgggaggagttcacgcgcaaggtgcggagcaacgccgccatcggggccgtgttcgtcgacgagaaccagtggaactccgcgaaggaggccgtggaggacgagcgcttctgggacctggtgcaccgggagcgcgagctgcacaagcagggcaagtgcgcgacctgcgtctacaacatgatggggaagcgggagaagaagctcggcgagttcgggaaggccaagggcagccgcgccatctggtacatgtggctgggcgcgcggttcctggagttcgaggccctcgggttcatgaacgaggaccactggttctcccgcgagaacagcctgtccggcgtggagggggagggcctgcacaagctcgggtacatcctgcgggacatcagcaagatctccggcggcaacatgtacgccgacgacaccgccgggtgggacacccgcatcacggaggacgacctgcagaacgaggccaagatcaccgagatcatggagcccgagcacgcgcagctcgccaaggccatcttcaagctgacctaccagaacaaggtggtccgggtgcagcgcccggccaagaacggcaccgtgatggacgtcatcagccgccgggaccagcgcgggtccggccaggtgggcacgtacgggctgaacaccttcaccaacatggaggcccagctcatccggcagatggagagcgagggcatcttctcccccagcgagctggagacccccaacctggcggagcgcgtgctcgactggctggagaagtacggggtcgagcggctgaagcgcatggccatctccggcgacgactgcgtggtgaagcccatcgacgaccggttcgccacggccctcaccgccctgaacgacatggggaaggtccgcaaggacatcccgcagtgggagcccagcaagggctggaacgactggcagcaggtccccttctgctcccaccacttccaccagctgatcatgaaggacggccgggagatcgtggtcccctgccgcaaccaggacgagctcgtggggcgggcgcgcgtgagccagggcgccgggtggagcctgcgggagaccgcctgcctgggcaagtcctacgcccagatgtggcagctcatgtacttccaccgccgggacctgcgcctggcggccaacgccatctgcagcgccgtcccggtggactgggtgcccacctcccggacgacctggagcatccacgcccaccaccagtggatgaccaccgaggacatgctctccgtctggaaccgcgtgtggatcgaggagaacccctggatgaaggacaagacgcacatcagctcctgggaggacgtgccctacctggggaagcgggaggaccagtggtgcggcagcctgatcggcctcaccgcgcgcgccacctgggccaccaacatccaggtcgccatcaaccaggtgcgccggctgatcgggaacgagaactacctggactacatgacctccatgaagcgcttcaagaacgagagcgacccggagggcgccctctggtga

SEQ ID NO: 8955 - RNA, 9879 nt, synthetic construct
  misc_feature 1..9879: note = derived and/or modified CDS sequence (opt1) from DENV-1__KU666939__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggagcgtggccctcgcgccccacgtgggcctggggctggagacgcgcaccgagacctggatgagctccgagggcgcctggaagcagatccagcgggtcgagacctgggtgctccgccaccccgggttcacggtgatcgccctgttcctggcccacgcgatcggcaccagcatcacccagaaggggatcatcttcatcctcctgatgctggtcaccccctccatggccatgcggtgcgtgggcatcggcagccgcgacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcggaagctctgcatcgaggcgaagatctccaacaccaccacggacagccgctgcccgacccagggcgaggccaccctggtcgaggagcaggacgccaacttcgtgtgccggcgcaccttcgtggaccggggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccaccgccaccatcacgccccaggcgcccacgaccgagatccagctcaccgactacggggccctgaccctggactgcctcccccgcacgggcctggacttcaacgagatggtgctgctcaccatgaaggagaagtcctggctggtgcacaagcagtggttcctggacctccccctgccctggacctccggggccagcaccagccaggagacgtggaaccggcaggacctgctcgtcaccttcaagaccgcccacgccaagaagcaggaggtggtggtcctgggctcccaggagggcgcgatgcacaccgccctgacgggggccaccgagatccagaccagcggcaccacgaccatcttcgccgggcacctcaagtgccgcctgaagatggacaagctgaccctcaagggcatgtcctacgtgatgtgcaccgggagcttcaagctggagaaggaggtggccgagacgcagcacggcaccgtcctggtgcagatcaagtacgagggcaccgacgcgccctgcaagatccccttctccacccaggacgagaagggggtgacgcagaacggccggctgatcaccgccaacccgatcgtcaccgacaaggagaagcccgtgaacatcgaggccgagccgcccttcggggagagctacatcgtgatcggcgccggcgagaaggcgctcaagctgtcctggttcaagaaggggagctccatcggcaagatgttcgaggccaccgcccgcggggcccggcgcatggccatcctgggcgacacggcgtgggacttcgggagcatcggcggcgtcttcacctccgtggggaagctcgtgcaccagatcttcggcaccgcctacggggtcctgttcagcggcgtgtcctggaccatgaagatcgggatcggcgtgctgctcacgtggctgggcctgaacagccgctccaccagcctctccatgacctgcatcgccgtcgggctggtgaccctgtacctcggcgtgatggtccaggccgacagcgggtgcgtgatcaactggaagggccgggagctgaagtgcgggtccggcatcttcgtgacgaacgaggtccacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtggtcgtgggggacgtggccggcatcctggcgcaggggaagaagatgatccggccccagcccatggagcacaagtactcctggaagtcctggggcaaggccaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgaagctccgggactcctacacccaggtgtgcgaccaccgcctgatgagcgcggccatcaaggactccaaggccgtccacgccgacatgggctactggatcgagagcgagaagaacgagacctggaagctggcccgggcgtccttcatcgaggtgaagacctgcatctggcccaagagccacacgctctggtccaacggcgtgctggagagcgagatgatcatccccaagatctacgggggcccgatctcccagcacaactaccgccccgggtacttcacccagaccgccggcccctggcacctggggaagctcgagctggacttcgacctgtgcgagggcaccacggtcgtggtggacgagcactgcggcaaccgggggccgagcctccgcaccaccaccgtcacgggcaagatcatccacgagtggtgctgccggtcctgcaccctgccgcccctgcgcttccgcggggaggacggctgctggtacgggatggagatccgccccgtgaaggagaaggaggagaacctcgtcaagagcatggtctccgccggcagcggcgaggtggacagcttctccctggggctgctctgcatcagcatcatgatcgaggaggtgatgcggtcccgctggagccggaagatgctgatgaccggcaccctggccgtcttcttcctcctgatcatggggcagctgacgtggaacgacctcatccgcctgtgcatcatggtgggcgccaacgcgtccgaccgcatggggatgggcaccacctacctggccctcatggccaccttcaagatgcggccgatgttcgccgtgggcctgctgttccgccggctcacgagccgcgaggtcctgctgctcaccatcgggctgtccctggtggccagcgtcgagctccccaactccctggaggagctgggcgacgggctcgcgatgggcatcatgatcctgaagctgctcaccgacttccagagccaccagctgtgggccaccctgctctccctgacgttcatcaagaccaccttcagcctgcactacgcctggaagaccatggccatggtgctctccatcgtgagcctgatccccctgtgcctctccacgaccagccagaagaccacctggctgcccgtcctgctcggctccctggggtgcaagccgctgacgatgttcctcatcgcggagaacaagatctggggccgcaagagctggcccctgaacgaggggatcatggccgtgggcatcgtgtccatcctgctcagcagcctgctgaagaacgacgtccccctcgccgggcccctgatcgccggcggcatgctgatcgcctgctacgtgatctccgggagctccgcggacctcctgctggagaaggccgccgaggtgagctgggaggaggaggccgagcactccggcgccagccacaacatcctcgtcgaggtgcaggacgacgggaccatgaagatcaaggacgaggagcgcgacgacaccctgaccatcctgctcaaggcgaccctgctggccatctccggcgtgtacccgctcagcatccccgccacgctgttcgtctggtacttctggcagaagaagaagcagcggtccggggtgctgtgggacacccccagcccgcccgaggtggagcgcgccgtcctggacgacggcatctaccggatcatgcagcgcggcctcctggggcggtcccaggtgggcgtgggggtcttccaggagaacgtgttccacaccatgtggcacgtgacccgcggcgccgtcctgatgtaccaggggaagcggctcgagcccagctgggcgtccgtgaagaaggacctgatcagctacggcggcgggtggcgcctgcagggctcctggaacacgggggaggaggtgcaggtcatcgccgtggagcccggcaagaaccccaagaacgtgcagaccgcccccgggaccttcaagacccccgagggcgaggtcggcgccatcgccctcgacttcaagcccgggacgagcggctcccccatcgtgaaccgggaggggaagatcgtgggcctgtacggcaacggggtcgtgaccaccagcggcacctacgtgtccgcgatcgcccaggccaaggccagccaggaggggccgctgcccgagatcgaggacgaggtcttccgcaagcggaacctcacgatcatggacctgcaccccggcagcgggaagacccgccggtacctgccggcgatcgtgcgcgaggccatcaagcggaagctccgcaccctgatcctggcccccacccgcgtggtcgcctccgagatggccgaggcgctcaagggcatgcccatccggtaccagacgaccgccgtcaagagcgagcacaccggcaaggagatcgtggacctgatgtgccacgccaccttcacgatgcgcctgctctcccccgtccgggtgccgaactacaacatgatcatcatggacgaggcccacttcaccgaccccagctccatcgccgcgcgcgggtacatcagcacccgggtgggcatgggggaggccgccgccatcttcatgaccgccacgccgcccggctccgtcgaggcgttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctgtcccgcaagaccttcgacacggagtaccagaagaccaagaacaacgactgggactacgtggtcaccaccgacatcagcgagatgggcgccaacttccgggcggaccgcgtgatcgacccgcggcgctgcctcaagcccgtgatcctgaaggacgggcccgagcgggtcatcctggccggccccatgccggtgacggtcgcctccgccgcccagcgccgggggcgcatcggccggaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgcgagaagtccgccgccatcgacggggagtaccgcctgcggggcgaggcgcgcaagaccttcgtggagctgatgcggcgcggggacctccccgtgtggctgtcctacaaggtcgccagcgagggcttccagtactccgaccggcgctggtgcttcgacggcgagcggaacaaccaggtgctggaggagaacatggacgtggagatctggacgaaggagggggagcgcaagaagctccggccccgctggctggacgcccggacctacagcgaccccctggccctccgcgagttcaaggagttcgccgcgggccggcgcagcgtctccggggacctgatcctggagatcggcaagctcccgcagcacctgacccagcgggcccagaacgccctggacaacctcgtgatgctgcacaacagcgagcagggcgggcgcgcctaccggcacgcgatggaggagctgcccgacaccatcgagacgctcatgctgctggccctcatcgccgtgctgaccggcggggtcaccctgttcttcctctccggccgcgggctgggcaagaccagcatcggcctgctctgcgtgatggcctccagcgtgctgctgtggatggcctccgtcgagccccactggatcgcggccagcatcatcctcgagttcttcctgatggtgctgctcatccccgagccggaccggcagcgcacgccccaggacaaccagctggcctacgtggtcatcgggctcctgttcatgatcctgacggtggccgccaacgagatgggcctgctcgagaccaccaagaaggacctggggatcggccacgtggcggtcgagaaccaccaccacgccaccatgctggacgtggacctccaccccgcctccgcctggacgctgtacgccgtggcgaccaccatcatcaccccgatgatgcggcacacgatcgagaacaccaccgccaacatcagcctgaccgccatcgccaaccaggccgcgatcctcatggggctggacaagggctggcccatctccaagatggacatcggcgtccccctgctcgccctggggtgctacagccaggtgaaccccctgacgctcaccgccgccgtgctgatgctggtcgcgcactacgccatcatcggcccggggctccaggccaaggccacccgcgaggcccagaagcgcaccgcggccggcatcatgaagaaccccacggtggacgggatcgtggccatcgacctggaccccgtcgtgtacgacgccaagttcgagaagcagctgggccagatcatgctcctgatcctgtgcacctcccagatcctcctgatgcggaccacctgggccctgtgcgagagcatcacgctcgcgaccggccccctgaccaccctgtgggaggggtccccgggcaagttctggaacacgaccatcgccgtgagcatggccaacatcttccgcgggtcctacctcgccggcgccggcctggcgttcagcctgatgaagtccctcgggggcgggcggcgcggcaccggggcccagggcgagaccctgggcgagaagtggaagcggcagctgaaccagctcagcaagagcgagttcaacacgtacaagcgctccgggatcatggaggtcgaccggagcgaggccaaggagggcctgaagcgcggggagaccaccaagcacgccgtgtcccggggcaccgcgaagctgcgctggttcgtggagcggaacctggtcaagcccgaggggaaggtgatcgacctcggctgcggccgcgggggctggagctactactgcgccgggctgaagaaggtgacggaggtcaagggctacaccaagggcgggcccggccacgaggagcccatcccgatggccacctacgggtggaacctggtgaagctctactccggcaaggacgtgttcttcatcccgcccgagaagtgcgacaccctgctgtgcgacatcggggagagctcccccaacccgacgatcgaggagggccggaccctccgcgtcctgaagatggtggagccctggctgcgggggaaccagttctgcatcaagatcctcaacccctacatgcccagcgtggtcgagaccctggagcagatgcagcgcaagcacggcggcatgctggtgcggaacccgctctcccgcaacagcacccacgagatgtactgggtgtcctgcgggaccggcaacatcgtcagcgccgtgaacatgacgtcccggatgctgctgaaccgcttcaccatggcccaccgcaagcccacctacgagcgggacgtggacctcggggcgggcacccgccacgtcgccgtggagcccgaggtggccaacctggacatcatcggccagcggatcgagaacatcaagcacgagcacaagagcacgtggcactacgacgaggacaacccctacaagacctgggcctaccacgggtcctacgaggtcaagccgagcggctccgccagctccatggtgaacggggtcgtgaagctgctcaccaagccctgggacgtgatccccatggtcacccagatcgcgatgacggacaccacccccttcggccagcagcgcgtgttcaaggagaaggtggacacccggacgccgaaggccaagcgcgggaccgcccagatcatggaggtcaccgcccggtggctgtggggcttcctgagccgcaacaagaagccccggatctgcacccgcgaggagttcacgcggaaggtgcgcagcaacgccgcgatcggcgccgtgttcatcgacgagaaccagtggaactccgccaaggaggccgtcgaggacgagcggttctgggacctcgtgcaccgcgagcgggagctgcacaagcaggggaagtgcgcgacctgcgtgtacaacatgatgggcaagcgcgagaagaagctgggggagttcggcaaggccaaggggagccgggccatctggtacatgtggctcggcgcccgcttcctggagttcgaggccctgggcttcatgaacgaggaccactggttctcccgggagaacagcctctccggggtcgagggcgaggggctgcacaagctgggctacatcctccgcgacatcagcaagatccccgggggcaacatgtacgcggacgacaccgccggctgggacacccggatcacggaggacgacctgcagaacgaggccaagatcaccgacatcatggagccggagcacgccctgctcgccaaggcgatcttcaagctgacctaccagaacaaggtggtgcgcgtccagcgccccgccaagaacgggaccgtgatggacgtgatctcccggcgcgaccagcggggcagcgggcaggtcggcacgtacggcctgaacaccttcaccaacatggaggcccagctcatccgccagatggagtccgaggggatcttcagcccctccgagctggagacccccaacctggccgagcgggtgctcgactggctgggcaagtacggggtggagcgcctgaagcggatggccatcagcggcgacgactgcgtcgtgaagccgatcgacgaccgcttcgcgacggccctcaccgccctgaacgacatggggaaggtgcggaaggacatcccccagtgggagccctccaagggctggaacgactggcagcaggtccccttctgcagccaccacttccaccagctgatcatgaaggacggccgcgagatcgtggtgccgtgccggaaccaggacgagctcgtcgggcgcgcccgggtgtcccagggcgccgggtggagcctgcgcgagaccgcgtgcctgggcaagtcctacgcccagatgtggcagctcatgtacttccaccggcgcgacctgcggctggccgccaacgcgatctgcagcgccgtgcccgtcgactgggtgcccaccagccgcacgacctggtccatccacgcccaccaccagtggatgaccaccgaggacatgctcagcgtgtggaaccgggtctggatcgaggagaacccctggatggaggacaagacgcacatctccagctgggaggacgtgccgtacctggggaagcgcgaggaccagtggtgcggctccctgatcggcctcaccgcccgcgccacctgggcgaccaacatccaggtggccatcaaccaggtccggcgcctgatcgggaacgagaactacctggactacatgaccagcatgaagcggttcaagaacgagtccgaccccgagggcgccctctggtga

SEQ ID NO: 8956 - RNA, 9879 nt, synthetic construct
  misc_feature 1..9879: note = derived and/or modified CDS sequence (opt1) from DENV-1__KU666940__SS-prME
  source 1..9879: mol_type = other RNA
agcgtgaccatgctgctcatgctgacccccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccggaccgagacctggatgagctccgagggcgcctggaagcagatccagcgggtcgagacgtgggccctccgccaccccgggttcaccgtgatcgccctgttcctggcgcacgccatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgcggtgctgcggaagctctgcatcgaggccaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgcgaccatcacgccccaggcccccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgcgaagaagcaggaggtcgtggtgctcggcagccaggagggcgccatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggcggagacccagcacggcaccgtgctggtccagatcaagtacgagggcaccgacgccccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccacggcccgcggggcccggcgcatggcgatcctgggcgacaccgcctgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggcgggcatcctcgcccaggggaagaagatgatccggccccagcccatggagcacaagtacagctggaagtcctggggcaaggccaagatcatcggcgccgacgtgcagaacaccaccttcatcatcgacgggcccaacaccccggagtgccccgacgaccagcgcgcgtggaacatctgggaggtcgaggactacggcttcgggatcttcacgaccaacatctggctgaagctgcgggacagctacacccaggtgtgcgaccaccgcctcatgtccgccgccatcaaggacagcaaggccgtgcacgccgacatgggctactggatcgagtccgagaagaacgagacctggaagctggcgcgggccagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgctaccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgcgaacgccagcgaccgcatggggatgggcaccacctacctggccctgatggccacgttcaagatgcggccgatgttcgccgtgggcctcctgttccgccggctgacctcccgcgaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccacgctgctgagcctcaccttcatcaagaccaccttctccctgcactacgcctggaagacgatcgcgatggtcctgagcatcgtgtccctcttccccctgtgcctgagcaccacctcccagaagaccacgtggctccccgtgctgctgggcagcctcgggtgcaagccgctgaccatgttcctgatcgccgagaacaagatctggggccggaagtcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgcgacgacaccctgaccatcctcctgaaggccacgctgctcgccgtgtccggcgtgtacccgctgagcatccccgccaccctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacgcgcggcgcggtcctcatgtaccaggggaagcggctggagcccagctgggcctccgtgaagaaggacctgatcagctacggcggcgggtggcgcctccagggctcctggaacaccggggaggaggtgcaggtcatcgccgtggagcccggcaagaaccccaagaacgtgcagaccgcccccgggaccttcaagacgcccgagggcgaggtcggcgccatcgcgctggacttcaagcccgggaccagcggctcccccatcgtgaaccgggaggggaagatcgtgggcctgtacggcaacggggtcgtgaccaccagcggcacgtacgtgagcgccatcgcccaggccaaggcgtcccaggaggggccgctccccgagatcgaggacgaggtcttccgcaagcggaacctgaccatcatggacctgcaccccggcagcgggaagacccgccggtacctcccggccatcgtgcgcgaggccatcaagcggaagctgcgcaccctgatcctcgcccccacgcgcgtggtcgcctccgagatggcggaggccctgaagggcatgcccatccggtaccagaccaccgccgtcaagagcgagcacaccggcaaggagatcgtggacctgatgtgccacgccacgttcaccatgcgcctcctgtcccccgtccgggtgccgaactacaacatgatcatcatggacgaggcccacttcaccgaccccagctccatcgcggcccgcgggtacatcagcacccgggtgggcatgggggaggccgccgccatcttcatgacggcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctctcccgcaagacgttcgacaccgagtaccagaagaccaagaacaacgactgggactacgtggtcaccacggacatcagcgagatgggcgcgaacttccgggccgaccgcgtgatcgacccgcggcgctgcctgaagcccgtgatcctgaaggacgggcccgagcgggtcatcctcgccggccccatgccggtgaccgtcgcctccgccgcgcagcgccgggggcgcatcggccggaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgcgagaagtccgccgcgatcgacggggagtaccgcctgcggggcgaggcccgcaagacgttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggaccaaggagggggagcgcaagaagctgcggccccgctggctggacgcccggacctactccgaccccctcgccctgcgcgagttcaaggagttcgcggccggccggcgcagcgtctccggggacctgatcctcgagatcggcaagctgccgcagcacctgacccagcgggcccagaacgccctcgacaacctggtgatgctgcacaacagcgagcagggcgggcgcgcgtaccggcacgccatggaggagctccccgacacgatcgagaccctgatgctgctcgccctgatcgccgtgctgaccggcggggtcaccctcttcttcctgtccggcaaggggctgggcaagaccagcatcggcctcctgtgcgtgatggcctccagcgtgctgctctggatggcgtccgtcgagccccactggatcgccgccagcatcatcctggagttcttcctgatggtgctcctgatccccgagccggaccgccagcggacgccccaggacaaccagctggcctacgtggtcatcgggctcctgttcatgatcctgaccgtggccgcgaacgagatgggcctcctggagaccaccaagaaggacctggggatcggccacgtggccgtcgagaaccaccaccacgccgccatgctcgacgtggacctgcaccccgcctccgcgtggacgctgtacgccgtggccaccaccatcatcaccccgatgatgcgccacacgatcgagaacaccaccgccaacatcagcctcaccgccatcgcgaaccaggccgccatcctgatggggctggacaagggctggcccatctccaagatggacatcggcgtccccctcctggccctggggtgctacagccaggtgaaccccctcacgctgaccgcggccgtgctgatgctcgtcgcccactacgccatcatcggcccggggctgcaggccaaggcgacccgggaggcccagaagcgcaccgccgccggcatcatgaagaaccccacggtggacgggatcgtggccatcgacctggaccccgtcgtgtacgacgcgaagttcgagaagcagctcggccagatcatgctgctgatcctctgcacctcccagatcctgctgatgcgcaccacctgggccctctgcgagagcatcacgctggccaccggccccctgaccaccctctgggaggggtccccgggcaagttctggaacacgaccatcgccgtgagcatggccaacatcttccgggggtcctacctggcgggcgccggcctggccttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtcgaccgcagcgaggcgaaggagggcctgaagcgcggggagaccaccaagcacgccgtgtcccgcggcaccgccaagctccggtggttcgtggagcgcaacctggtcaagcccgaggggaaggtgatcgacctgggctgcggccgcgggggctggagctactactgcgccgggctgaagaaggtgacggaggtcaagggctacaccaagggcggccccggccacgaggagcccgtgccgatggccacctacgggtggaacctcgtgaagctgcactccggcaaggacgtcttcttcatcccgcccgagaagtgcgacaccctgctctgcgacatcggggagagctcccccaacccgacgatcgaggagggccgcaccctgcgggtgctgaagatggtggagccctggctccgcgggaaccagttctgcatcaagatcctgaacccctacatgcccagcgtcgtggagaccctggagcagatgcagcggaagcacggcggcatgctcgtgcgcaacccgctgtcccggaacagcacccacgagatgtactgggtctcctgcgggaccggcaacatcgtgagcgcgatcaacatgacgtcccgcatgctgctcaaccggttcaccatggcccaccgcaagcccacctacgagcgcgacgtggacctgggggccggcacccggcacgtcgccgtggagcccgaggtggccaacctggacatcatcggccagcgcatcgagaacatcaagtgcgagcacaagagcacgtggcactacgacgaggacaacccctacaagacctgggcgtaccacgggtcctacgaggtcaagccgagcggctccgccagcagcatggtgaacggggtcgtgaagctcctgaccaagccctgggacgtgatccccatggtcacccagatcgccatgacggacaccacccccttcggccagcagcgggtgttcaaggagaaggtggacacccgcacgccgaaggccaagcgggggaccgcccagatcatggaggtcaccgcgcgctggctgtggggcttcctctcccggaacaagaagccccgcatctgcacccgggaggagttcacgcgcaaggtgcggagcaacgccgccatcggcgccgtgttcgtcgacgagaaccagtggaactccgcgaaggaggccgtggaggacgagcgcttctgggacctggtgcaccgggagcgcgagctgcacaagcaggggaagtgcgcgacctgcgtctacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtggagggcgaggggctgcacaagctcggctacatcctgcgggacatcagcaagatctccgggggcaacatgtacgccgacgacaccgccggctgggacacccgcatcacggaggacgacctgcagaacgaggccaagatcaccgagatcatggagcccgagcacgcgcagctcgccaaggccatcttcaagctgacctaccagaacaaggtggtccgggtgcagcgcccggccaagaacgggaccgtgatggacgtcatcagccgccgggaccagcgcggctccggccaggtggggacgtacggcctgaacaccttcaccaacatggaggcccagctcatccggcagatggagagcgaggggatcttctcccccagcgagctggagacccccaacctggcggagcgcgtgctcgactggctggagaagtacggcgtcgagcggctgaagcgcatggccatctccggggacgactgcgtggtgaagcccatcgacgaccggttcgccacggccctcaccgccctgaacgacatgggcaaggtccgcaaggacatcccgcagtgggagcccagcaaggggtggaacgactggcagcaggtccccttctgctcccaccacttccaccagctgatcatgaaggacggccgggagatcgtggtcccctgccgcaaccaggacgagctcgtgggccgggcgcgcgtgagccagggggccggctggagcctgcgggagaccgcctgcctggggaagtcctacgcccagatgtggcagctcatgtacttccaccgccgggacctgcgcctggcggccaacgccatctgcagcgccgtcccggtggactgggtgcccacctcccggacgacctggagcatccacgcccaccaccagtggatgaccaccgaggacatgctctccgtctggaaccgcgtgtggatcgaggagaacccctggatgaaggacaagacgcacatcagctcctgggaggacgtgccctacctgggcaagcgggaggaccagtggtgcgggagcctgatcggcctcaccgcgcgcgccacctgggccaccaacatccaggtcgccatcaaccaggtgcgccggctgatcggcaacgagaactacctggactacatgacctccatgaagcgcttcaagaacgagagcgacccggagggggccctctggtga

SEQ ID NO: 8957 - RNA, 9879 nt, synthetic construct
  misc_feature 1..9879: note = derived and/or modified CDS sequence (opt1) from DENV-1__KU666941__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcggcgccaagatctccaacaccaccacggacagccgctgcccgacccagggcgaggccaccctggtggaggagcaggacgccaacttcgtctgccggcgcaccttcgtggaccgggggtggggcaacgggtgcggcctgttcgggaagggctccctcatcacgtgcgccaagttcaagtgcgtgaccaagctggagggcaagatcgtccagtacgagaacctgaagtacagcgtgatcgtgaccgtccacaccggggaccagcaccaggtgggcaacgagtccacggagcacgggaccaccgcgaccatcacgccccaggcccccacgaccgagatccagctcaccgactacggcgccctgaccctggactgcagcccccgcacggggctcgacttcaacgagatggtcctgctgaccatgaaggagaagtcctggctcgtgcacaagcagtggttcctggacctgcccctcccctggaccagcggcgccagcacctcccaggagacgtggaaccggcaggacctgctggtgaccttcaagaccgcccacgcgaagaagcaggaggtcgtggtgctcggcagccaggagggggccatgcacaccgccctgacgggcgccaccgagatccagacctccgggaccacgaccatcttcgccggccacctgaagtgccgcctcaagatggacaagctgaccctgaaggggatgagctacgtcatgtgcaccggctccttcaagctcgagaaggaggtggcggagacgcagcacggcaccgtgctggtccagatcaagtacgaggggaccgacgccccctgcaagatccccttcagcacccaggacgagaagggcgtgacgcagaacgggcggctgatcaccgccaacccgatcgtgaccgacaaggagaagcccgtcaacatcgaggccgagccgcccttcggcgagtcctacatcgtgatcggcgcgggggagaaggccctgaagctcagctggttcaagaagggctccagcatcgggaagatgttcgaggccaccgcccgcggcgcccggcgcatggcgatcctgggggacacggcctgggacttcggctccatcggcggggtgttcaccagcgtcggcaagctggtgcaccagatcttcgggaccgcctacggcgtcctcttctccggggtcagctggaccatgaagatcggcatcggcgtgctgctgacgtggctcgggctgaactcccgcagcacctccctgagcatgacctgcatcgccgtgggcctcgtcaccctgtacctgggggtgatggtgcaggccgactccggctgcgtcatcaactggaaggggcgggagctcaagtgcggcagcggcatcttcgtgacgaacgaggtgcacacctggaccgagcagtacaagttccaggcggacagcccgaagcgcctgtccgccgccatcgggaaggcctgggaggagggcgtctgcgggatccggagcgccacccgcctggagaacatcatgtggaagcagatctccaacgagctcaaccacatcctgctggagaacgacatgaagttcaccgtggtggtcggcgacgtggcggggatcctcgcccagggcaagaagatgatccggccccagcccatggagcacaagtacagctggaagtcctggggcaaggccaagatcatcggggccgacgtgcagaacacgaccttcatcatcgacggccccaacaccccggagtgccccgacgaccagcgcgcgtggaacatctgggaggtcgaggactacgggttcggcatcttcaccacgaacatctggctgaagctgcgggacagctacacccaggtgtgcgaccaccgcctcatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacacgctgtggagcaacggggtgctcgagtccgagatgatcatccccaagatctacggcgggccgatcagccagcacaactaccgccccggctacttcacccagaccgccgggccctggcacctgggcaagctggagctcgacttcgacctgtgcgagggcaccacggtggtcgtggacgagcactgcgggaaccggggcccgtccctgcgcaccaccaccgtgacggggaagatcatccacgagtggtgctgccggagctgcaccctgccgcccctccgctaccggggcgaggacgggtgctggtacggcatggagatccgccccgtcaaggagaaggaggagaacctggtgaagtccatggtgagcgccggcagcggggaggtcgactccttcagcctcggcctgctgtgcatctccatcatgatcgaggaggtgatgcggagccgctggtcccggaagatgctcatgaccgggaccctggccgtgttcttcctgctcatcatgggccagctgacgtggaacgacctgatccgcctctgcatcatggtcggggcgaacgccagcgaccgcatgggcatgggcaccacctacctggccctgatggccaccttcaagatgcggccgatgttcgccgtggggctcctgttccgccggctgacgtcccgcgaggtgctcctgctgaccatcggcctcagcctggtcgcgtccgtggagctgcccaacagcctcgaggagctgggggacggcctggccatgggcatcatgatcctcaagctgctgaccgacttccagtcccaccagctctgggccaccctgctgagcctcacgttcatcaagaccaccttctccctgcactacgcctggaagaccatcgcgatggtcctgagcatcgtgtccctcttccccctgtgcctgagcacgacctcccagaagaccacctggctccccgtgctgctggggagcctcggctgcaagccgctgacgatgttcctgatcgccgagaacaagatctgggggcggaagtcctggcccctcaacgagggcatcatggccgtcgggatcgtgagcatcctgctgagctccctcctgaagaacgacgtgcccctggccggccccctcatcgccggcgggatgctgatcgcgtgctacgtcatcagcggctccagcgccgacctgtccctcgagaaggccgccgaggtgagctgggaggaggaggccgagcactccggggcgagccacaacatcctggtggaggtccaggacgacggcaccatgaagatcaaggacgaggagcgcgacgacaccctgaccatcctcctgaaggccaccctgctcgccgtgtccggggtgtacccgctgagcatccccgccacgctgttcgtctggtacttctggcagaagaagaagcagcggtccggcgtgctctgggacacccccagcccgcccgaggtggagcgcgccgtcctggacgacggcatctaccggatcatgcagcgcgggctgctgggccggtcccaggtgggggtgggcgtcttccaggagaacgtgttccacaccatgtggcacgtgacccgcggggcggtcctcatgtaccagggcaagcggctggagcccagctgggcctccgtgaagaaggacctgatcagctacggcgggggctggcgcctccaggggtcctggaacacgggcgaggaggtgcaggtcatcgccgtggagcccgggaagaaccccaagaacgtgcagaccgcccccggcaccttcaagacccccgagggcgaggtcggggccatcgcgctggacttcaagcccggcacgagcgggtcccccatcgtgaaccgggagggcaagatcgtgggcctgtacgggaacggcgtcgtgaccaccagcgggacctacgtgagcgccatcgcccaggccaaggcgtcccaggagggcccgctccccgagatcgaggacgaggtcttccgcaagcggaacctgacgatcatggacctgcaccccgggagcggcaagacccgccggtacctcccggccatcgtgcgcgaggccatcaagcggaagctgcgcaccctgatcctcgcccccacccgcgtggtcgcctccgagatggcggaggccctgaagggcatgcccatccggtaccagacgaccgccgtcaagagcgagcacaccgggaaggagatcgtggacctgatgtgccacgccaccttcacgatgcgcctcctgtcccccgtccgggtgccgaactacaacatgatcatcatggacgaggcccacttcaccgaccccagctccatcgcggcccgcggctacatcagcacccgggtggggatgggcgaggccgccgccatcttcatgaccgcgacgccgcccgggtccgtcgaggccttcccgcagagcaacgccgtgatccaggacgaggagcgcgacatccccgagcggtcctggaacagcggctacgagtggatcaccgacttccccggcaagaccgtgtggttcgtcccctccatcaagagcgggaacgacatcgccaactgcctgcgcaagaacggcaagcgggtgatccagctctcccgcaagaccttcgacacggagtaccagaagaccaagaacaacgactgggactacgtggtcaccaccgacatcagcgagatgggggcgaacttccgggccgaccgcgtgatcgacccgcggcgctgcctgaagcccgtgatcctgaaggacggccccgagcgggtcatcctcgccgggcccatgccggtgacggtcgcctccgccgcgcagcgccggggccgcatcggccggaaccacaacaaggagggggaccagtacatctacatgggccagcccctgaacaacgacgaggaccacgcccactggaccgaggccaagatgctgctcgacaacatcaacacccccgaggggatcatccccgccctgttcgagccggagcgcgagaagtccgccgcgatcgacggcgagtaccgcctgcgcggggaggcccgcaagaccttcgtggagctcatgcggcgcggcgacctgcccgtgtggctgtcctacaaggtcgccagcgagggcttccagtacagcgaccggcgctggtgcttcgacggggagcggaacaaccaggtgctcgaggagaacatggacgtggagatctggacgaaggagggcgagcgcaagaagctgcggccccgctggctggacgcccggacctactccgaccccctcgccctgcgcgagttcaaggagttcgcggccgggcggcgcagcgtctccggcgacctgatcctcgagatcggcaagctgccgcagcacctgacccagcgggcccagaacgccctcgacaacctggtgatgctgcacaacagcgagcagggcgggcgcgcgtaccggcacgccatggaggagctccccgacaccatcgagacgctgatgctgctcgccctgatcgccgtgctgaccgggggcgtcaccctcttcttcctgtccgggaagggcctgggcaagaccagcatcgggctcctgtgcgtgatggcctccagcgtgctgctctggatggcgtccgtcgagccccactggatcgccgccagcatcatcctggagttcttcctgatggtgctcctgatccccgagccggaccgccagcggacgccccaggacaaccagctggcctacgtggtcatcggcctcctgttcatgatcctgacggtggccgcgaacgagatggggctcctggagaccaccaagaaggacctgggcatcgggcacgtggccgtcgagaaccaccaccacgccgccatgctcgacgtggacctgcaccccgcctccgcgtggaccctgtacgccgtggccacgaccatcatcaccccgatgatgcgccacaccatcgagaacacgaccgccaacatcagcctcaccgccatcgcgaaccaggccgccatcctgatgggcctggacaagggctggcccatctccaagatggacatcggggtccccctcctggccctgggctgctacagccaggtgaaccccctcaccctgacggcggccgtgctgatgctcgtcgcccactacgccatcatcgggccgggcctgcaggccaaggcgacccgggaggcccagaagcgcaccgccgccgggatcatgaagaaccccaccgtggacggcatcgtggccatcgacctggaccccgtcgtgtacgacgcgaagttcgagaagcagctcggccagatcatgctgctgatcctctgcacgtcccagatcctgctgatgcgcaccacctgggccctctgcgagagcatcaccctggccacggggcccctgaccaccctctgggagggctccccggggaagttctggaacaccacgatcgccgtgagcatggccaacatcttccggggctcctacctggcgggcgccgggctggccttcagcctcatgaagtccctgggcgggggccgccgggggaccggcgcccagggcgagaccctgggggagaagtggaagcgccagctcaaccagctgtccaagagcgagttcaacacctacaagcggtccggcatcatggaggtcgaccgcagcgaggcgaaggaggggctgaagcggggcgagacgaccaagcacgccgtgtcccgcgggaccgccaagctccggtggttcgtggagcgcaacctggtcaagcccgagggcaaggtgatcgacctgggctgcgggcggggcgggtggagctactactgcgccggcctgaagaaggtgaccgaggtcaaggggtacacgaagggcggccccgggcacgaggagcccgtgccgatggccacctacggctggaacctcgtgaagctgcactccgggaaggacgtcttcttcatcccgcccgagaagtgcgacaccctgctctgcgacatcggcgagagctcccccaacccgaccatcgaggaggggcgcacgctgcgggtgctgaagatggtggagccctggctccgcggcaaccagttctgcatcaagatcctgaacccctacatgcccagcgtcgtggagaccctggagcagatgcagcggaagcacggcgggatgctcgtgcgcaacccgctgtcccggaacagcacccacgagatgtactgggtctcctgcggcaccgggaacatcgtgagcgcgatcaacatgacctcccgcatgctgctcaaccggttcacgatggcccaccgcaagcccacctacgagcgcgacgtggacctgggcgccggcacccggcacgtcgccgtggagcccgaggtggccaacctggacatcatcgggcagcgcatcgagaacatcaagtgcgagcacaagagcacctggcactacgacgaggacaacccctacaagacgtgggcgtaccacggctcctacgaggtcaagccgagcgggtccgccagcagcatggtgaacggcgtcgtgaagctcctgaccaagccctgggacgtgatccccatggtcacccagatcgccatgaccgacacgacccccttcgggcagcagcgggtgttcaaggagaaggtggacacccgcaccccgaaggccaagcggggcacggcccagatcatggaggtcaccgcgcgctggctgtggggcttcctctcccggaacaagaagccccgcatctgcacccgggaggagttcacccgcaaggtgcggagcaacgccgccatcggggccgtgttcgtcgacgagaaccagtggaactccgcgaaggaggccgtggaggacgagcgcttctgggacctggtgcaccgggagcgcgagctgcacaagcagggcaagtgcgccacgtgcgtctacaacatgatggggaagcgggagaagaagctcggcgagttcgggaaggccaagggcagccgcgccatctggtacatgtggctgggcgcgcggttcctggagttcgaggccctcgggttcatgaacgaggaccactggttctcccgcgagaacagcctgtccggcgtggagggggagggcctgcacaagctcgggtacatcctgcgggacatcagcaagatctccggcggcaacatgtacgccgacgacaccgccgggtgggacacccgcatcaccgaggacgacctgcagaacgaggccaagatcacggagatcatggagcccgagcacgcgcagctcgccaaggccatcttcaagctgacctaccagaacaaggtggtccgggtgcagcgcccggccaagaacggcaccgtgatggacgtcatcagccgccgggaccagcgcgggtccggccaggtgggcacctacgggctgaacacgttcaccaacatggaggcccagctcatccggcagatggagagcgagggcatcttctcccccagcgagctggagacccccaacctggcggagcgcgtgctcgactggctggagaagtacggggtcgagcggctgaagcgcatggccatctccggcgacgactgcgtggtgaagcccatcgacgaccggttcgccaccgccctcacggccctgaacgacatggggaaggtccgcaaggacatcccgcagtgggagcccagcaagggctggaacgactggcagcaggtccccttctgctcccaccacttccaccagctgatcatgaaggacggccgggagatcgtggtcccctgccgcaaccaggacgagctcgtggggcgggcgcgcgtgagccagggcgccgggtggagcctgcgggagaccgcctgcctgggcaagtcctacgcccagatgtggcagctcatgtacttccaccgccgggacctgcgcctggcggccaacgccatctgcagcgccgtcccggtggactgggtgcccacctcccggaccacgtggagcatccacgcccaccaccagtggatgaccaccgaggacatgctctccgtctggaaccgcgtgtggatcgaggagaacccctggatgaaggacaagacccacatcagctcctgggaggacgtgccctacctggggaagcgggaggaccagtggtgcggcagcctgatcggcctcacggcgcgcgccacctgggccaccaacatccaggtcgccatcaaccaggtgcgccggctgatcgggaacgagaactacctggactacatgacctccatgaagcgcttcaagaacgagagcgacccggagggcgccctctggtga

SEQ ID NO: 8958 - RNA, 9879 nt, synthetic construct
  misc_feature 1..9879: note = derived and/or modified CDS sequence (opt1) from DENV-1__KC172835__SS-prME
  source 1..9879: mol_type = other RNA
agcgtgaccatgctgctcatgctgatgcccaccgccctggccttccacctcaccacccgcggcggggagccgcacatgatcgtgagcaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcgtgaactggaagggccgggagctcaagtgcgggagcggcatcttcgtgacgaacgaggtccacacctggaccgagcagtacaagttccaggcggacagcccgaagcgcctgtccgccgccatcggcaaggcctgggaggagggggtgtgcggcatccggagcgccacccgcctggagaacgtgatgtggaagcagatctccaacgagctcaaccacatcctgctggagaacgacatgaagttcaccgtcgtggtgggggacgtcgcgggcatcctcgcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtggaggactacggcttcgggatcttcaccacgaacatctggctgcggctgcgcgacagctacacccaggtctgcgaccaccggctcatgtccgccgccatcaaggacagcaaggccgtgcacgccgacatgggctactggatcgagtccgagaagaacgagacctggaagctggcgcgcgccagcttcatcgaggtgaagacctgcatctggcccaagtcccacacgctgtggagcaacggcgtcctcgagtccgagatgatcatccccaagatctacgggggcccgatcagccagcacaactaccggcccgggtacttcacccagaccgccggcccctggcacctggggaagctggagctcgacttcgacctgtgcgagggcaccacggtggtggtcgacgagcactgcggcaaccgcgggccgtccctgcggaccaccaccgtgacgggcaagaccatccacgagtggtgctgccgcagctgcaccctgccgcccctccggttccgcggggaggacggctgctggtacgggatggagatccggcccgtgaaggagaaggaggagaacctggtcaagtccatggtgagcgccggcagcggcgaggtggactccttcagcctcgggctgctgtgcatctccatcatgatcgaggaggtcatgcgcagccggtggtcccgcaagatgctcatgaccggcacgctggccgtgttcttcctgctcatcatcgggcagctgacctggaacgacctgatccgcctcagcatcatggtgggcgcgaacgcctccgacaagatggggatgggcaccacctacctggccctgatggccacgttcaagatgcggccgatgttcgccgtcggcctcctgttccgccggctgaccagccgcgaggtgctcctgctgaccatcgggctctccctggtcgcgagcgtggagctgcccaactccctcgaggagctgggcgacgggctggccatgggcatcatgatcctcaagctgctgaccgacttccagccccaccagctctgggccacgctgctgagcctcaccttcatcaagaccaccttctccctgcactacgcctggaagacgatggcgatggtgctgagcatcgtctccctcttccccctgtgcctgagcaccacctcccagaagaccacgtggctcccggtgctgctgggcagcctcgggtgcaagcccctgaccatgttcctgatcaccgagaacaagatctggggccggaagtcctggcccctcaacgaggggatcatggccgtgggcatcgtcagcatcctgctgagctccctcctgaagaacgacgtgcccctggccgggccgctcatcgccggcggcatgctgatcgcctgctacgtgatcagcgggtccagcgcggacctgtccctcgagaaggccgccgaggtcagctgggaggaggaggccgagcactccggcgccagccacaacatcctggtggaggtgcaggacgacgggaccatgaagatcaaggacgaggagcgcgacgacaccctgacgatcctcctgaaggcgaccctgctcgccgtctccggcgtgtaccccctgagcatccccgccaccctgttcgtgtggtacttctggcagaagaagaagcagcggtccggggtcctctgggacacccccagcccgcccgaggtggagcgcgccgccctggacgacggcatctaccggatcatgcagcgcggcctgctggggcggtcccaggtgggcgtcggggtgttccaggagaacgtgttccacacgatgtggcacgtcacccgcggcgcggtgctcatgtaccaggggaagcggctggagcccagctgggcctccgtgaagaaggacctgatcagctacggcggcgggtggcgcctccagggctcctggaacaccggggaggaggtccaggtgatcgccgtggagcccggcaagaacccgaagaacgtccagaccgcccccgggacgttcaagacccccgagggcgaggtgggcgccatcgcgctggacttcaagcccgggaccagcggctccccgatcgtgaaccgggaggggaagatcgtcggcctgtacggcaacggggtggtgaccacgagcggcacctacgtcagcgccatcgcccaggccaaggcgtcccaggaggggcccctccccgagatcgaggacgaggtgttccgcaagcggaacctgaccatcatggacctgcacccgggcagcgggaagacccgccggtacctccccgccatcgtgcgcgaggccatcaagcggaagctgcgcacgctgatcctcgcccccacccgcgtcgtggcctccgagatggcggaggccctgaagggcatgcccatccggtaccagaccaccgccgtcaagagcgagcacacgggcaaggagatcgtcgacctgatgtgccacgccaccttcaccatgcgcctcctgtccccggtgcgggtgcccaactacaacatgatcatcatggacgaggcccacttcaccgaccccagctccatcgcggcccgcgggtacatcagcacgcgggtcggcatgggggaggccgccgccatcttcatgaccgcgacgccgcccggctccgtggaggccttcccccagagcaacgccgtgatccaggacgaggagcgcgacatccccgagcggtcctggaacagcgggtacgagtggatcaccgacttccccggcaagacggtctggttcgtgccctccatcaagagcggcaacgacatcgccaactgcctgcgcaagaacgggaagcgggtgatccagctctcccgcaagaccttcgacaccgagtaccagaagaccaagaacaacgactgggactacgtcgtgacgaccgacatcagcgagatgggcgcgaacttccgggccgaccgcgtgatcgacccccggcgctgcctgaagcccgtcatcctgaaggacgggcccgagcgggtgatcctcgccggcccgatgcccgtcaccgtggcctccgccgcgcagcgccgggggcgcatcggccggaaccacaacaaggagggcgaccagtacatctacatggggcagcccctgaacaacgacgaggaccacgcccactggaccgaggccaagatgctgctcgacaacatcaacacgcccgagggcatcatcccggccctgttcgagcccgagcgcgagaagtccgccgcgatcgacggggagtaccgcctgcggggcgaggcccgcaagaccttcgtggagctcatgcggcgcggggacctgcccgtctggctgtcctacaaggtggccagcgagggcttccagtacagcgaccggcgctggtgcttcgacggcgagcggaacaaccaggtgctcgaggagaacatggacgtcgagatctggaccaaggagggggagcgcaagaagctgcggccccgctggctggacgcccggacctactccgacccgctcgccctgcgcgagttcaaggagttcgcggccggccggcgcagcgtgtccggggacctgatcctcgagatcggcaagctgccccagcacctgacgcagcgggcccagaacgccctcgacaacctggtgatgctgcacaacagcgagcagggcgggcgcgcgtaccggcacgccatggaggagctccccgacaccatcgagaccctgatgctgctcgccctgatcgccgtcctgaccggcggggtgaccctcttcttcctgtccggccgcgggctgggcaagacgagcatcggcctcctgtgcgtgatggcctccagcgtcctgctctggatggcgtccgtggagccccactggatcgccgccagcatcatcctggagttcttcctgatggtgctcctgatcccggagcccgaccggcagcgcacgccccaggacaaccagctggcctacgtcgtgatcgggctcctgttcatgatcctgaccgtggccgcgaacgagatgggcctcctggagaccacgaagaaggacctggggatcggccacgtcgccgacgagaaccaccaccacgccgccatgctcgacgtggacctgcacccggcctccgcgtggaccctgtacgccgtggccaccaccatcatcacgcccatgatgcggcacaccatcgagaacaccaccgccaacatcagcctcacggccatcgcgaaccaggccgccatcctgatggggctggacaagggctggcccatctccaagatggacatcggcgtccccctcctggccctggggtgctacagccaggtgaacccgctcaccctgaccgcggccgtgctgatgctcgtcgcccactacgccatcatcggccccgggctgcaggccaaggcgacccgcgaggcccagaagcgcacggccgccggcatcatgaagaaccccaccgtggacgggatcgtggccatcgacctggaccccgtcgtgtacgacgcgaagttcgagaagcagctcggccagatcatgctgctgatcctctgcacctcccagatcctgctgatgcggaccacgtgggccctctgcgagagcatcaccctggccaccggcccgctgaccacgctctgggaggggtcccccggcaagttctggaacaccaccatcgccgtgagcatggccaacatcttccgcgggtcctacctggcgggcgccggcctggccttcagcctcatgaagtccctcgggggcgggcggcgcgggaccggggcccagggcgagacgctgggcgagaagtggaagcggcagctcaaccagctgtccaagagcgagttcaacacctacaagcgctccgggatcatggaggtcgaccggagcgaggcgaaggagggcctgaagcgcggggagaccaccaagcacgccgtgtcccggggcacggccaagctccgctggttcgtggagcggaacctggtcaagcccgaggggaaggtgatcgacctgggctgcggccgcgggggctggagctactactgcgccgggctgaagaaggtgaccgaggtcaagggctacaccaagggcgggcccggccacgaggagccgatccccatggccacctacgggtggaacctcgtgaagctgcactccggcaaggacgtgttcttcatcccgcccgagaagtgcgacacgctgctctgcgacatcggggagagctccccgaaccccaccatcgaggagggccggaccctgcgcgtcctgaagatggtggagccctggctccgggggaaccagttctgcatcaagatcctgaacccctacatgccgagcgtggtcgagaccctggagcagatgcagcgcaagcacggcggcatgctcgtgcggaaccccctgtcccgcaacagcacccacgagatgtactgggtgtcctgcgggacgggcaacatcgtcagcgcggtgaacatgacctcccggatgctgctcaaccgcttcaccatggtgcaccgcaagcccacctacgagcgggacgtcgacctgggggccggcacgcgccacgtggccgtggagcccgaggtcgccaacctggacatcatcggccagcggatcgagaacatcaagcacgagcacaagagcacctggcactacgacgaggacaacccgtacaagacctgggcctaccacgggtcctacgaggtgaagcccagcggctccgcgagcagcatggtcaacggggtggtgaagctcctgaccaagccctgggacgtcatccccatggtgacgcagatcgccatgaccgacaccaccccgttcggccagcagcgcgtgttcaaggagaaggtcgacacgcggacccccaaggccaagcgcgggaccgcccagatcatggaggtgaccgcccggtggctgtggggcttcctctcccgcaacaagaagccccggatctgcacgcgcgaggagttcacccggaaggtgcgcagcaacgcggccatcggcgccgtcttcatcgacgagaaccagtggaactccgccaaggaggcggtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtggagggcgaggggctgcacaagctcggctacatcctgcgcgacatcagcaagatccccggcgggaacatgtacgccgacgacaccgccgggtgggacacgcggatcaccgaggacgacctgcagaacgaggccaagatcaccgacatcatggagtccgagcacgccctcctggccaagagcatcttcaagctgacctaccagaacaaggtggtccgcgtgcagcgccccgccaagaacgggacggtgatggacgtcatctcccggcgcgaccagcggggcagcggccaggtgggcacctacggcctcaacaccttcaccaacatggaggcccagctgatccgccagatggagtccgaggggatcttcagcccctccgagctggagacgcccaacctcgccgagcgggccctggactggctggagaagcacggcgtggagcgcctcaagcggatggcgatcagcggggacgactgcgtcgtgaagccgatcgacgaccgcttcgccaccgccctgaccgccctgaacgacatgggcaaggtgcggaaggacatcccccagtgggagccctccaaggggtggaacgactggcagcaggtccccttctgcagccaccacttccaccagctcatcatgaaggacggccgcgagatcgtggtgccgtgccggaaccaggacgagctggtcggccgcgcccgggtgagccagggggcgggctggtccctgcgcgagaccgcctgcctcggcaagagctacgcccagatgtggcagctgatgtacttccaccggcgcgacctgcggctcgccgcgaacgccatctgctccgccgtgcccgtcgactgggtgcccacgagccgcaccacctggtccatccacgcccaccaccagtggatgaccacggaggacatgctgagcgtgtggaaccgggtctggatcgaggagaacccctggatggaggacaagacccacatctccagctgggaggacgtgccgtacctgggcaagcgcgaggaccagtggtgcgggtccctcatcggcctgaccgcccgcgcgacctgggccaccaacatccaggtggccatcagccaggtccggcgcctgatcggcaacgagaactacctcgactacatgacgtccatgaagcggttcaagaacgagagcgaccccgagggggccctgtggtga

SEQ ID NO: 8959 - RNA, 9879 nt, synthetic construct
  misc_feature 1..9879: note = derived and/or modified CDS sequence (opt1) from DENV-1__EU848545__SS-prME
  source 1..9879: mol_type = other RNA
agcgtgaccatgctgctcatgctgctgcccaccgccctcgccttccacctgaccacccgcggcggggagccgcacatgatcgtgagcaagcaggagcggggcaagagcctcctgttcaagaccagcgccggggtgaacatgtgcaccatcatcgccatggacctgggcgagctgtgcgaggacaccatgacctacaagtgcccccgcatcaccaaggccgagcccgacgacgtggactgctggtgcaacgccaccgacacctgggtgacctacgggacctgcagccggaccggcgagcaccgccgggacaagcgctccgtggccctcgcgccccacgtgggcctggggctggagacccgggccgagacctggatgagcagcgagggcgcctggaagcagatccagaaggtcgagacctgggccctccgccacccggggttcaccgtgatcgcgctgttcctggcccacgccatcggcacgagcatcacccagaaggggatcatcttcatcctcctgatgctggtgaccccctccatggccatgcggtgcgtcggcatcggcaaccgcgacttcgtggaggggctcagcggcgccacctgggtggacgtcgtgctggagcacgggtcctgcgtgacgaccatggcgaaggacaagcccaccctggacatcgagctcctgaagaccgaggtcacgaagcccgccgtgctgcggaagctctgcatcgaggccaagatcagcaacaccaccaccgactcccgctgcccgacgcagggcgaggccaccctggtggaggagcaggacgccaacttcgtctgccggcgcaccttcgtggaccggggctgggggaacggctgcgggctgttcggcaaggggagcctcatcacgtgcgcgaagttcaagtgcgtgacgaagctggagggcaagatcgtccagtacgagaacctgaagtactccgtgatcgtgaccgtccacaccggcgaccagcaccaggtggggaacgagaccacggagcacggcaccatcgccaccatcacgccccaggcccccaccagcgagatccagctcacggactacggggccctgaccctggactgcagcccccgcaccggcctcgacttcaacgagatggtcctgctgaccatgaaggagaagtcctggctcgtgcacaagcagtggttcctggacctgccgctcccctggacgtccggggccagcacgccccaggagacctggaaccgggaggacctgctggtgaccttcaagacggcgcacgccaagaagcaggaggtcgtggtgctcggcagccaggagggcgccatgcacaccgccctgaccggggccaccgagatccagacgtccggcaccaccaagatcttcgcggggcacctgaagtgccgcctcaagatgaacaagctgaccctgaagggcatgagctacgtcatgtgcacggggtccttcaagctcgagaaggaggtggccgagacccagcacggcaccgtgctggtccaggtgaagtacgagggcaccgacgccccctgcaagatcccgttcagcacgcaggacgagaagggggtgacccagaacggccggctgatcaccgccaaccccatcgtcaccgacaaggagaagcccgtgaacatcgaggcggagcccccgttcggggagtcctacatcgtggtcggcgccggcgagaaggccctgaagctcagctggttcaagaaggggtccagcatcggcaagatgctggaggccacggcccgcggggcgcggcgcatggccatcctgggcgacaccgcctgggacttcgggtccatcggcggcgtgttcaccagcgtggggaagctcgtccaccagatcttcggcaccgcctacggggtgctgttctccggcgtgagctggacgatgaagatcgggatcggcatcctgctcacctggctgggcctgaactcccgcagcgcctccctcagcatgacctgcatcgcggtcgggatggtgaccctgtacctgggcgtgatggtccaggccgactccgggtgcgtgatcaactggaagggccgggagctcaagtgcgggagcggcatcttcgtgacgaacgaggtccacacctggaccgagcagtacaagttccaggccgactcccccaagcgcctgagcgccgccatcggcaaggcgtgggaggagggggtgtgcggcatccggagcgccacccgcctggagaacatcatgtggaagcagatctccaacgagctcaaccacatcctgctggagaacgacatgaagttcacggtggtcgtgggggacgtgagcggcatcctcacccaggggcggaagatgatcggcccccagcccatggagcacaagtactcctggaagtcctggggcaaggccaagatcatcggggccgacgtccagaacaccaccttcatcatcgacggcccgaacacccccgagtgccccgacgaccagcgcgcgtggaacatctgggaggtggaggactacgggttcggcatcttcacgaccaacatctggctgaagctgcgggactcctacacccaggtgtgcgacccccgcctcatgagcgccgccatcaaggactccaaggccgtccacgccgacatgggctactggatcgagagcgagaagaacgagacctggaagctggcgcgggcctccttcatcgaggtgaagacgtgcgtgtggcccaagagccacaccctgtggtccaacggggtcctcgagagcgagatgatcatccccaagatctacggcgggcccatctcccagcacaactaccgcccgggctacagcacccagaccgccgggccctggcacctgggcaagctggagctcgacttcgacctgtgcgagggcacgaccgtggtggtcgacgagcactgcgggaaccggggcccctccctgcgcaccaccacggtgaccgggaagatcatccacgagtggtgctgccggagctgcaccctgcccccgctgcgcttcaagggcgaggacgggtgctggtacggcatggagatccggcccgtgaaggacaaggaggagaacctggtcaagtccctcgtgagcgccggcagcggggaggtggactccttcagcctgggcctgctctgcatctccatcatgatcgaggaggtcatgcgcagccggtggtcccgcaagatgctgatgaccgggacgctggccgtgttcctcctgctgatcatgggccagctcacctggaacgacctgatccggctgtgcatcatggtgggggcgaacgccagcgaccgcatgggcatgggcaccacctacctcgccctgatggccacgttcaagatgcgccccatgttcgccgtcgggctcctcttccggcgcctgacctcccgggaggtgctgctcctgaccatcgggctgagcctcgtcgcgtccgtggagctgcccaacagcctggaggagctcggggacggcctggccatgggcatcatgatcctgaagctcctgaccgacttccagtcccaccagctgtgggccgccctcctgagcctgacgttcatcaagaccaccttctccctccactacgcgtggaagaccgtggccatggtcctgagcatcgtgtccctgttcccgctctgcctgagcacgacctcccagaagaccacctggctgcccgtgctcctggggagcctgggctgcaagcccctcacgatgttcctgatcgccgagaacaagatctgggggcgcaagtcctggcccctgaacgagggcatcatggccgtcgggatcgtgagcatcctcctgagctccctgctcaagaacgacgtgccgctggccggccccctgatcgcgggcgggatgctcatcgcctgctacgtcatcagcggctccagcgccgacctgtccctggagaaggccgccgagatcagctgggaggaggaggcggagcactccggggccagccacaacatcctcgtggaggtgcaggacgacggcaccatgaagatcaaggacgaggagcgggacgacaccctgaccatcctgctcaaggccacgctgctggccgtctccggggtgtaccccatcagcatccccgccaccctcttcgtgtggtacttctggcagaagaagaagcagcgctccggcgtcctgtgggacaccccgtccccgcccgaggtggagcgggcggtgctggacgacggcatctaccgcatcctgcagcgggggctcctgggccgctcccaggtcggggtgggcgtgttccaggagggggtcttccacaccatgtggcacgtgacccggggcgccgtgctgatgtaccagggcaagcgcctcgagcccagctgggcctccgtcaagaaggacctgatcagctacgggggcgggtggcggttccagggctcctggaacacgggggaggaggtccaggtgatcgccgtcgagccgggcaagaaccccaagaacgtgcagaccgcccccggcaccttcaagacccccgagggggaggtgggcgcgatcgccctggacttcaagccggggacgagcggctcccccatcgtcaaccgcgagggcaagatcgtggggctctacggcaacggggtggtcaccaccagcggcacctacgtgagcgccatcgcccaggcgaaggcctcccaggaggggcccctgccggagatcgaggacgaggtgttccggaagcgcaacctgacgatcatggacctccaccccggcagcggcaagacccggcgctacctgcccgccatcgtccgggaggccatcaagcgcaagctgcggaccctcatcctggcccccacccgcgtggtggcgtccgagatggccgaggccctgaaggggatgccgatccgctaccagacgaccgccgtcaagagcgagcacaccggccgggagatcgtggacctcatgtgccacgccaccttcacgatgcgcctgctgtcccccgtgcgggtccccaactacaacatgatcatcatggacgaggcgcacttcaccgaccccgccagcatcgccgcccgcgggtacatctccacccgggtgggcatgggggaggccgcggccatcttcatgaccgccacgccgcccggcagcgtggaggccttcccccagtccaacgcggtcatccaggacgaggagcgcgacatccccgagcggagctggaactccggctacgactggatcaccgacttcccggggaagaccgtgtggttcgtgcccagcatcaagtccggcaacgacatcgccaactgcctccgcaagaacgggaagcgggtcatccagctgagccgcaagaccttcgacacggagtaccagaagaccaagaacaacgactgggactacgtggtgaccaccgacatctccgagatgggcgccaacttccgggccgaccgcgtcatcgacccccggcgctgcctgaagcccgtgatcctcaaggacgggccggagcgggtcatcctggccggccccatgcccgtgacggtggcgagcgccgcccagcgccggggccgcatcgggcggaaccagaacaaggagggcgaccagtacatctacatggggcagcccctgaacaacgacgaggaccacgcccactggaccgaggccaagatgctcctggacaacatcaacaccccggagggcatcatccccgcgctgttcgagcccgagcgcgggaagtccgccgccatcgacggcgagtaccgcctccggggcgaggcccgcaagaccttcgtcgagctgatgcggcgcggggacctgcccgtgtggctcagctacaaggtggcctccgagggcttccagtacagcgaccggaagtggtgcttcgacggggagcgcaacaaccaggtcctggaggagaacatggacgtggagatctggacgaaggagggcgagcggaagaagctgcgcccgcggtggctcgacgcgcgcacctacagcgacccccaggccctgcgggagttcaaggagttcgccgccggccgccggtccgtgagcggggacctgatcctcgagatcggcaagctgccccagcacctgacccagcgcgcgcagaacgccctcgacaacctggtcatgctgcacaactccgagcagggcgggaaggcctaccggcacgccatggaggagctccccgacaccatcgagacgctgatgctgctcgccctgatcgcggtgctgaccgggggcgtgaccctcttcttcctgagcggccgcgggctgggcaagacctccatcgggctcctgtgcgtcatggccagctccgtgctgctctgggtggccagcgtcgagccgcactggatcgccgcctccatcatcctggagttcttcctgatggtgctcctgatccccgagcccgaccggcagcgcacgccgcaggacaaccagctggcgtacgtggtcatcggcctcctgttcatgatcctgaccgtggccgccaacgagatggggctcctggagaccaccaagaaggacctgggcatcggccacgtggccgtcgagaaccaccaccacgccaccatgctcgacgtggacctgcggcccgcgagcgcctggacgctgtacgccgtggccaccaccatcatcacccccatgatgcgccacacgatcgagaacaccaccgccaacatctccctcaccgcgatcgccaaccaggccgccatcctgatggggctggacaagggctggcccatcagcaagatggacatcggggtcccgctcctggcgctgggctgctactcccaggtgaaccccctcacgctgatcgccgccgtgctgatgctcgtcgcccactacgccatcatcgggcccggcctgcaggcgaaggccacccgggaggcccagaagcgcaccgccgccggcatcatgaagaaccccaccgtggacgggatcgtggcgatcgacctggacccggtcgtgtacgacgccaagttcgagaagcagctcggccagatcatgctgctgatcctctgcacgagccagatcctgctgatgcgcaccacctgggccctctgcgagtccatcaccctggccacggggcccctgaccaccctctgggagggcagccccggcaagttctggaacaccacgatcgccgtgtccatggcgaacatcttccgggggagctacctggccggcgccgggctggccttctccctcatgaagtccctgggcgggggccgccggggcaccggggcgcagggcgagaccctgggggagaagtggaagcgccagctcaaccagctgagcaagtccgagttcaacacctacaagcggagcggcatcatggaggtcgaccgctccgaggccaaggaggggctgaagcggggcgagacgaccaagcacgccgtgagccgcggcaccgccaagctccggtggttcgtggagcgcaacctggtcaagcccgaggggaaggtgatcgacctgggctgcgggcggggcgggtggtcctactactgcgccggcctgaagaaggtgaccgaggtcaagggctacacgaagggcgggccggggcacgaggagcccatccccatggcgacctacggctggaacctcgtgaagctgcacagcgggaaggacgtgttcttcacgcccccggagaagtgcgacaccctgctctgcgacatcggcgagtccagccccaaccccacgatcgaggagggccgcaccctgcgggtcctgaagatggtggagccctggctccgcgggaaccagttctgcatcaagatcctgaacccgtacatgccctccgtggtcgagaccctggagcagatgcagcggaagcacggcgggatgctcgtgcgcaaccccctgagccggaactccacccacgagatgtactgggtgagctgcggcacgggcaacatcgtctccgccgtgaacatgaccagccgcatgctgctcaaccggttcaccatggcccaccgcaagcccacctacgagcgcgacgtggacctgggggccggcacccggcacgtcgccgtggagccggaggtcgcgaacctggacatcatcgggcagcgcatcgagaacatcaagaacgagcacaagtccacgtggcactacgacgaggacaacccctacaagacctgggcctaccacggcagctacgaggtgaagccctccgggagcgcctccagcatggtgaacggcgtcgtgcggctcctgaccaagccctgggacgtgatcccgatggtcacccagatcgccatgacggacaccacccccttcggccagcagcgcgtgttcaaggagaaggtggacacccggacgcccaaggccaagcgcgggaccgcgcagatcatggaggtcaccgcccggtggctgtggggcttcctcagccgcaacaagaagccgcggatctgcacccgcgaggagttcacgcggaaggtgcgctccaacgccgccatcggggcggtgttcgtcgacgagaaccagtggaacagcgccaaggaggccgtggaggacgagcggttctgggacctggtgcaccgcgagcgggagctgcacaagcagggcaagtgcgcgacctgcgtctacaacatgatggggaagcgcgagaagaagctcggcgagttcggcaaggccaaggggtcccgggcgatctggtacatgtggctgggcgcccgcttcctggagttcgaggccctcgggttcatgaacgaggaccactggttcagccgggagaactccctgagcggcgtggagggggagggcctgcacaagctcggctacatcctgcgcgacatctccaagatccccgggggcaacatgtacgccgacgacaccgccgggtgggacacccggatcacggaggacgacctgcagaacgaggcgaagatcaccgacatcatggagcccgagcacgccctcctggccaccagcatcttcaagctgacctaccagaacaaggtggtccgcgtgcagcgccccgccaagaacggcacggtgatggacgtcatctcccggcgcgaccagcggggcagcggccaggtgggcacctacgggctcaacaccttcaccaacatggaggtgcagctgatccgccagatggagtccgagggcatcttcagcccgtccgagctggagacgcccaacctcgccgagcgggtcctggactggctggagaagcacggggtggagcgcctcaagcggatggcgatcagcggcgacgactgcgtggtcaagcccaccgacgaccgcttcgccaccgccctgaccgccctgaacgacatgggcaaggtgcggaaggacatcccccagtgggagccgtccaaggggtggaacgactggcagcaggtccccttctgcagccaccacttccaccagctcatcatgaaggacggccgcgagatcgtcgtgccctgccggaaccaggacgagctggtggggcgcgcccgggtctcccagggcgcggggtggagcctgcgcgagacggcctgcctcggcaagagctacgcccagatgtggcagctgatgtacttccaccggcgcgacctgcggctcgccgcgaacgccatctgctccgccgtgcccatcgactgggtgccgaccagccgcaccacctggtccatccacgcccaccaccagtggatgacgaccgaggacatgctgagcgtctggaaccgggtgtggatcgaggagaacccctggatggaggacaagacccacgtgtccagctgggaggacgtcccctacctgggcaagcgcgaggaccagtggtgcgggtccctcatcggcctgaccgcccgcgcgacgtgggccaccaacatccaggtggccatcaaccaggtgcggcgcctgatcgggaacgagaactacctcgactacatgaccagcatgaagcggttcaagaacgagtccgacctggagggcgccctgtggtga

SEQ ID NO: 8960 - RNA, 9879 nt, synthetic construct
  misc_feature 1..9879: note = derived and/or modified CDS sequence (opt1) from DENV-1__KR024708__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgccggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggaagcagatccagaaggtggagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccgcaagctgtgcatcgaggccaagatcagcaacaccaccacggactcccggtgccccacccagggcgaggccaccctggtggaggagcaggacgccaacttcgtctgccgccggaccttcgtggaccgcggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccgccaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccggctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccgcctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccgccggatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgcgagctgaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcaccgtcgtggtgggggacgccaacggcatcctgacgcaggggaagaagatgatccgcccccagcccatggagcacaagtactcctggaagtcctggggcaaggcgaagatcatcggcgccgacacccagaacaccaccttcatcatcgacgggcccgacacgccggagtgccccgacgaccagcgggcctggaacatctgggaggtcgaggactacggcttcggggtgttcaccaccaacatctggctgaagctccgcgactcctacacccagatgtgcgaccaccggctgatgagcgccgcgatcaaggactccaaggccgtgcacgccgacatgggctactggatcgagagcgagaagaacgagacgtggaagctggcccgcgcctccttcatcgaggtcaagacctgcatctggccccggagccacaccctctggtccaacggcgtgctggagagcgagatgatcatccccaagatctacgggggcccgatctcccagcacaactaccgccccgggtacttcacccagacggcgggcccctggcacctggggaagctcgagctggacttcaacctgtgcgagggcaccaccgtggtcgtggacgagcactgcggcaaccgggggccgagcctccgcaccacgaccgtgaccggcaagatcatccacgagtggtgctgccggtcctgcaccctgccgcccctgcgcttccgcggggaggacggctgctggtacgggatggagatccgccccgtcaaggagaaggaggagaacctcgtgcggagcatggtgtccgccggcagcggcgaggtcgacagcttctccctggggctgctctgcgtgagcatcatgatcgaggaggtgatgcgctcccggtggagccgcaagatgctgatgacgggcaccctggccgtcttcttcctcctgatcatggggcagctgacctggaacgacctcatccgcctgtgcatcatggtgggcgccaacgtgtccgaccggatggggatgggcaccacgtacctggccctcatggcgaccttcaagatgcgcccgatgttcgccgtcgggctgctgttccggcgcctcaccagccgggaggtgctgctgctcaccatcgggctgtccctggtcgccagcgtggagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcctggaagaccatggcgatggtgctgtccatcgtcagcctgttccccctctgcctgtccaccacgagccagaagaccacctggctgcccgtgctcctgggctccttcgggtgcaagccgctgaccatgttcctcatcaccgagaacaagatctggggccgcaagagctggcccctgaacgaggggatcatggccgtgggcatcgtctccatcctgctcagcagcctgctgaagaacgacgtgcccctcgccgggcccctgatcgccggcggcatgctgatcgcgtgctacgtgatctccgggagctccgccgacctcagcctggagcgggccgccgaggtctcctgggaggaggaggccgagcacagcggcgcgtcccacaacatcctggtggaggtgcaggacgacgggacgatgaagatcaaggacgaggagcgcgacgacaccctcaccatcctgctgaaggccaccctcctggccgtcagcggcgtgtacccgatgtccatccccgccacgctgttcgtgtggtacttctggcagaagaagaagcagcggagcggggtcctctgggacacccccagcccgcccgaggtggagcgcgccgtgctggacgacggcatctaccggatcctgcagcgcggcctgctcgggcggagccaggtcggcgtgggggtgttccaggacggcgtcttccacaccatgtggcacgtgacccgcggggcggtgctgatgtaccagggcaagcggctggagccctcctgggccagcgtcaagaaggacctcatctcctacggcgggggctggcgcttccaggggagctggaacacgggcgaggaggtccaggtgatcgccgtcgagcccgggaagaaccccaagaacgtgcagaccacccccggcaccttcaagacgcccgagggcgaggtgggggccatcgccctggacttcaagcccggcacctccgggagccccatcgtcaaccgggagggcaagatcgtgggcctgtacgggaacggcgtggtcaccacctccgggacgtacgtgagcgcgatcgcccaggccaaggccagccaggagggcccgctccccgagatcgaggacgaggtgttcaagaagcgcaacctgaccatcatggacctgcaccccgggtccggcaagacccggcgctacctcccggccatcgtccgggaggcgatcaagcgcaagctgcgcaccctgatcctcgcccccacgcgggtggtggccagcgagatggccgaggcgctgaagggcatgcccatccgctaccagaccaccgccgtcaagtccgagcacaccgggaaggagatcgtggacctgatgtgccacgccacgttcaccatgcggctcctgagccccgtgcgcgtcccgaactacaacatgatcatcatggacgaggcccacttcaccgaccccgcctccatcgcggcccggggctacatcagcacccgcgtggggatgggcgaggccgccgccatcttcatgacggcgacgccgcccgggtccgtggagagcttcccgcagtccaacgccgtcatccaggacgaggagcgggacatccccgagcgcagctggaactccggctacgactggatcaccgacttccccggcaagaccgtgtggttcgtgcccagcatcaagtccgggaacgacatcgccaactgcctgcggaagaacggcaagcgcgtcatccagctcagccggaagacgttcgacaccgagtaccagaagaccaagaacaacgactgggactacgtggtgaccacggacatctccgagatgggggccaacttccgcgccgaccgggtcatcgacccgcgccggtgcctgaagcccgtgatcctgaaggacggccccgagcgcgtcatcctcgcggggcccatgccggtgaccgccgccagcgccgcgcagcggcgcggccggatcggccgcaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgcgagaagtccgccgcgatcgacggcgagtaccggctgcgcggggaggcccggaagacgttcgtggagctcatgcgccggggcgacctgcccgtctggctgagctacaaggtggcctccgagggcttccagtacagcgaccgccggtggtgcttcgacggggagcgcaacaaccaggtgctcgaggagaacatggacgtcgagatctggaccaaggagggcgagcggaagaagctgcgcccccggtggctggacgcccgcacctacagcgaccccctcgccctgcgggagttcaaggagttcgcggccgggcgccggtccgtgagcggcgacctgatcctcgagatcggcaagctgccgcagcacctgaccctccgcgcccagaacgccctggacaacctggtgatgctccacaactccgagcagggcgggaaggcctaccggcacgcgatggaggagctgcccgacaccatcgagacgctgatgctcctggccctgatcgccgtcctcaccgggggcgtgaccctgttcttcctgagcgggaagggcctcggcaagacctccatcgggctgctgtgcgtgatggccagctccgtcctcctgtggatggcgagcgtggagccccactggatcgccgcctccatcatcctggagttcttcctcatggtgctgctgatccccgagccggaccgccagcggacgccccaggacaaccagctcgcctacgtcgtgatcggcctgctgttcatgatcctcaccgtggccgcgaacgagatggggctgctggagaccaccaagaaggacctcggcatcgggcacgtcgtggccgagaaccaccaccacgccacgatgctggacatcgacctgcaccccgccagcgcctggaccctctacgcggtggccaccaccatcatcacgccgatgatgcgccacaccatcgagaacaccaccgccaacatctccctgacggccatcgccaaccaggcggccatcctgatgggcctcgacaagggctggcccatcagcaagatggacatcggggtccccctgctggccctcggctgctactcccaggtgaaccccctgaccctgaccgccgccgtgctcatgctggtcgcgcactacgccatcatcgggccgggcctgcaggccaaggccacccgggaggcgcagaagcgcacggccgccgggatcatgaagaaccccaccgtggacggcatcgtggccatcgacctcgaccccgtcgtgtacgacgccaagttcgagaagcagctgggccagatcatgctgctcatcctgtgcaccagccagatcctgctcatgcgcaccacgtgggcgctgtgcgagtccatcaccctggccaccgggcccctcaccacgctgtgggagggcagcccggggaagttctggaacaccaccatcgccgtgtccatggccaacatcttccggggcagctacctggccggcgcggggctcgccttctccctgatgaagtccctgggcgggggccgccgggggaccggcgcccagggcgagacgctcggggagaagtggaagcgccagctgaaccagctgagcaagtccgagttcaacacctacaagcggagcggcatcatggaggtcgaccgctccgaggccaaggaggggctcaagcggggcgagaccaccaagcacgccgtgagccgcgggacggcgaagctgcggtggttcgtggagcgcaacctggtcaagcccgagggcaaggtgatcgacctgggctgcgggcggggcgggtggtcctactactgcgccggcctcaagaaggtgaccgaggtcaaggggtacaccaagggcggccccgggcacgaggagcccatcccgatggccacctacggctggaacatcgtgaagctgcacagcgggcgcgacgtgttcttcacgccgcccgagaagtgcgacacgctgctctgcgacatcggcgagtccagccccaacccgaccatcgaggaggggcggaccctgcgcgtcctgaagatggtggagccctggctccggggcaaccagttctgcatcaagatcctgaacccctacatgccctccgtggtcgagaccctggagcagatgcagcgcaagcacggcgggatgctcgtgcggaacccgctgagccgcaactccacgcacgagatgtactgggtgagctgcggcaccgggaacatcgtctccgccgtgaacatgaccagccggatgctgctcaaccgcttcaccatggcgcaccgcaagcccacgtacgagcgggacgtggacctgggcgccggcacccgccacgtcgccgtggagcccgagatcgccaacctggacatcatcgggcagcggatcgagaacatcaagaacgagcacaagtccacctggcactacgacgaggacaacccctacaagacctgggcctaccacggcagctacgaggtgaagccgtccgggagcgcgtccagcatggtcaacggcgtggtccgcctcctgacgaagccctgggacgtgatccccatggtgacccagatcgccatgaccgacaccacgcccttcgggcagcagcgggtcttcaaggagaaggtggacacccgcaccccgcggcccaagcgcggcaccgcccagatcatggaggtgacggccaagtggctgtggggcttcctcagccggaacaagaagccccgcatctgcacccgggaggagttcacccgcaaggtccggtccaacgccgcgatcggggccgtgttcgtggacgagaaccagtggaacagcgccaaggaggccgtcgaggacgagcgcttctgggacctggtgcaccgggagcgcgagctgcacaagcagggcaagtgcgcgacctgcgtgtacaacatgatggggaagcgggagaagaagctcggcgagttcgggaaggcgaagggctcccgcgccatctggtacatgtggctgggcgcccggttcctggagttcgaggccctcgggttcatgaacgaggaccactggttcagccgcgagaactccctgagcggcgtcgagggggagggcctgcacaagctcgggtacatcctgcgggacatctccaagatcccgggcggcaacatgtacgcggacgacacggccgggtgggacacccgcatcaccgaggacgacctgcagaacgaggccaagatcaccgacatcatggagcccgagcacgccctcctggccacgagcatcttcaagctgacctaccagaacaaggtggtgcgcgtccagcggcccgcgaagtccggcaccgtgatggacgtgatcagccgccgggaccagcgcgggtccggccaggtcggcacctacgggctcaacacgttcaccaacatggaggtgcagctgatccggcagatggagagcgagggcatcttctcccccagcgagctggagaactccaacctcgccgagcgcgtgctggactggctggagaagcacggggtcgagcggctcaagcgcatggccatcagcggcgacgactgcgtggtgaagccgaccgacgaccggttcgccaccgccctgacggcgctgaacgacatggggaaggtccgcaaggacatcccccagtgggagccctccaagggctggaacgactggcagcaggtccccttctgcagccaccacttccaccagctcatcatgaaggacggccgggagatcgtggtcccgtgccgcaaccaggacgagctggtggggcgggcccgcgtgagccagggcgccgggtggtccctgcgggagaccgcctgcctcggcaagagctacgcccagatgtggcagctgatgtacttccaccgccgggacctgcgcctcgcggccaacgccatctgctccgccgtccccgtgaactgggtgcccaccagccggaccacctggtccatccacgcccaccaccagtggatgacgaccgaggacatgctgagcgtctggaaccgcgtgtggatcgaggagaacccctggatggaggacaagacccacgtgtccagctgggaggacgtcccgtacctggggaagcgcgaggaccagtggtgcggctccctcatcggcctgaccgcgcgggccacgtgggccaccaacatccaggtggccatcaaccaggtgcgccggctgatcgggaacgagaactacctcgactacatgaccagcatgaagcgcttcaagaacgagtccgaccccgagggcgcgctgtggtga

SEQ ID NO: 8961 - RNA, 9879 nt, synthetic construct
  misc_feature 1..9879: note = derived and/or modified CDS sequence (opt1) from DENV-1__KR024705__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgccggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggaagcagatccagaaggtggagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccgcaagctgtgcatcgaggccaagatcagcaacgccaccaccgactcccggtgccccacgcagggcgaggccaccctggtggaggagcaggacgccaacttcgtctgccgccggaccttcgtggaccgcggctgggggaacggctgcggcctcttcggcaaggggagcctgctgacctgcgcgaagttcaagtgcgtgacgaagctcgagggcaagatcgtccagtacgagaacctgaagtactccgtgatcgtgaccgtccacaccggcgaccagcaccaggtggggaacgagaccacggagcacggcaccatcgccaccatcacgccccaggcccccaccagcgagatccagctgacggactacggggccctcaccctggactgcagcccccggaccggcctggacttcaacgagatggtcctcctgaccatgaaggagaagtcctggctggtgcacaagcagtggttcctcgacctgccgctgccctggacgtccggggccagcaccagccaggagacctggaaccgccaggacctcctggtgaccttcaagacggcgcacgccaagaagcaggaggtcgtggtgctgggctcccaggagggcgccatgcacaccgccctcaccggggccaccgagatccagacgagcggcaccaccaccatcttcgcggggcacctgaagtgccggctgaagatggacaagctcacgctgaagggcgtctcctacgtgatgtgcaccgggagcttcaagctggagaaggaggtggccgagacccagcacggcaccgtcctggtccaggtgaagtacgagggcacggacgccccctgcaagatccccatctccacccaggacgagaagggggtcacccagaacggccgcctcatcaccgccaacccgatcgtgacggacaaggagaagcccgtgaacatcgagaccgagccgcccttcggggagagctacatcgtcatcggcgcgggcgagaaggccctgaagctgtcctggttcaagaaggggagctccatcggcaagatgttcgaggccaccgcccgcggggcccgccggatggcgatcctcggcgacaccgcctgggacttcgggagcatcggcggcgtgttcacgtccgtggggaagctggtccaccaggtgttcggcaccgcctacggggtgctgttcagcggcgtctcctggaccatgaagatcgggatcggcatcctcctgacctggctgggcctcaacagccgctccacgagcctgtccatgacctgcatcgccgtggggatggtgaccctgtacctcggcgtcatggtgcaggccgacagcgggtgcgtgatcaactggaagggccgcgagctgaagtgcgggtccggcatcttcgtcaccaacgaggtgcacacgtggaccgagcagtacaagttccaggcggacagcccgaagcggctgagcgccgccatcggcaaggcctgggaggagggggtgtgcggcatccgctccgccacccggctcgagaacatcatgtggaagcagatcagcaacgagctgaaccacatcctgctcgagaacgacatgaagttcaccgtcgtggtgggggacgcgaacggcatcctgacccaggggaagaagatgatccgcccccagcccatggagcacaagtactcctggaagtcctggggcaaggccaagatcatcggcgccgacacgcagaacaccaccttcatcatcgacgggcccgacaccccggagtgccccgacgaccagcgggcctggaacatctgggaggtcgaggactacggcttcggggtgttcacgaccaacatctggctgaagctccgcgactcctacacccagatgtgcgaccaccggctgatgagcgcggccatcaaggactccaaggccgtgcacgccgacatgggctactggatcgagagcgagaagaacgagacctggaagctggcccgcgcgtccttcatcgaggtcaagacgtgcatctggccccggagccacaccctctggtccaacggcgtgctggagagcgagatgatcatccccaagatctacgggggcccgatctcccagcacaactaccgccccgggtacttcacccagaccgccggcccctggcacctggggaagctcgagctggacttcaacctgtgcgagggcacgaccgtggtcgtggacgagcactgcggcaaccgggggccgagcctccgcaccaccacggtgaccggcaagatcatccacgagtggtgctgccggtcctgcaccctgccgcccctgcgcttccgcggggaggacggctgctggtacgggatggagatccgccccgtcaaggagaaggaggagaacctcgtgcggagcatggtgtccgccggcagcggcgaggtcgacagcttctccctggggctgctctgcgtgagcatcatgatcgaggaggtgatgcgctcccggtggagccgcaagatgctgatgaccggcacgctggccgtcttcttcctcctgatcatggggcagctgacctggaacgacctcatccgcctgtgcatcatggtgggcgccaacgtgtccgaccggatggggatgggcaccacctacctggcgctcatggccacgttcaagatgcgcccgatgttcgccgtcggcctgctgttccggcgcctcaccagccgggaggtgctgctgctcaccatcgggctgtccctggtcgccagcgtggagctccccaactccctggaggagctgggcgacgggctcgccatgggcatcatgatgctgaagctgctcaccgacttccagagccaccagctgtggacgaccctgctctccctgaccttcatcaagaccacgctgagcctcgactacgcgtggaagaccatggccatggtgctgtccatcgtcagcctgttccccctctgcctgtccaccaccagccagaagacgacctggctgcccgtgctcctgggctccttcgggtgcaagccgctgaccatgttcctcatcaccgagaacaagatctggggccgcaagagctggcccctgaacgaggggatcatggccgtgggcatcgtctccatcctgctcagcagcctgctgaagaacgacgtgcccctcgccgggcccctgatcgcgggcggcatgctgatcgcctgctacgtgatctccgggagctccgccgacctcagcctggagcgggccgccgaggtctcctgggaggaggaggcggagcacagcggcgcctcccacaacatcctggtggaggtgcaggacgacgggaccatgaagatcaaggacgaggagcgcgacgacacgctcaccatcctgctgaaggccaccctcctggccgtcagcggcgtgtacccgatgtccatccccgccaccctgttcgtgtggtacttctggcagaagaagaagcagcggagcggggtcctctgggacacgcccagcccgcccgaggtggagcgcgcggtgctggacgacggcatctaccggatcctgcagcgcggcctgctcgggcggagccaggtcggcgtgggggtgttccaggacggcgtcttccacaccatgtggcacgtgacccgcggggccgtgctgatgtaccagggcaagcggctggagccctcctgggccagcgtcaagaaggacctcatctcctacggcgggggctggcgcttccaggggagctggaacaccggcgaggaggtccaggtgatcgccgtcgagcccgggaagaaccccaagaacgtgcagacgacccccggcaccttcaagacccccgagggcgaggtgggggccatcgcgctggacttcaagcccggcacgtccgggagccccatcgtcaaccgggagggcaagatcgtgggcctgtacgggaacggcgtggtcaccacctccgggacctacgtgagcgccatcgcccaggccaaggccagccaggagggcccgctccccgagatcgaggacgaggtgttcaagaagcgcaacctgacgatcatggacctgcaccccgggtccggcaagacccggcgctacctcccggcgatcgtccgggaggccatcaagcgcaagctgcgcaccctgatcctcgcccccacccgggtggtggccagcgagatggcggaggccctgaagggcatgcccatccgctaccagacgaccgccgtcaagtccgagcacaccgggaaggagatcgtggacctgatgtgccacgccaccttcacgatgcggctcctgagccccgtgcgcgtcccgaactacaacatgatcatcatggacgaggcccacttcaccgaccccgcgtccatcgccgcccggggctacatcagcacccgcgtggggatgggcgaggccgccgcgatcttcatgaccgccacgccgcccgggtccgtggaggccttcccgcagagcaacgccgtcatccaggacgaggagcgggacatccccgagcgctcctggaacagcggctacgactggatcaccgacttccccggcaagaccgtgtggttcgtgccctccatcaagagcgggaacgacatcgccaactgcctgcggaagaacggcaagcgcgtcatccagctctcccggaagaccttcgacacggagtaccagaagaccaagaacaacgactgggactacgtggtgaccaccgacatcagcgagatgggggcgaacttccgcgccgaccgggtcatcgacccgcgccggtgcctgaagcccgtgatcctgaaggacggccccgagcgcgtcatcctcgccgggcccatgccggtgacggccgcgtccgccgcccagcggcgcggccggatcggccgcaaccagaacaaggagggggaccagtacatctacatgggccagcccctgaacaacgacgaggaccacgcccactggaccgaggccaagatgctgctcgacaacatcaacacccccgaggggatcatccccgcgctgttcgagccggagcgcgagaagtccgccgccatcgacggcgagtaccggctgcgcggggaggcccggaagaccttcgtggagctcatgcgccggggcgacctgcccgtctggctgtcctacaaggtggccagcgagggcttccagtactccgaccgccggtggtgcttcgacggggagcgcaacaaccaggtgctcgaggagaacatggacgtcgagatctggacgaaggagggcgagcggaagaagctgcgcccccggtggctggacgcgcgcacctacagcgaccccctcgccctgcgggagttcaaggagttcgccgccgggcgccggagcgtgtccggcgacctgatcctcgagatcggcaagctgccgcagcacctgaccctccgcgcccagaacgcgctggacaacctggtgatgctccacaacagcgagcagggcgggaaggcctaccggcacgccatggaggagctgcccgacaccatcgagaccctgatgctcctggccctgatcgcggtcctcaccggcggggtgaccctgttcttcctgtccgggaaggggctcggcaagaccagcatcgggctgctgtgcgtgatggcctccagcgtcctcctgtggatggcctccgtggagccccactggatcgccgccagcatcatcctggagttcttcctcatggtgctgctgatccccgagccggaccgccagcggacgccccaggacaaccagctcgcgtacgtcgtgatcggcctgctgttcatgatcctcacggtggccgccaacgagatggggctgctggagaccaccaagaaggacctcggcatcgggcacgtcgtggccgagaaccaccaccacgccaccatgctggacatcgacctgcaccccgcgtccgcctggacgctctacgccgtggccaccaccatcatcaccccgatgatgcgccacacgatcgagaacaccaccgccaacatcagcctgaccgcgatcgccaaccaggccgccatcctgatgggcctcgacaagggctggcccatctccaagatggacatcggggtccccctgctggccctcggctgctacagccaggtgaaccccctgacgctgaccgcggccgtgctcatgctggtcgcccactacgccatcatcgggccgggcctgcaggcgaaggccacccgggaggcccagaagcgcaccgccgccgggatcatgaagaaccccacggtggacggcatcgtggcgatcgacctcgaccccgtcgtgtacgacgccaagttcgagaagcagctgggccagatcatgctgctcatcctgtgcacctcccagatcctgctcatgcgcaccacctgggccctgtgcgagagcatcacgctggccaccgggcccctcaccaccctgtgggagggctccccggggaagttctggaacacgaccatcgccgtgagcatggcgaacatcttccggggctcctacctggccggcgccgggctcgccttcagcctgatgaagtccctgggcgggggccgccgggggaccggcgcccagggcgagaccctcggggagaagtggaagcgccagctgaaccagctgagcaagagcgagttcaacacgtacaagcggtccggcatcatggaggtcgaccgcagcgaggcgaaggaggggctcaagcggggcgagaccaccaagcacgccgtgtcccgcgggaccgccaagctgcggtggttcgtggagcgcaacctggtcaagcccgagggcaaggtgatcgacctgggctgcgggcggggcgggtggagctactactgcgccggcctcaagaaggtgacggaggtcaaggggtacaccaagggcggccccgggcacgaggagcccatcccgatggcgacctacggctggaacatcgtgaagctgcactccgggcgcgacgtgttcttcacgccgcccgagaagtgcgacaccctgctctgcgacatcggcgagagctcccccaacccgacgatcgaggaggggcggaccctgcgcgtcctgaagatggtggagccctggctccggggcaaccagttctgcatcaagatcctgaacccctacatgcccagcgtggtcgagaccctggagcagatgcagcgcaagcacggcgggatgctcgtgcggaacccgctgtcccgcaacagcacccacgagatgtactgggtgtcctgcggcacggggaacatcgtcagcgccgtgaacatgacctcccggatgctgctcaaccgcttcaccatggcccaccgcaagcccacctacgagcgggacgtggacctgggcgccggcacgcgccacgtcgccgtggagcccgagatcgcgaacctggacatcatcgggcagcggatcgagaacatcaagaacgagcacaagagcacctggcactacgacgaggacaacccctacaagacctgggcctaccacggctcctacgaggtgaagccgagcgggtccgccagctccatggtcaacggcgtggtccgcctcctgaccaagccctgggacgtgatccccatggtgacgcagatcgccatgaccgacaccacccccttcgggcagcagcgggtcttcaaggagaaggtggacacgcgcaccccgcggcccaagcgcggcaccgcccagatcatggaggtgaccgcgaagtggctgtggggcttcctcagccggaacaagaagccccgcatctgcacgcgggaggagttcacccgcaaggtccggagcaacgccgccatcggggccgtgttcgtggacgagaaccagtggaactccgccaaggaggcggtcgaggacgagcgcttctgggacctggtgcaccgggagcgcgagctgcacaagcagggcaagtgcgcgacctgcgtgtacaacatgatggggaagcgggagaagaagctcggcgagttcgggaaggccaagggcagccgcgccatctggtacatgtggctgggcgcgcggttcctggagttcgaggccctcgggttcatgaacgaggaccactggttctcccgcgagaacagcctgtccggcgtcgagggggagggcctgcacaagctcgggtacatcctgcgggacatcagcaagatcccgggcggcaacatgtacgccgacgacaccgccgggtgggacacgcgcatcaccgaggacgacctgcagaacgaggccaagatcaccgacatcatggagcccgagcacgcgctcctggccacctccatcttcaagctgacgtaccagaacaaggtggtgcgcgtccagcggcccgccaagagcggcaccgtgatggacgtgatctcccgccgggaccagcgcgggagcggccaggtcggcacctacgggctcaacaccttcacgaacatggaggtgcagctgatccggcagatggagtccgagggcatcttcagcccctccgagctggagaacagcaacctcgccgagcgcgtgctggactggctggagaagcacggggtcgagcggctcaagcgcatggccatctccggcgacgactgcgtggtgaagccgaccgacgaccggttcgcgaccgccctgaccgccctgaacgacatggggaaggtccgcaaggacatcccccagtgggagcccagcaagggctggaacgactggcagcaggtccccttctgctcccaccacttccaccagctcatcatgaaggacggccgggagatcgtggtcccgtgccgcaaccaggacgagctggtggggcgggcccgcgtgagccagggcgccgggtggagcctgcgggagacggcgtgcctcggcaagtcctacgcccagatgtggcagctgatgtacttccaccgccgggacctgcgcctcgccgccaacgccatctgcagcgcggtccccgtgaactgggtgcccacctcccggaccacctggagcatccacgcccaccaccagtggatgaccacggaggacatgctgtccgtctggaaccgcgtgtggatcgaggagaacccctggatggaggacaagacccacgtgagctcctgggaggacgtcccgtacctggggaagcgcgaggaccagtggtgcggcagcctcatcggcctgaccgcccgggccacctgggcgacgaacatccaggtggccatcaaccaggtgcgccggctgatcgggaacgagaactacctcgactacatgacctccatgaagcgcttcaagaacgagagcgaccccgagggcgccctgtggtga

SEQ ID NO: 8962 - RNA, 9879 nt, synthetic construct
  misc_feature 1..9879: note = derived and/or modified CDS sequence (opt1) from DENV-1__KR024706__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccgcatcaccggggccgagcccgacgacgtggactgctggtgcaacgccaccgacacctgggtgacctacgggacctgcagccagaccggcgagcaccggcgcgacaagcggtccgtggccctggcgccccacgtggggctgggcctcgagacccgcaccgagacctggatgagctccgagggggcctggcggcagatccagaaggtcgagacctgggccctgcgccaccccggcttcacggtgatcgccttcttcctggcgcacgccatcgggaccagcatcacccagaagggcatcatcttcatcctcctgatgctggtgaccccctccatggccatgcggtgcgtcggcatcgggaaccgcgacttcgtggagggcctcagcggggccacgtgggtggacgtcgtgctggagcacggctcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccctggtggaccgggggtggggcaacgggtgcggcctcttcgggaagggcagcctgctgacgtgcgccaagttcaagtgcgtgaccaagctcgagggcaagatcgtccagtacgagaacctgaagtactccgtgatcgtgaccgtccacaccggggaccagcaccaggtgggcaacgagacgaccgagcacgggaccatcgcgaccatcacgccccaggcccccacgagcgagatccagctgaccgactacggcgccctcaccctggactgcagcccccggaccgggctggacttcaacgagatggtcctcctgacgatgaaggagaagtcctggctggtgcacaagcagtggttcctcgacctgccgctgccctggacctccggcgccagcaccagccaggagacctggaaccggcaggacctcctggtgacgttcaagaccgcccacgcgaagaagcaggaggtcgtggtgctgggctcccaggagggggccatgcacaccgccctcaccggcgccacggagatccagaccagcgggaccaccacgatcttcgccggccacctgaagtgccgcctgaagatggacaagctcaccctgaagggggtctcctacgtgatgtgcaccggcagcttcaagctggagaaggaggtggcggagacccagcacggcacggtcctggtccaggtgaagtacgaggggaccgacgccccctgcaagatccccatctccacccaggacgagaagggcgtcacccagaacgggcggctcatcacggccaacccgatcgtgaccgacaaggagaagcccgtgaacatcgagaccgagccgcccttcggcgagagctacatcgtcatcggcgccggggagaaggcgctgaagctgtcctggttcaagaagggcagctccatcgggaagatgttcgaggccaccgcccgcggcgcccggcgcatggccatcctcggggacacggcgtgggacttcggcagcatcggcggggtgttcacctccgtgggcaagctggtccaccaggtgttcgggaccgcctacggcgtgctgttcagcggggtctcctggaccatgaagatcggcatcggcatcctcctgacgtggctggggctcaacagccgctccaccagcctgtccatgacctgcatcgccgtgggcatggtgaccctgtacctcggggtcatggtgcaggccgacagcggctgcgtgatcaactggaaggggcgggagctgaagtgcggctccggcatcttcgtcacgaacgaggtgcacacctggaccgagcagtacaagttccaggccgacagcccgaagcgcctgagcgcggccatcgggaaggcctgggaggagggcgtgtgcgggatccggtccgccacccgcctcgagaacatcatgtggaagcagatcagcaacgagctgaaccacatcctgctcgagaacgacatgaagttcaccgtcgtggtgggcgacgccaacgggatcctgacgcagggcaagaagatgatccggccccagcccatggagcacaagtactcctggaagtcctggggcaaggcgaagatcatcggggccgacacccagaacaccaccttcatcatcgacggccccgacacgccggagtgccccgacgaccagcgcgcctggaacatctgggaggtcgaggactacgggttcggcgtgttcaccaccaacatctggctgaagctccgggactcctacacccagatgtgcgaccaccgcctgatgagcgccgcgatcaaggactccaaggccgtgcacgccgacatgggctactggatcgagagcgagaagaacgagacgtggaagctggcccgggcctccttcatcgaggtcaagacctgcatctggccccgcagccacaccctctggtccaacggggtgctggagagcgagatgatcatccccaagatctacggcgggccgatctcccagcacaactaccggcccggctacttcacccagacggcggggccctggcacctgggcaagctcgagctggacttcaacctgtgcgagggcaccaccgtggtcgtggacgagcactgcgggaaccgcggcccgagcctccggaccacgaccgtgaccgggaagatcatccacgagtggtgctgccgctcctgcaccctgccgcccctgcggttccgcggcgaggacgggtgctggtacggcatggagatccggcccgtcaaggagaaggaggagaacctcgtgcgcagcatggtgtccgccggcagcggggaggtcgacagcttctccctgggcctgctctgcgtgagcatcatgatcgaggaggtgatgcggtcccgctggagccgcaagatgctgatgacggggaccctggccgtcttcttcctcctgatcatgggccagctgacctggaacgacctcatccggctgtgcatcatggtgggggccaacgtgtccgaccgcatgggcatgggcaccacgtacctggccctcatggcgaccttcaagatgcggccgatgttcgccgtcgggctgctgttccgccggctcaccagccgcgaggtgctgctgctcaccatcggcctgtccctggtcgccagcgtggagctccccaactccctggaggagctgggggacggcctcgccatgggcatcatgatgctgaagctgctcacggacttccagagccaccagctgtggaccaccctgctctccctgaccttcatcaagacgaccctgagcctcgactacgcctggaagaccatggcgatggtgctgtccatcgtcagcctgttccccctctgcctgtccaccacgagccagaagaccacctggctgcccgtgctcctggggtccttcggctgcaagccgctgaccatgttcctcatcaccgagaacaagatctgggggcgcaagagctggcccctgaacgagggcatcatggccgtggggatcgtctccatcctgctcagcagcctgctgaagaacgacgtgcccctcgccggccccctgatcgccggcgggatgctgatcgcgtgctacgtgatctccggcagctccgccgacctcagcctggagcgcgccgccgaggtctcctgggaggaggaggccgagcacagcggggcgtcccacaacatcctggtggaggtgcaggacgacggcacgatgaagatcaaggacgaggagcgggacgacaccctcaccatcctgctgaaggccaccctcctggccgtcagcggggtgtacccgatgtccatccccgccacgctgttcgtgtggtacttctggcagaagaagaagcagcgcagcggcgtcctctgggacacccccagcccgcccgaggtggagcgggccgtgctggacgacggcatctaccgcatcctgcagcgggggctgctcggccgcagccaggtcggggtgggcgtgttccaggacggggtcttccacaccatgtggcacgtgacccggggcgcggtgctgatgtaccagggcaagcgcctggagccctcctgggccagcgtcaagaaggacctcatctcctacgggggcgggtggcggttccagggcagctggaacacgggggaggaggtccaggtgatcgccgtcgagcccggcaagaaccccaagaacgtgcagaccacccccggcaccttcaagacgcccgagggggaggtgggcgccatcgccctggacttcaagcccgggacctccggcagccccatcgtcaaccgcgagggcaagatcgtggggctgtacggcaacggggtggtcaccacctccggcacgtacgtgagcgcgatcgcccaggccaaggccagccaggaggggccgctccccgagatcgaggacgaggtgttcaagaagcggaacctgaccatcatggacctgcaccccggctccggcaagacccgccggtacctcccggccatcgtccgcgaggcgatcaagcgcaagctgcggaccctgatcctcgcccccacgcgcgtggtggccagcgagatggccgaggcgctgaaggggatgcccatccggtaccagaccaccgccgtcaagtccgagcacaccggcaaggagatcgtggacctgatgtgccacgccacgttcaccatgcgcctcctgagccccgtgcgggtcccgaactacaacatgatcatcatggacgaggcccacttcaccgaccccgcctccatcgcggcccgcgggtacatcagcacccgggtgggcatgggggaggccgccgccatcttcatgacggcgacgccgcccggctccgtggaggccttcccgcagagcaacgccgtcatccaggacgaggagcgcgacatccccgagcggtcctggaacagcggctacgactggatcaccgacttccccgggaagaccgtgtggttcgtgccctccatcaagagcggcaacgacatcgccaactgcctgcgcaagaacgggaagcgggtcatccagctctcccgcaagacgttcgacaccgagtaccagaagaccaagaacaacgactgggactacgtggtgaccacggacatcagcgagatgggcgccaacttccgggcggaccgcgtcatcgacccgcggcgctgcctgaagcccgtgatcctgaaggacgggcccgagcgggtcatcctcgccggccccatgccggtgaccgccgcctccgcggcccagcgccggggccgcatcgggcgcaaccagaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgggagaagtccgcggccatcgacggggagtaccgcctgggcggcgaggcccggaagacgttcgtggagctcatgaagcgcggggacctgcccgtctggctgtcctacaaggtggccagcgagggcttccagtactccgaccggcgctggtgcttcgacggggagcggaacaaccaggtgctcgaggagaacatggacgtcgagatctggaccaaggagggcgagcgcaagaagctgcggccccgctggctggacgcccggacctacagcgaccccctcgcgctgcgcgagttcaaggagttcgccgccggccggcgcagcgtgtccggggacctgatcctcgagatcggcaagctgccgcagcacctgaccctccgggcccagaacgccctggacaacctggtgatgctccacaacagcgagcagggcgggaaggcgtaccgccacgccatggaggagctgcccgacaccatcgagacgctgatgctcctggccctgatcgccgtcctcaccgggggcgtgaccctgttcttcctgtccggcaaggggctcggcaagaccagcatcgggctgctgtgcgtgatggcgtccagcgtcctcctgtggatggcctccgtggagccccactggatcgccgccagcatcatcctggagttcttcctcatggtgctgctgatccccgagccggaccggcagcgcacgccccaggacaaccagctcgcctacgtcgtgatcggcctgctgttcatgatcctcaccgtggcggccaacgagatggggctgctggagaccaccaagaaggacctcggcatcggccacgtcgtggccgagaaccaccaccacgccacgatgctggacatcgacctgcaccccgcctccgcgtggaccctctacgccgtggccaccaccatcatcacgccgatgatgcggcacaccatcgagaacaccaccgccaacatcagcctgacggccatcgcgaaccaggccgccatcctgatggggctcgacaagggctggcccatctccaagatggacatcggggtccccctgctggccctcggctgctacagccaggtgaaccccctgaccctgaccgccgcggtgctcatgctggtcgcccactacgccatcatcgggccgggcctgcaggccaaggcgacccgcgaggcccagaagcggacggccgccggcatcatgaagaaccccaccgtggacgggatcgtggccatcgacctcgaccccgtcgtgtacgacgcgaagttcgagaagcagctgggccagatcatgctgctcatcctgtgcacctcccagatcctgctcatgcgcaccacgtgggccctgtgcgagagcatcaccctggccaccgggcccctcaccacgctgtgggagggctccccgggcaagttctggaacaccaccatcgccgtgagcatggccaacatcttccgcgggtcctacctggcgggcgccgggctcgccttcagcctgatgaagtccctgggcgggggccggcgcggcaccggggcccagggcgagacgctcggggagaagtggaagcggcagctgaaccagctgagcaagagcgagttcaacacctacaagcgctccggcatcatggaggtcgaccggagcgaggccaaggaggggctcaagcgcggcgagaccaccaagcacgcggtgtcccggggcacggccaagctgcgctggttcgtggagcggaacctggtcaagcccgaggggaaggtgatcgacctgggctgcgggcgcggcgggtggagctactactgcgccggcctcaagaaggtgaccgaggtcaagggctacaccaagggcggccccgggcacgaggagcccatcccgatggccacctacggctggaacatcgtgaagctgcactccgggcgggacgtgttcttcacgccgcccgagaagtgcgacacgctgctctgcgacatcggcgagagctcccccaacccgaccatcgaggagggccgcaccctgcgggtcctgaagatggtggagccctggctccgcgggaaccagttctgcatcaagatcctgaacccctacatgcccagcgtggtcgagaccctggagcagatgcagcggaagcacggcgggatgctcgtgcgcaacccgctgtcccggaacagcacgcacgagatgtactgggtgtcctgcggcaccggcaacatcgtcagcgcggtgaacatgacctcccgcatgctgctcaaccggttcaccatggcccaccgcaagcccacgtacgagcgcgacgtggacctgggggccggcacccggcacgtcgccgtggagcccgagatcgccaacctggacatcatcgggcagcgcatcgagaacatcaagaacgagcacaagagcacctggcactacgacgaggacaacccctacaagacctgggcgtaccacggctcctacgaggtgaagccgagcgggtccgccagctccatggtcaacggcgtggtccggctcctgacgaagccctgggacgtgatccccatggtgacccagatcgccatgaccgacaccacgcccttcggccagcagcgcgtcttcaaggagaaggtggacacccggaccccgcgccccaagcgggggaccgcccagatcatggaggtgacggccaagtggctgtggggcttcctcagccgcaacaagaagccccggatctgcacccgcgaggagttcacccggaaggtccgcagcaacgcggccatcggggccgtgttcgtggacgagaaccagtggaactccgccaaggaggccgtcgaggacgagcggttctgggacctggtgcaccgcgagcgggagctgcacaagcagggcaagtgcgcgacctgcgtgtacaacatgatggggaagcgcgagaagaagctcggcgagttcggcaaggccaaggggagccgggccatctggtacatgtggctgggcgcccgcttcctggagttcgaggcgctcgggttcatgaacgaggaccactggttctcccgggagaacagcctgtccggcgtcgagggggagggcctgcacaagctcggctacatcctgcgcgacatcagcaagatccccgggggcaacatgtacgccgacgacacggccgggtgggacacccggatcaccgaggacgacctgcagaacgaggccaagatcaccgacatcatggagcccgagcacgccctcctggcgacgtccatcttcaagctgacctaccagaacaaggtggtgcgcgtccagcgccccgccaagagcggcaccgtgatggacgtgatctcccggcgcgaccagcggggcagcgggcaggtcggcacctacgggctcaacacgttcaccaacatggaggtgcagctgatccgccagatggagtccgagggcatcttcagcccctccgagctggagaacagcaacctcgccgagcgggtgctggactggctggagaagcacggggtcgagcgcctcaagcggatggccatctccggcgacgactgcgtggtgaagccgaccgacgaccgcttcgccaccgcgctgacggccctgaacgacatgggcaaggtccggaaggacatcccccagtgggagcccagcaaggggtggaacgactggcagctcgtgcccttctgctcccaccacttccaccagctgatcatgaaggacggccgcgagatcgtggtcccgtgccggaaccaggacgagctggtggggcgcgcccgggtgagccagggcgccgggtggagcctccgcgagaccgcctgcctgggcaagtcctacgcgcagatgtggcagctgatgtacttccaccggcgcgacctccggctggccgccaacgccatctgcagcgccgtccccgtgaactgggtgcccacctcccgcaccacctggagcatccacgcgcaccaccagtggatgacgaccgaggacatgctgtccgtctggaaccgggtgtggatcgaggagaacccctggatggaggacaagacccacgtgagctcctgggaggacgtcccgtacctcggcaagcgcgaggaccagtggtgcgggagcctgatcggcctgaccgcccgcgccacgtgggccaccaacatccaggtggcgatcaaccaggtgcggcgcctcatcgggaacgagaactacctggactacatgacctccatgaagcggttcaagaacgagagcgaccccgagggcgccctgtggtga

SEQ ID NO: 8963 - RNA, 9879 nt, synthetic construct
  misc_feature 1..9879: note = derived and/or modified CDS sequence (opt1) from DENV-1__KR024707__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctgacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtcgaggactacggcttcggggtgttcaccaccaacatctggctgaagctccgggactcctacacccagatgtgcgaccaccgcctgatgagcgccgcgatcaaggactccaaggccgtgcacgccgacatgggctactggatcgagagcgagaagaacgagacgtggaagctggcccgggcctccttcatcgaggtcaagacctgcatctggccccgcagccacaccctctggtccaacggcgtgctggagagcgagatgatcatccccaagatctacgggggcccgatctcccagcacaactaccggcccgggtacttcacccagacggcgggcccctggcacctggggaagctcgagctggacttcaacctgtgcgagggcaccaccgtggtcgtggacgagcactgcggcaaccgcgggccgagcctccggaccacgaccgtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggctgctctgcgtgagcatcatgatcgaggaggtgatgcggtcccgctggagccgcaagatgctgatgacgggcaccctggccgtcttcttcctcctgatcatggggcagctgacctggaacgacctcatccggctgtgcatcatggtgggcgccaacgtgtccgaccgcatggggatgggcaccacgtacctggccctcatggcgaccttcaagatgcggccgatgttcgccgtcgggctgctgttccgccggctcaccagccgcgaggtgctgctgctcaccatcgggctgtccctggtcgccagcgtggagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcctggaagaccatggcgatggtgctgtccatcgtcagcctgttccccctctgcctgtccaccacgagccagaagaccacctggctgcccgtgctcctgggctccttcgggtgcaagccgctgaccatgttcctcatcaccgagaacaagatctggggccgcaagagctggcccctgaacgaggggatcatggccgtgggcatcgtctccatcctgctcagcagcctgctgaagaacgacgtgcccctcgccgggcccctgatcgccggcggcatgctgatcgcgtgctacgtgatctccgggagctccgccgacctcagcctggagcgcgccgccgaggtctcctgggaggaggaggccgagcacagcggcgcgtcccacaacatcctggtggaggtgcaggacgacgggacgatgaagatcaaggacgaggagcgggacgacaccctcaccatcctgctgaaggccaccctcctggccgtcagcggcgtgtacccgatgtccatccccgccacgctgttcgtgtggtacttctggcagaagaagaagcagcgcagcggggtcctctgggacacccccagcccgcccgaggtggagcgggccgtgctggacgacggcatctaccgcatcctgcagcggggcctgctcgggcgcagccaggtcggcgtgggggtgttccaggacggcgtcttccacaccatgtggcacgtgacccgcggggcggtgctgatgtaccagggcaagcgcctggagccctcctgggccagcgtcaagaaggacctcatctcctacggcgggggctggcggttccaggggagctggaacacgggcgaggaggtccaggtgatcgccgtcgagcccgggaagaaccccaagaacgtgcagaccacccccggcaccttcaagacgcccgagggcgaggtgggggccatcgccctggacttcaagcccggcacctccgggagccccatcgtcaaccgcgagggcaagatcgtgggcctgtacgggaacggcgtggtcaccacctccgggacgtacgtgagcgcgatcgcccaggccaaggccagccaggagggcccgctccccgagatcgaggacgaggtgttcaagaagcggaacctgaccatcatggacctgcaccccgggtccggcaagacccgccggtacctcccggccatcgtccgcgaggcgatcaagcgcaagctgcggaccctgatcctcgcccccacgcgcgtggtggccagcgagatggccgaggcgctgaagggcatgcccatccggtaccagaccaccgccgtcaagtccgagcacaccgggaaggagatcgtggacctgatgtgccacgccacgttcaccatgcgcctcctgagccccgtgcgggtcccgaactacaacatgatcatcatggacgaggcccacttcaccgaccccgcctccatcgcggcccgcggctacatcagcacccgggtggggatgggcgaggccgccgccatcttcatgacggcgacgccgcccgggtccgtggaggccttcccgcagagcaacgccgtcatccaggacgaggagcgcgacatccccgagcggtcctggaacagcggctacgactggatcaccgacttccccggcaagaccgtgtggttcgtgccctccatcaagagcgggaacgacatcgccaactgcctgcgcaagaacggcaagcgggtcatccagctctcccgcaagacgttcgacaccgagtaccagaagaccaagaacaacgactgggactacgtggtgaccacggacatcagcgagatgggggccaacttccgggcggaccgcgtcatcgacccgcggcgctgcctgaagcccgtgatcctgaaggacggccccgagcgggtcatcctcgccgggcccatgccggtgaccgccgcctccgcggcccagcgccggggccgcatcggccgcaaccagaacaaggagggggaccagtacgtgtacatgggccagcccctgaacaacgacgaggaccacgcccactggaccgaggccaagatgctgctcgacaacatcaacacccccgaggggatcatccccgccctgttcgagccggagcgggagaagtccgcggccatcgacggcgagtaccgcctgcgcggggaggcccgcaagacgttcgtcgagctcatgcggcgcggcgacctgcccgtgtggctgtcctacaaggtggccagcgagggcttccagtactccgaccggcgctggtgcttcgacggggagcggaacaaccaggtcctcgaggagaacatggacgtggagatctggaccaaggagggcgagcgcaagaagctgcggccccgctggctggacgcccggacctacagcgaccccctcgcgctgcgcgagttcaaggagttcgccgccgggcggcgcagcgtgtccggcgacctgatcctcgagatcggcaagctgccgcagcacctgaccctccgggcccagaacgccctggacaacctggtcatgctccacaacagcgagcagggcgggaaggcgtaccgccacgccatggaggagctgcccgacaccatcgagacgctgatgctcctgaccctgatcgccgtgctcaccgggggcgtgaccctgttcttcctgtccgggaagggcctcggcaagacgagcatcgggctgctgtgcgtcatggcctccagcgtgctcctgtggatggcgtccgtggagccccactggatcgccgccagcatcatcctggagttcttcctcatggtcctgctgatccccgagccggaccggcagcgcacgccccaggacaaccagctcgcctacgtggtgatcggcctgctgttcatgatcctcaccgtcgccgcgaacgagatggggctgctggagaccacgaagaaggacctcggcatcgggcacgtggtggccgagaaccaccaccacgccaccatgctggacatcgacctgcaccccgcctccgcctggaccctctacgcggtcgccaccacgatcatcaccccgatgatgcggcacaccatcgagaacaccacggccaacatcagcctgaccgccatcgccaaccaggcggccatcctgatgggcctcgacaagggctggcccatctccaagatggacatcggggtgcccctgctggccctcggctgctacagccaggtgaaccccctgaccctgaccgccgccgtcctcatgctggtggcgcactacgccatcatcgggccgggcctgcaggccaaggccacgcgcgaggcgcagaagcgcaccgccgccgggatcatgaagaaccccaccgtggacggcatcgtcgccatcgacctcgaccccgtggtgtacgacgccaagttcgagaagcagctgggccagatcatgctgctcatcctgtgcacctcccagatcctgctcatgcggacgacctgggcgctgtgcgagagcatcaccctggccaccgggcccctcacgaccctgtgggagggctccccggggaagttctggaacaccaccatcgccgtcagcatggccaacatcttccgcggctcctacctggccggcgcggggctcgccttcagcctgatgaagtccctgggcgggggccggcgcgggacgggcgcccagggcgagaccctcggggagaagtggaagcggcagctgaaccagctgagcaagagcgagttcaacacctacaagcgctccggcatcatggaggtggaccggagcgaggccaaggaggggctcaagcgcggcgagaccacgaagcacgccgtgtcccgggggaccgcgaagctgcgctggttcgtcgagcggaacctggtgaagcccgagggcaaggtgatcgacctgggctgcgggcgcggcgggtggagctactactgcgccggcctcaagaaggtcaccgaggtgaaggggtacaccaagggcggccccgggcacgaggagcccatcccgatggccacctacggctggaacatcgtgaagctgcactccgggcgggacgtcttcttcacgccgcccgagaagtgcgacaccctgctctgcgacatcggcgagagctcccccaacccgaccatcgaggaggggcgcaccctgcgggtgctgaagatggtggagccctggctccgcggcaaccagttctgcatcaagatcctgaacccctacatgcccagcgtcgtggagacgctggagcagatgcagcggaagcacggcgggatgctcgtgcgcaacccgctgtcccggaacagcacccacgagatgtactgggtctcctgcggcaccgggaacatcgtgagcgccgtgaacatgacctcccgcatgctgctcaaccgcttcacgatggcgcaccggaagcccacctacgagcgcgacgtcgacctgggcgccggcacccggcacgtggccgtggagcccgagatcgccaacctggacatcatcgggcagcgcatcgagaacatcaagaacgagcacaagagcacctggcactacgacgaggacaacccctacaagacgtgggcctaccacggctcctacgaggtcaagccgagcgggtccgcgagctccatggtgaacggcgtcgtgcggctcctgaccaagccctgggacgtgatccccatggtcacccagatcgccatgaccgacacgacccccttcgggcagcagcgcgtgttcaaggagaaggtggacacccggaccccgcgccccaagcggggcacggcccagatcatggaggtcaccgccaagtggctgtggggcttcctcagccgcaacaagaagccccggatctgcacccgcgaggagttcacccggaaggtgcgcagcaacgccgcgatcggggccgtgttcgtcgacgagaaccagtggaactccgccaaggaggccgtggaggacgagcggttctgggacctggtgcaccgcgagcgggagctgcacaagcagggcaagtgcgccacgtgcgtctacaacatgatggggaagcgcgagaagaagctcggcgagttcgggaaggcgaagggcagccgggccatctggtacatgtggctgggcgcccgcttcctggagttcgaggccctcgggttcatgaacgaggaccactggttctcccgggagaacagcctgtccggcgtggagggggagggcctgcacaagctcgggtacatcctgcgcgacatcagcaagatcccgggcggcaacatgtacgcggacgacaccgccgggtgggacacccgcatcaccgaggacgacctgcagaacgaggccaagatcacggacatcatggagcccgagcacgccctcctggccacctccatcttcaagctgacctaccagaacaaggtggtccgggtgcagcgccccgccaagagcggcaccgtgatggacgtcatctcccggcgcgaccagcgggggagcggccaggtgggcacgtacgggctcaacaccttcaccaacatggaggtgcagctgatccgccagatggagtccgagggcatcttcagcccctccgagctggagaacagcaacctcgcggagcgggtcctggactggctggagaagcacggggtggagcgcctcaagcggatggccatctccggcgacgactgcgtggtcaagccgaccgacgaccgcttcgccacggccctgaccgcgctgaacgacatggggaaggtgcggaaggacatcccccagtgggagcccagcaagggctggaacgactggcagcaggtccccttctgctcccaccacttccaccagctcatcatgaaggacggccgcgagatcgtcgtgccgtgccggaaccaggacgagctggtggggcgcgcccgggtcagccagggcgccgggtggagcctgcgcgagaccgcctgcctcggcaagtcctacgcccagatgtggcagctgatgtacttccaccggcgcgacctgcggctcgcggccaacgccatctgcagcgccgtgcccgtgaactgggtccccacctcccgcaccacgtggagcatccacgcccaccaccagtggatgaccaccgaggacatgctgtccgtgtggaaccgcgtgtggatcgaggagaacccctggatggaggacaagacccacgtcagctcctgggaggacgtgccgtacctggggaagcgggaggaccagtggtgcggcagcctcatcggcctgacggcgcgcgccacctgggccaccaacatccaggtggccatcaaccaggtccggcgcctgatcgggaacgagaactacctcgactacatgacctccatgaagcggttcaagaacgagagcgaccccgagggcgcgctgtggtga

SEQ ID NO: 8964 - RNA, 9879 nt, synthetic construct
  misc_feature 1..9879: note = derived and/or modified CDS sequence (opt1) from DENV-1__KC172829__SS-prME
  source 1..9879: mol_type = other RNA
agcgtgaccatgctgctcatgctgatgcccaccgccctggccttccacctcaccacccgcggcggggagccgcacatgatcgtgagcaagcaggagcggggcaagagcctgctgttcaagacctccgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggacgttcaagctcgagaaggaggtggcggagacccagcacggcaccgtgctggtccagatcaagtacgagggcaccgacgccccctgcaagatccccttctccacgcaggacgagaagggggtgacccagaacggccggctgatcaccgccaacccgatcgtgaccgacaaggagaagcccgtcaacatcgaggccgagccgcccttcggggagagctacatcgtgatcggcgcgggcgagaaggccctgaagctctcctggttcaagaaggggagctccatcggcaagatgttcgaggccacggcccgcggggcccggcgcatggcgatcctgggcgacaccgcctgggacttcgggagcatcggcggcgtgttcacctccgtcgggaagctggtgcaccagatcttcggcaccgcctacggggtgctgttcagcggcgtctcctggacgatgaagatcgggatcggcgtgctgctgacctggctcggcctgaacagccgctccaccagcctgtccatgacctgcatcgccgtggggctcgtcacgctgtacctgggcgtgatggtgcaggccgacagcgggtgcgtcgtgaactggaagggccgggagctcaagtgcgggtccggcatcttcgtgaccaacgaggtccacacctggaccgagcagtacaagttccaggcggacagcccgaagcgcctgagcgccgccatcggcaaggcctgggaggagggggtgtgcggcatccggtccgccacccgcctggagaacatcatgtggaagcagatcagcaacgagctcaaccacatcctgctggagaacgacatgaagttcacggtggtcgtgggggacgtggcgggcatcctcgcccaggggaagaagatgatccggccccagcccatggagtacaagtactcctggaagtcctggggcaaggccaagatcatcggcgccgacgtccagaacaccaccttcatcatcgacgggcccaacaccccggagtgccccgacgaccagcgcgcgtggaacatctgggaggtggaggactacggcttcgggatcttcacgaccaacatctggctgcggctgcgcgactcctacacccaggtgtgcgaccaccggctcatgagcgccgccatcaaggactccaaggccgtccacgccgacatgggctactggatcgagagcgagaagaacgagacctggaagctggcgcgcgcctccttcatcgaggtgaagacgtgcatctggcccaagagccacaccctgtggtccaacggcgtgctcgagagcgagatgatcatccccaagatctacgggggcccgatctcccagcacaactaccggcccgggtacttcacccagaccgccggcccctggcacctggggaagctggagctcgacttcgacctgtgcgagggcacgaccgtcgtggtggacgagcactgcggcaaccgcgggccgagcctgcggaccaccacggtcaccggcaagatcatccacgagtggtgctgccgctcctgcaccctgccgcccctccggttccgcggggaggacggctgctggtacgggatggagatccggcccgtgaaggagaaggaggagaacctggtcaagagcatggtctccgccggcagcggcgaggtggacagcttctccctcgggctgctgtgcatcagcatcatgatcgaggaggtgatgcgctcccggtggagccgcaagatgctcatgaccggcacgctggccgtcttcttcctgctcatcatcgggcagctgacctggaacgacctgatccgcctctccatcatggtgggcgcgaacgccagcgacaagatggggatgggcaccacctacctggccctgatggccacgttcaagatgcggccgatgttcgccgtgggcctcctgttccgccggctgacctcccgcgaggtcctcctgctgaccatcgggctcagcctggtggcgtccgtcgagctgcccaacagcctcgaggagctgggcgacgggctggccatgggcatcatgatcctcaagctgctgaccgacttccagtcccaccagctctgggccacgctgctgagcctcaccttcatcaagaccaccttctccctgcactacgcctggaagacgatggcgatggtgctgagcatcgtgtccctcttccccctgtgcctgagcaccacctcccagaagaccacgtggctccccgtcctgctgggcagcctcgggtgcaagccgctgaccatgttcctgatcaccgagaacaagatctggggccggaagtcctggcccctcaacgaggggatcatggccgtgggcatcgtgagcatcctgctgagctccctcctgaagaacgacgtccccctggccgggcccctcatcgccggcggcatgctgatcgcctgctacgtgatcagcgggtccagcgcggacctgtccctcgagaaggccgccgaggtgagctgggaggaggaggccgagcactccggcgccagccacaacatcctggtcgaggtgcaggacgacgggaccatgaagatcaaggacgaggagcgcgacgacaccctgacgatcctcctgaaggcgaccctgctcgccgtgtccggcgtctacccgctgagcatccccgccaccctgttcgtgtggtacttctggcagaagaagaagcagcggtccggggtgctctgggacacccccagcccgcccgaggtcgagcgcgccgtgctggacgacggcatctaccggatcatgcagcgcggcctgctggggcggtcccaggtgggcgtcggggtgttccaggagaacgtgttccacacgatgtggcacgtcacccgcggcgccgtgctcatgtaccaggggaagcggctggagcccagctgggcgtccgtgaagaaggacctgatcagctacggcggcgggtggcgcctccagggctcctggaacaccggggaggaggtccaggtgatcgccgtggagcccggcaagaaccccaagaacgtccagaccgcccccgggacgttcaagaccaccgagggcgaggtgggcgccatcgccctggacttcaagcccgggaccagcggctcccccatcgtgaaccgggaggggaagatcgtcggcctgtacggcaacggggtggtgacgaccagcggcacctacgtcagcgcgatcgcccaggccaaggcctcccaggaggggcccctcccggagatcgaggacgaggtgttccgcaagcggaacctgaccatcatggacctgcaccccggcagcgggaagacgcgccggtacctccccgcgatcgtgcgcgaggccatcaagcggaagctgcgcaccctgatcctcgccccgacccgcgtcgtggcctccgagatggccgaggcgctgaagggcatgcccatccggtaccagaccacggccgtcaagagcgagcacaccggcaaggagatcgtcgacctgatgtgccacgccaccttcaccatgcgcctcctgtcccccgtgcgggtgcccaactacaacatgatcatcatggacgaggcccacttcacggacccgagctccatcgccgcgcgcgggtacatcagcacccgggtcggcatgggggaggccgccgccatcttcatgaccgccacgccgcccggctccgtggaggcgttcccccagagcaacgccgtgatccaggacgaggagcgcgacatcccggagcggtcctggaacagcgggtacgagtggatcacggacttctccggcaagaccgtctggttcgtgcccagcatcaagtccggcaacgacatcgccaactgcctgcgcaagaacgggaagcgggtgatccagctcagccgcaagaccttcgacaccgagtaccagaagacgaagaacaacgactgggactacgtcgtgaccaccgacatctccgagatgggcgccaacttccgggcggaccgcgtgatcgacccccggcgctgcctgaagcccgtcatcctgaaggacgggccggagcgggtgatcctcgccggccccatgcccgtcaccgtggccagcgccgcccagcgccgggggcgcatcggccggaaccacaacaaggagggcgaccagtacatctacatggggcagcccctgaacaacgacgaggaccacgcgcactggacggaggccaagatgctgctcgacaacatcaacaccccggagggcatcatccccgccctgttcgagcccgagcgcgagaagtccgccgccatcgacggggagtaccgcctgcggggcgaggcgcgcaagaccttcgtggagctcatgcggcgcggggacctgcccgtctggctgagctacaaggtggccagcgagggcttccagtactccgaccggcgctggtgcttcgacggcgagcggaacaaccaggtgctcgaggagaacatggacgtcgagatctggaccaaggagggggagcgcaagaagctgcggccgcgctggctggacgcccggacgtacagcgaccccctcgccctgcgcgagttcaaggagttcgccgcgggccggcgctccgtgagcggggacctgatcctcgagatcggcaagctgccccagcacctgacccagcgggcccagaacgccctcgacaacctggtgatgctgcacaactccgagcagggcgggcgcgcctaccggcacgcgatggaggagctccccgacaccatcgagaccctgatgctgctcgccctgatcgccgtcctgaccggcggggtgaccctcttcttcctgagcggccgcgggctgggcaagacctccatcggcctcctgtgcgtgatggccagctccgtcctgctctggatggccagcgtggagccgcactggatcgcggcctccatcatcctggagttcttcctgatggtgctcctgatccccgagcccgaccggcagcgcacgccccaggacaaccagctggcctacgtcgtgatcgggctcctgttcatgatcctgaccgtggccgccaacgagatgggcctcctggagacgaccaagaaggacctggggatcggccacgtcgcggacgagaaccaccaccacgccgccatgctcgacgtggacctgcacccggccagcgcctggaccctgtacgcggtggccaccacgatcatcacccccatgatgcggcacaccatcgagaacaccacggccaacatctccctcaccgccatcgccaaccaggcggccatcctgatggggctggacaagggctggcccatcagcaagatggacatcggcgtcccgctcctggccctggggtgctactcccaggtgaaccccctcaccctgaccgccgcggtgctgatgctcgtcgcccactacgccatcatcggccccgggctgcaggccaaggccacgcgcgaggcgcagaagcgcaccgccgccggcatcatgaagaaccccaccgtggacgggatcgtggccatcgacctggacccggtcgtgtacgacgccaagttcgagaagcagctcggccagatcatgctgctgatcctctgcaccagccagatcctgctgatgcggacgacctgggcgctctgcgagtccatcaccctggccaccggccccctgacgaccctctgggaggggagccccggcaagttctggaacaccaccatcgccgtgtccatggccaacatcttccgcgggagctacctggccggcgcgggcctggccttcagcctcatgaagtccctcgggggcgggcggcgcgggacgggggcccagggcgagaccctgggcgagaagtggaagcggcagctcaaccagctgagcaagtccgagttcaacacctacaagcgcagcgggatcatggaggtcgaccggtccgaggccaaggagggcctgaagcgcggggagaccacgaagcacgcggtgagccggggcaccgccaagctccgctggttcgtggagcggaacctggtcaagcccgaggggaaggtgatcgacctgggctgcggccgcgggggctggtcctactactgcgccgggctgaagaaggtgaccgaggtcaagggctacaccaagggcgggccgggccacgaggagcccatccccatggccacgtacgggtggaacctcgtgaagctgcacagcggcaaggacgtgttcttcatcccgcccgagaagtgcgacaccctgctctgcgacatcggggagtccagccccaaccccaccatcgaggagggccggaccctgcgcgtcctgaagatggtggagccctggctccgggggaaccagttctgcatcaagatcctgaacccctacatgccctccgtggtcgagaccctggagcagatgcagcgcaagcacggcggcatgctcgtgcggaaccccctgagccgcaactccacgcacgagatgtactgggtgagctgcgggaccggcaacatcgtctccgccgtgaacatgaccagccggatgctgctcaaccgcttcaccatggtgcaccgcaagcccacgtacgagcgggacgtcgacctgggggcgggcacccgccacgtggccgtggagccggaggtcgccaacctggacatcatcggccagcggatcgagaacatcaagcacgagcacaagtccacctggcactacgacgaggacaacccctacaagacctgggcctaccacgggagctacgaggtgaagccctccggcagcgccagctccatggtcaacggggtggtgaagctcctgacgaagccctgggacgtcatcccgatggtgacccagatcgcgatgaccgacaccacgcccttcggccagcagcgcgtgttcaaggagaaggtcgacacccggacccccaaggccaagcgcgggaccgcccagatcatggaggtgacggcccggtggctgtggggcttcctcagccgcaacaagaagccccggatctgcacccgcgaggagttcacccggaaggtgcgctccaacgccgcgatcggcgccgtcttcgtggacgagaaccagtggaacagcgccaaggaggccgtggaggacgagcggttctgggacctggtccaccgcgagcgggagctgcacaagcaggggaagtgcgcgacctgcgtgtacaacatgatgggcaagcgcgagaagaagctcggggagttcggcaaggccaaggggtcccgggccatctggtacatgtggctgggcgcccgcttcctggagttcgaggccctcggcttcatgaacgaggaccactggttcagccgggagaactccctgagcggggtggagggcgaggggctgcacaagctcggctacatcctgcgcgacatctccaagatccccgggggcaacatgtacgcggacgacacggccggctgggacacccggatcaccgaggacgacctgcagaacgaggccaagatcaccgacatcatggagagcgagcacgccctcctggccaagtccatcttcaagctgacgtaccagaacaaggtcgtgcgcgtgcagcgccccgcgaagaacgggaccgtcatggacgtgatcagccggcgcgaccagcggggctccggccaggtgggcacctacggcctcaacaccttcacgaacatggaggcccagctgatccgccagatggagagcgaggggatcttctcccccagcgagctggagaccccgaacctcgccgagcgggccctggactggctggagaagcacggcgtcgagcgcctcaagcggatggccatctccggggacgactgcgtggtgaagcccatcgacgaccgcttcgcgaccgccctgaccgccctgaacgacatgggcaaggtccggaaggacatcccccagtgggagcccagcaaggggtggaacgactggcagcaggtcccgttctgcagccaccacttccaccagctcatcatgaaggacggccgcgagatcgtggtcccctgccggaaccaggacgagctggtgggccgcgcccgggtgtcccagggggccggctggagcctgcgcgagacggcgtgcctcgggaagtcctacgcccagatgtggcagctgatgtacttccaccggcgcgacctgcggctcgccgccaacgcgatctgcagcgccgtccccgtggactgggtgcccacctcccgcaccacctggagcatccacgcccaccaccagtggatgacgaccgaggacatgctgtccgtctggaaccgggtgtggatcgaggagaacccgtggatggaggacaagacccacatcagctcctgggaggacgtgccctacctgggcaagcgcgaggaccagtggtgcgggagcctcatcggcctgaccgcccgcgccacctgggcgacgaacatccaggtcgccatctcccaggtgcggcgcctgatcggcaacgagaactacctcgactacatgaccagcatgaagcggttcaagaacgagtccgaccccgagggggccctgtggtga

SEQ ID NO: 8965 - RNA, 9879 nt, synthetic construct
  misc_feature 1..9879: note = derived and/or modified CDS sequence (opt1) from DENV-1__EU359008__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacacgctcacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcagccgcgacttcgtggaggggctgtccggcgccacgtgggtggacgtcgtgctggagcacgggagctgcgtgaccaccatggccaaggacaagcccaccctcgacatcgagctgctgaagacggaggtcaccaaccccgcggtgctccggaagctgtgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctgatcacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcaccacgcaggagacctggaaccggcaggacctgctcgtgaccttcaagaccgcccacgcgaagaagcaggaggtcgtggtgctgggctcccaggagggcgccatgcacacggccctgaccggggccaccgagatccagaccagcggcacgaccaccatcttcgccgggcacctcaagtgccgcctgaagatggacaagctgaccctcaagggcatgtcctacgtcatgtgcacggggagcttcaagctggagaaggaggtggcggagacccagcacggcaccgtgctggtccagatcaagtacgagggcaccgacgccccctgcaagatccccttcctgacgcaggacgagaagggggtgacccagaacggccggctcatcaccgccaacccgatcgtgaccgacaaggagaagcccgtcaacatcgaggccgagccgcccttcggggagtcctacatcgtgatcggcgcgggcgagaaggccctgaagctgagctggttcaagaaggggtccagcatcggcaagatgttcgaggccacggcccgcggggcccggcgcatggcgatcctcggcgacaccgcctgggacttcgggtccatcggcggcgtgttcaccagcgtcgggaagctggtgcaccagatcttcggcaccgcctacggggtgctgttctccggcgtcagctggacgatgaagatcgggatcggcgccctcctgacctggctgggcctcaactcccgcagcacctccctgagcatgacctgcatcgccgtggggctggtgacgctctacctgggcgtcatggtgcaggcggactccgggtgcgtgatcaactggaagggccgggagctgaagtgcgggagcggcatcttcgtcaccaacgaggtgcacacctggaccgagcagtacaagttccaggccgactccccgaagcgcctcagcgccgccatcggcaaggcctgggaggagggggtgtgcggcatccggagcgcgacccgcctggagaacatcatgtggaagcagatctccaacgagctgaaccacatcctcctggagaacgacatgaagttcacggtcgtggtgggggacgtcgccggcatcctggcccaggggaagaagatgatccggccccagcccatggagcacaagtacagctggaagtcctggggcaaggccaagatcatcggcgcggacgtgcagaacaccaccttcatcatcgacgggcccaacaccccggagtgccccgacgaccagcgcgcctggaacatctgggaggtggaggactacggcttcgggatcttcacgaccaacatctggctcaagctgcgggacagctacacccaggtctgcgaccaccgcctgatgtccgccgccatcaaggacagcaaggccgtgcacgcggacatgggctactggatcgagtccgagaagaacgagacctggaagctcgcccgggccagcttcatcgaggtgaagacgtgcatctggcccaagtcccacaccctgtggagcaacggcgtcctggagtccgagatgatcatccccaagatctacgggggcccgatcagccagcacaactaccgccccgggtacttcacccagaccgccggcccctggcacctcgggaagctggagctggacttcgacctctgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggctccggcgaggtggacagcttcagcctggggctcctgtgcatctccatcatgatcgaggaggtcatgcggagccgctggtcccggaagatgctgatgaccggcacgctcgcggtgttcttcctgctgatcatgggccaggtgacctggaacgacctcatccgcctgtgcatcatggtcggcgccaacgccagcgaccgcatggggatgggcaccacctacctggccctcatggccacgttcaagatgcggccgatgttcgcggtgggcctgctgttccgccggctcacctcccgcgaggtgctgctgctcaccatcgggctgagcctggtcgcctccgtggagctccccaacagcctggaggagctgggcgacgggctcgccatgggcatcatgatcctgaagctgctcaccgacttccagtcccaccagctgtgggccacgctgctcagcctgaccttcatcaagaccaccttctccctgcactacgcgtggaagacgatggccatggtcctcagcatcgtgtccctgttccccctgtgcctcagcaccacctcccagaagaccacgtggctgcccgtgctgctcggcagcctggggtgcaagccgctgaccatgttcctcatcgccgagaacaagatctggggccggaagtcctggcccctgaacgaggggatcatggccgtcggcatcgtgagcatcctgctctccagcctgctgaagaacgacgtgcccctcgccgggcccctgatcgcgggcggcatgctgatcgcctgctacgtcatcagcgggtccagcgccgacctctccctggagaaggccgccgaggtgagctgggaggaggaggcggagcactccggcgccagccacaacatcctggtggaggtccaggacgacgggaccatgaagatcaaggacgaggagcgcgacgacaccctcaccatcctgctgaaggccacgctcctggccgtgtccggcgtgtacccgctgagcatccccgccaccctcttcgtctggtacttctggcagaagaagaagcagcggtccggggtgctgtgggacacccccagcccgcccgaggtggagcgcgcggtcctggacgacggcatctaccggatcatgcagcgcggcctgctcgggcggtcccaggtgggcgtgggggtcttccaggagaacgtgttccacaccatgtggcacgtgacgcgcggcgccgtcctgatgtaccaggggaagcggctggagcccagctgggcctccgtgaagaaggacctcatcagctacggcggcgggtggcgcctgcagggctcctggaacaccggggaggaggtgcaggtcatcgccgtggagcccggcaagaaccccaagaacgtgcagaccgcccccgggaccttcaagacgcccgagggcgaggtcggcgcgatcgccctggacttcaagcccgggaccagcggctcccccatcgtgaaccgggaggggaagatcgtgggcctctacggcaacggggtcgtgaccaccagcggcacgtacgtgtccgccatcgcccaggcgaaggccagccaggaggggccgctgcccgagatcgaggacgaggtcttccgcaagcggaacctgaccatcatggacctccaccccggcagcgggaagacccgccggtacctgccggccatcgtgcgcgaggccatcaagcggaagctgcgcaccctcatcctggcccccacgcgcgtggtcgcgtccgagatggccgaggccctgaagggcatgcccatccggtaccagaccaccgccgtcaagagcgagcacaccggcaaggagatcgtggacctcatgtgccacgccacgttcaccatgcgcctgctgtcccccgtccgggtgccgaactacaacatgatcatcatggacgaggcgcacttcaccgaccccagctccatcgccgcccgcgggtacatcagcacccgggtgggcatgggggaggccgccgcgatcttcatgacggccacgccgcccggctccgtcgaggccttcccgcagagcaacgccgcgatccaggacgaggagcgcgacatccccgagcggtcctggaacagcgggtacgagtggatcaccgacttccccggcaagaccgtgtggttcgtgccctccatcaagagcggcaacgacatcgccaactgcctccgcaagaacgggaagcgggtcatccagctgtcccgcaagacgttcgacaccgagtaccagaagaccaagaacaacgactgggactacgtggtgaccacggacatcagcgagatgggcgccaacttccgggccgaccgcgtcatcgacccgcggcgctgcctgaagcccgtgatcctcaaggacgggcccgagcgggtgatcctggccggccccatgccggtcaccgtggcgtccgccgcccagcgccgggggcgcatcggccggaaccacaacaaggagggcgaccagtacatctacatggggcagcccctgaacaacgacgaggaccacgcccactggaccgaggccaagatgctcctggacaacatcaacacccccgagggcatcatccccgcgctgttcgagccggagcgcgagaagtccgccgccatcgacggggagtaccgcctccggggcgaggcccgcaagacgttcgtcgagctgatgcggcgcggggacctgcccgtgtggctctcctacaaggtggccagcgagggcttccagtactccgaccggcgctggtgcttcgacggcgagcggaacaaccaggtcctggaggagaacatggacgtggagatctggaccaaggagggggagcgcaagaagctgcggccccgctggctcgacgcgcggacctacagcgaccccctggccctgcgcgagttcaaggagttcgccgccggccggcgcagcgtgtccggggacctcatcctggagatcggcaagctgccgcagcacctcacccagcgggcgcagaacgccctggacaacctggtcatgctccacaacagcgagcagggcgggcgcgcctaccggcacgccatggaggagctgcccgacacgatcgagaccctgatgctcctggccctgatcgcggtgctcaccggcggggtgaccctgttcttcctgtccggccgcgggctcggcaagaccagcatcggcctgctgtgcgtcatggcctccagcgtgctcctgtggatggcctccgtggagccccactggatcgccgccagcatcatcctggagttcttcctcatggtcctgctgatccccgagccggaccggcagcgcacgccccaggacaaccagctcgcgtacgtggtgatcgggctgctgttcatgatcctcaccgtcgccgccaacgagatgggcctgctggagaccaccaagaaggacctcgggatcggccacgtggccgtggagaaccaccaccacgccgcgatgctggacgtcgacctgcaccccgcctccgcctggacgctctacgccgtggccaccaccatcatcaccccgatgatgcggcacacgatcgagaacaccaccgcgaacatcagcctgaccgccatcgccaaccaggccgcgatcctgatggggctcgacaagggctggcccatctccaagatggacatcggcgtgcccctgctggccctcgggtgctacagccaggtcaaccccctgacgctgaccgccgccgtgctcatgctggtggcccactacgcgatcatcggcccggggctgcaggccaaggccacccgcgaggcccagaagcgcaccgccgcgggcatcatgaagaaccccacggtcgacgggatcgtggccatcgacctcgaccccgtggtctacgacgccaagttcgagaagcagctgggccagatcatgctgctcatcctgtgcacctcccagatcctgctcatgcggaccacctgggccctgtgcgagagcatcacgctggccaccggccccctcaccaccctgtgggaggggtccccgggcaagttctggaacacgaccatcgcggtgagcatggccaacatcttccgcgggtcctacctggccggcgccggcctcgcgttcagcctgatgaagtccctcgggggcgggcggcgcgggaccggggcccagggcgagaccctcggcgagaagtggaagcggcagctgaaccagctgagcaagagcgagttcaacacgtacaagcgctccgggatcatggaggtggaccggagcgaggccaaggagggcctcaagcgcggggagaccaccaagcacgccgtctcccggggcaccgccaagctgcgctggttcgtggagcggaacctggtgaagcccgaggggaaggtcatcgacctgggctgcggccgcgggggctggagctactactgcgcggggctcaagaaggtgacggaggtgaagggctacaccaagggcgggcccggccacgaggagcccatcccgatggccacctacgggtggaacctggtcaagctgcactccggcaaggacgtgttcttcatcccgcccgagaagtgcgacaccctcctgtgcgacatcggggagagctcccccaacccgacgatcgaggagggccggaccctgcgcgtgctcaagatggtcgagccctggctgcgggggaaccagttctgcatcaagatcctgaacccctacatgcccagcgtggtggagaccctcgagcagatgcagcgcaagcacggcggcatgctggtccggaacccgctgtcccgcaacagcacccacgagatgtactgggtgtcctgcgggaccggcaacatcgtgagcgccgtcaacatgacgtcccggatgctcctgaaccgcttcaccatggcccaccgcaagcccacctacgagcgggacgtggacctgggggccggcacccgccacgtggcggtcgagcccgaggtggccaacctcgacatcatcggccagcggatcgagaacatcaagcacgagcacaagagcacgtggcactacgacgaggacaacccctacaagacctgggcctaccacgggtcctacgaggtgaagccgagcggctccgccagctccatggtcaacggggtggtcaagctgctgaccaagccctgggacgtgatccccatggtgacccagatcgccatgacggacaccacccccttcggccagcagcgcgtcttcaaggagaaggtggacacccggacgccgaaggcgaagcgcgggaccgcccagatcatggaggtgaccgcccggtggctctggggcttcctgagccgcaacaagaagccccggatctgcacccgcgaggagttcacgcggaaggtccgcagcaacgccgcgatcggcgccgtgttcgtggacgagaaccagtggaactccgccaaggaggccgtcgaggacgagcggttctgggacctggtgcaccgcgagcgggagctccacaagcaggggaagtgcgcgacctgcgtgtacaacatgatgggcaagcgcgagaagaagctgggggagttcggcaaggcgaaggggagccgggccatctggtacatgtggctgggcgcccgcttcctcgagttcgaggccctgggcttcatgaacgaggaccactggttctcccgggagaacagcctgtccggggtcgagggcgaggggctccacaagctgggctacatcctgcgcgacatcagcaagatccccgggggcaacatgtacgccgacgacaccgcgggctgggacacccggatcacggaggacgacctccagaacgaggccaagatcaccgacatcatggagccggagcacgccctgctggccaaggccatcttcaagctcacctaccagaacaaggtggtgcgcgtccagcgccccgcgaagaacgggaccgtgatggacgtgatctcccggcgcgaccagcggggcagcgggcaggtcggcacgtacggcctgaacaccttcaccaacatggaggcccagctgatccgccagatggagtccgaggggatcttcagcccctccgagctcgagacccccaacctggccgagcgggtgctggactggctcgagaagtacggcgtggagcgcctgaagcggatggccatcagcggggacgactgcgtcgtgaagccgatcgacgaccgcttcgccacggcgctgaccgccctcaacgacatgggcaaggtgcggaaggacatcccccagtgggagccctccaaggggtggaacgactggcagcaggtccccttctgcagccaccacttccaccagctgatcatgaaggacggccgcgagatcgtggtgccgtgccggaaccaggacgagctggtcggccgcgcccgggtgtcccagggggccggctggagcctccgcgagaccgcgtgcctggggaagtcctacgcccagatgtggcagctgatgtacttccaccggcgcgacctccggctggccgccaacgccatctgcagcgcggtgcccgtcgactgggtgcccaccagccgcacgacctggtccatccacgcccaccaccagtggatgaccaccgaggacatgctgagcgtgtggaaccgggtctggatcgaggagaacccctggatggaggacaagacgcacatctccagctgggaggacgtgccgtacctcggcaagcgcgaggaccagtggtgcgggtccctgatcggcctgaccgcccgcgccacctgggccaccaacatccaggtggcgatcaaccaggtccggcgcctcatcggcaacgagaactacctggactacatgaccagcatgaagcggttcaagaacgagtccgaccccgagggggccctgtggtga

SEQ ID NO: 8966 - RNA, 9879 nt, synthetic construct
  misc_feature 1..9879: note = derived and/or modified CDS sequence (opt1) from DENV-1__AY835999__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtcacctacgggacctgcagccagaccggcgagcaccggcgcgacaagcggtccgtggccctcgcgccccacgtgggcctggggctggagacgcggaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcctgacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcctgacccaggacgagaagggggtgacgcagaacggccggctcatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcgtgggcggcgtcttcacctccgtggggaagctggtgcaccagatcttcggcaccgcctacggggtcctgttcagcggcgtgtcctggaccatgaagctcgggatcggcgtgctgctgacgtggctcggcctgaacagccgctccaccagcctgtccatgacctgcatcgccgtcgggctcgtgaccctgtacctgggcgtgatggtccaggccgacagcgggtgcgtgatcaactggaagggccgggagctcaagtgcgggtccggcatcttcgtgacgaacgaggtccacacctggaccgagcagtacaagttccaggcggacagcccgaagcgcctgagcgccgccatcggcaaggcctgggaggagggggtgtgcggcatccggtccgccacccgcctggagaacatcatgtggaagcagatcagcaacgagctcaaccacatcctgctggagaacgacatgaagttcaccgtggtcgtgggggacgtggcgggcatcctcgtccaggggaagaagatgatccggccccagcccatggagtacaagtactcctggaagtcctggggcaaggccaagatcatcggcgccgacgtgcagaactccacgttcatcatcgacgggcccaacaccccggagtgccccgacgaccagcgcgcctggaacatctgggaggtggaggactacggcttcgggatcttcaccaccaacatctggctgaagctgcgggacagctacacgcaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacctgcatctggcccaagtcccacaccctgtggagcaacggcgtcctcgagtccgagatgatcatccccaagatctacgggggcccgatcagccagcacaactaccgccccgggtacttcacgcagaccgccggcccctggcacctggggaagctggagctcgacttcgacctgtgcgagggcaccaccgtggtggtcgacgagcactgcggcaaccgggggccgtccctgcgcacgaccaccgtgaccggcaagatcatccacgagtggtgctgccggagctgcacgctgccgcccctccgcttccgcggggagaacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcatcctggccgtgttcttcctgctcatcatggggcagctgacctggaacgacctgatccgcctctgcatcatggtgggcgccaacgcgagcgaccgcatggggatgggcaccacgtacctggccctgatggccaccttcaagatgcggccgatgttcgccgtcggcctcctgttccgccggctgacctcccgcgaggtgctcctgctgaccatcgggctcagcctggtcgcctccgtggagctgcccaacagcctcgaggagctgggcgacgggctggcgatgggcatcatgatcctcaagctgctgacggacttccagtcccaccagctctgggccaccctgctgagcctcaccttcatcaagaccacgttctccctgcactacgcctggaagaccatggccatggtgctgagcatcgtctccctcttccccctgtgcctgagcaccacctcccagaagacgacctggctccccgtgctgctgggcagcctcgggtgcaagccgctgaccatgttcctgatcgcggagaacaagatctggggccggaagtcctggcccctcaacgaggggatcatggccgtgggcatcgtcagcatcctgctgagctccctcctgaagaacgacgtgcccctggccgggcccctcatcgccggcggcatgctgatcgcctgctacgtgatcagcgggtccagcgcggacctgtccctcgagaaggccgccgaggtcagctgggaggaggaggccgagcactccggcgccagccacaacatcctggtggaggtgcaggacgacgggaccatgaagatcaaggacgaggagcgcgacgacacgctgaccatcctcctgaaggcgaccctgctcgccgtctccggcgtgtacccgctgagcatccccgccaccctgttcgtgtggtacttctggcagaagaagaagcagcggtccggggtcctgtgggacacccccagcccgcccgaggtggagcgcgccgtgctcgacgacggcatctaccggatcatgcagcgcggcctgctggggcggtcccaggtcggcgtgggggtgttccaggagaacgtcttccacacgatgtggcacgtgacccgcggcgccgtgctcatgtaccaggggaagcggctggagcccagctgggcgtccgtcaagaaggacctgatcagctacggcggcgggtggcgcctccagggctcctggaacaccggggaggaggtccaggtgatcgccgtcgagcccggcaagaaccccaagaacgtgcagaccgcccccgggacgttcaagacccccgagggcgaggtgggcgccatcgccctggacttcaagcccgggaccagcggctcccccatcgtcaaccgggaggggaagatcgtgggcctgtacggcaacggggtggtcaccacgagcggcacctacgtgagcgcgatcgcccagaccaaggcctcccaggaggggccgctccccgagatcgaggacgaggtgttccgcaagcggaacctgaccatcatggacctgcaccccggcagcgggaagacgcgccggtacctcccggccatcgtccgcgaggcgatcaagcggaagctgcgcaccctgatcctcgcccccacccgcgtggtggcctccgagatggccgaggccctgaagggcatgcccatccggtaccagaccacggcggtcaagagcgagcacaccggcaaggagatcgtggacctgatgtgccacgccaccttcaccatgcgcctcctgtcccccgtgcgggtcccgaactacaacatgatcatcatggacgaggcccacttcacggaccccagctccatcgccgcccgcgggtacatcagcacccgggtgggcatgggggaggcggccgccatcttcatgaccgccacgccgcccggctccatggaggccttcccgcagagcaacgcggtgatccaggacgaggagcgcgacatccccgagcggtcctggaacagcgggtacgagtggatcacggacttccccggcaagaccgtctggttcgtgccctccatcaaggccggcaacgacatcgccaactgcctgcgcaagaacgggaagcgggtgatccagctcagccgcaagaccttcgacaccgagtaccagaagacgaagaacaacgactgggactacgtcgtgaccaccgacatctccgagatgggcgccaacttccgggcggaccgcgtgatcgacccgcggcgctgcctgaagcccgtcatcctgaaggacgggcccgagcgggtgatcctcgccggccccatgccggtcaccgtggccagcgccgcccagcgccgggggcgcatcggccggaaccacaacaaggagggcgaccagtacatctacatggggcagcccctgaacaacgacgaggaccacgcgcactggacggaggccaagatgctgctcgacaacatcaacacccccgagggcatcatccccgccctgttcgagccggagcgcgagaagtccgccgccatcgacggggagtaccgcctgcggggcgaggcgcgcaagaccttcgtggagctcatgcggcgcggggacctgcccgtctggctgagctacaaggtggcctccgagggcttccagtacagcgaccggcgctggtgcttcgacggcgagcggaacaaccaggtgctcgaggagaacatggacgtcgagatctggaccaaggagggggagcgcaagaagctgcggccccgctggctggacgcccggacgtacagcgaccccctcgccctgcgcgagttcaaggagttcgccgcgggccggcgctccgtgagcggggacctgatcctcgagatcggcaagctgccgcagcacctgacccagcgggcccagaacgccctcgacaacctggtgatgctgcacaactccgagcagggcgggcgcgcctaccggcacgcgatggaggagctccccgacaccatcgagaccctgatgctgctcgccctgatcgccgtcctgacgggcggggtgaccctcttcttcctgagcggcaaggggctgggcaagacctccatcggcctcctgtgcgtgatggccagctccgtcctgctctggatggccagcgtggagccccactggatcgcggcctccatcatcctggagttcttcctgatggtgctcctgatccccgagccggaccgccagcggacgccccaggacaaccagctggcctacgtcgtgatcgggctcctgttcatgatcctgaccgtggccgccaacgagatgggcctcctggagacgaccaagaaggacctggggatcggccacgtcgcggtggagaaccaccaccacgccgccatgctcgacgtggacctgcaccccgccagcgcctggaccctgtacgcggtcgccaccacgatcatcaccccgatgatgcgccacaccatcgagaacaccacggccaacatctccctcaccgccatcgccaaccaggcggccatcctgatggggctggacaagggctggcccatcagcaagatggacatcggcgtgcccctcctggccctggggtgctactcccaggtgaaccccctcaccctgaccgccgcgctgctcatgctggtcgcccactacgccatcatcggcccggggctgcaggccaaggccacgcgggaggcgcagaagcgcaccgccgccggcatcatgaagaaccccaccatcgacgggatcgtggccatcgacctcgaccccgtggtctacgacgccaagttcgagaagcagctgggccagatcatgctgctcatcctgtgcaccagccagatcctgctcatgcgcacgacctgggcgctgtgcgagtccatcaccctggccaccggccccctcacgaccctgtgggaggggagcccgggcaagttctggaacaccaccatcgccgtgtccatggccaacatcttccgggggagctacctggccggcgcgggcctcgccttctccctgatgaagtccctcgggggcgggcgccgggggacgggggcccagggcgagaccctcggcgagaagtggaagcgccagctgaaccagctgagcaagtccgagttcaacacctacaagcggagcgggatcatggaggtggaccgctccgaggccaaggagggcctgaagcgcggggagaccacgaagcacgcggtcagccgcggcaccgccaagctccggtggttcgtggagcgcaacctggtgaagcccgaggggaaggtcatcgacctgggctgcggccgcggcgggtggtcctactactgcgccgggctcaagaaggtgaccgaggtgaaggggtacaccaagggcggccccggccacgaggagcccatcccgatggccacgtacgggtggaacctggtcaagctgcacagcggcaaggacgtgttcttcatcccgcccgagaagtgcgacaccctcctgtgcgacatcggggagtccagccccaacccgaccatcgaggagggccgcaccctgcgggtgctcaagatggtcgagccctggctgcgcgggaaccagttctgcatcaagatcctgaacccctacatgccctccgtggtggagacgctcgagcagatgcagcggaagcacggcggcatgctggtccgcaacccgctgagccggaactccacccacgagatgtactgggtgagctgcgggaccggcaacatcgtgtccgccgtcaacatgaccagccgcatgctcctgaaccggttcaccatggcgcaccgcaagcccacgtacgagcgcgacgtggacctgggggccggcacccggcacgtggccgtcgagcccgaggtggccaacctcgacatcatcggccagcgcatcgagaacatcaagcacgagcacaagtccacctggcactacgacgaggacaacccctacaagacctgggcctaccacgggagctacgaggtgaagccgtccggcagcgcgtccagcatggtcaacggggtggtcaagctgctgacgaagccctgggacgtgatccccatggtgacccagatcgccatgaccgacaccacgcccttcggccagcagcgggtcttcaaggagaaggtggacacccgcaccccgaaggccaagcgggggaccgcccagatcatggaggtgacggcccgctggctctggggcttcctgagccggaacaagaagccccgcatctgcacccgggaggagttcacccgcaaggtccggtccaacgcggccatcggcgccgtgttcgtggacgagaaccagtggaacagcgccaaggaggcggtcgaggacgaccgcttctgggacctggtgcaccgggagcgcgagctccacaagcaggggaagtgcgcgacctgcgtgtacaacatgatgggcaagcgggagaagaagctgggggagttcggcaaggccaaggggtcccgcgccatctggtacatgtggctgggcgcccggttcctcgagttcgaggcgctgggcttcatgaacgaggaccactggttcagccgcgagaactccctgagcggggtcgagggcgaggggctccacaagctgggctacatcctgcgggacatctccaagatccccgggggcaacatgtacgccgacgacacggccggctgggacacccgcatcaccgaggacgacctccagaacgaggccaagatcaccgacatcatggagccggagcacgcccagctggccaagagcatcttcaagctgacgtaccagaacaaggtggtgcgggtccagcgccccgccaagaacgggaccgtgatggacgtgatctcccgccgggaccagcgcggcagcgggcaggtcggcacctacggcctcaacaccttcacgaacatggaggcccagctgatccggcagatggagtccgaggggatcttcagccccaacgagctggagacccccaacctcgccgagcgcgtgctggactggctggagaagtacggcgtggagcggctcaagcgcatggccatctccggggacgactgcgtcgtgaagccgatcgacgaccggttcgcgaccgccctgaccgccctgaacgacatgggcaaggtgcgcaaggacatcccccagtgggagcccagcaaggggtggaacgactggcagcaggtccccttctgctcccaccacttccaccagctcatcatgaaggacggccgggagatcgtggtgccgtgccgcaaccaggacgagctggtcggccgggcccgcgtgagccagggggccggctggtccctgcgggagacggcgtgcctcggcaagagctacgcccagatgtggcagctgatgtacttccaccgccgggacctgcgcctcgccgccaacgcgatctgcagcgccgtgcccgtcgactgggtgcccacctcccggaccacctggagcatccacgcccaccaccagtggatgacgaccgaggacatgctgtccgtgtggaaccgcgtctggatcgaggagaacccctggatggaggacaagacccggatcagctcctgggaggacgtgccgtacctgggcaagcgcgaggaccagtggtgcgggagcctcatcggcctgaccgcccgcgccacgtgggcgaccaacatccaggtggccatcaaccaggtccggcgcctgatcggcaacgagaactactccgactacatgaccagcatgaagcggttcaagaacgagtccgagcccgagggggccctctggtga

SEQ ID NO: 8967 - RNA, 9879 nt, synthetic construct
  misc_feature 1..9879: note = derived and/or modified CDS sequence (opt1) from DENV-1__KP686070__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctgacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtcgaggactacggcttcggggtgttcaccaccaacatctggctgaagctccgggactcctacacccagatgtgcgaccaccgcctgatgagcgccgcgatcaaggactccaaggccgtgcacgccgacatgggctactggatcgagagcgagaagaacgagacgtggaagctggcccgggcctccttcatcgaggtcaagacctgcatctggccccgcagccacaccctctggtccaacggcgtgctggagagcgagatgatcatccccaagatctacgggggcccgatctcccagcacaactaccggcccgggtacttcacccagacggcgggcccctggcacctggggaagctcgagctggacttcaacctgtgcgagggcaccaccgtggtcgtggacgagcactgcggcaaccgcgggccgagcctccggaccacgaccgtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggctgctctgcgtgagcatcatgatcgaggaggtgatgcggtcccgctggagccgcaagatgctgatgacgggcaccctggccgtcttcttcctcctgatcatggggcagctgacctggaacgacctcatccggctgtgcatcatggtgggcgccaacgtgtccgaccgcatggggatgggcaccacgtacctggccctcatggcgaccttcaagatgcggccgatgttcgccgtcgggctgctgttccgccggctcaccagccgcgaggtgctgctgctcaccatcgggctgtccctggtcgccagcgtggagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcctggaagaccatggcgatggtgctgtccatcgtcagcctgttccccctctgcctgtccaccacgagccagaagaccacctggctgcccgtgctcctgggctccttcgggtgcaagccgctgaccatgttcctcatcaccgagaacaagatctggggccgcaagagctggcccctgaacgaggggatcatggccgtgggcatcgtctccatcctgctcagcagcctgctgaagaacgacgtgcccctcgccgggcccctgatcgccggcggcatgctgatcgcgtgctacgtgatctccgggagctccgccgacctcagcctggagcgcgccgccgaggtctcctgggaggaggaggccgagcacagcggcgcgtcccacaacatcctggtggaggtgcaggacgacgggacgatgaagatcaaggacgaggagcgggacgacaccctcaccatcctgctgaaggccaccctcctggccgtcagcggcgtgtacccgatgtccatccccgccacgctgttcgtgtggtacttctggcagaagaagaagcagcgcagcggggtcctctgggacacccccagcccgcccgaggtggagcgggccgtgctggacgacggcatctaccgcatcctgcagcggggcctgctcgggcgcagccaggtcggcgtgggggtgttccaggacggcgtcttccacaccatgtggcacgtgacccgcggggcggtgctgatgtaccagggcaagcgcctggagccctcctgggccagcgtcaagaaggacctcatctcctacggcgggggctggcggttccaggggagctggaacacgggcgaggaggtccaggtgatcgccgtcgagcccgggaagaaccccaagaacgtgcagaccacccccggcaccttcaagacgcccgagggcgaggtgggggccatcgccctggacttcaagcccggcacctccgggagccccatcgtcaaccgcgagggcaagatcgtgggcctgtacgggaacggcgtggtcaccacctccgggacgtacgtgagcgcgatcgcccaggccaaggccagccaggagggcccgctccccgagatcgaggacgaggtgttcaagaagcggaacctgaccatcatggacctgcaccccgggtccggcaagacccgccggtacctcccggccatcgtccgcgaggcgatcaagcgcaagctgcggaccctgatcctcgcccccacgcgcgtggtggccagcgagatggccgaggcgctgaagggcatgcccatccggtaccagaccaccgccgtcaagtccgagcacaccgggaaggagatcgtggacctgatgtgccacgccacgttcaccatgcgcctcctgagccccgtgcgggtcccgaactacaacatgatcatcatggacgaggcccacttcaccgaccccgcctccatcgcggcccgcggctacatcagcacccgggtggggatgggcgaggccgccgccatcttcatgacggcgacgccgcccgggtccgtggaggccttcccgcagagcaacgccgtcatccaggacgaggagcgcgacatccccgagcggtcctggaacagcggctacgactggatcaccgacttccccggcaagaccgtgtggttcgtgccctccatcaagagcgggaacgacatcgccaactgcctgcgcaagaacggcaagcgggtcatccagctctcccgcaagacgttcgacaccgagtaccagaagaccaagaacaacgactgggactacgtggtgaccacggacatcagcgagatgggggccaacttccgggcggaccgcgtcatcgacccgcggcgctgcctgaagcccgtgatcctgaaggacggccccgagcgggtcatcctcgccgggcccatgccggtgaccgccgcctccgcggcccagcgccggggccgcatcggccgcaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgggagaagtccgcggccatcgacggcgagtaccgcctgcgcggggaggcccgcaagacgttcgtggagctcatgcggcgcggcgacctgcccgtctggctgtcctacaaggtggccagcgagggcttccagtactccgaccggcgctggtgcttcgacggggagcggaacaaccaggtgctcgaggagaacatggacgtcgagatctggaccaaggagggcgagcgcaagaagctgcggccccgctggctggacgcccggacctacagcgaccccctcgcgctgcgcgagttcaaggagttcgccgccgggcggcgcagcgtgtccggcgacctgatcctcgagatcggcaagctgccgcagcacctgaccctccgggcccagaacgccctggacaacctggtgatgctccacaacagcgagcagggcgggaaggcgtaccgccacgccatggaggagctgcccgacaccatcgagacgctgatgctcctggccctgatcgccgtcctcaccgggggcgtgaccctgttcttcctgtccgggaagggcctcggcaagaccagcatcgggctgctgtgcgtgatggcgtccagcgtcctcctgtggatggcctccgtggagccccactggatcgccgccagcatcatcctggagttcttcctcatggtgctgctgatccccgagccggaccggcagcgcacgccccaggacaaccagctcgcctacgtcgtgatcggcctgctgttcatgatcctcaccgtggcggccaacgagatggggctgctggagaccaccaagaaggacctcggcatcgggcacgtcgtggccgagaaccaccaccacgccacgatgctggacatcgacctgcaccccgcctccgcgtggaccctctacgccgtggccaccaccatcatcacgccgatgatgcggcacaccatcgagaacaccaccgccaacatcagcctgacggccatcgcgaaccaggccgccatcctgatgggcctcgacaagggctggcccatctccaagatggacatcggggtccccctgctggccctcggctgctacagccaggtgaaccccctgaccctgaccgccgcggtgtccatgctcgtcgcccactacgccatcatcgggccgggcctgcaggccaaggcgacccgcgaggcccagaagcgcacggccgccgggatcatgaagaaccccaccgtggacggcatcgtggccatcgacctggaccccgtcgtgtacgacgcgaagttcgagaagcagctcggccagatcatgctgctgatcctctgcaccagccagatcctgctgatgcggaccacgtgggccctctgcgagtccatcaccctggccaccgggcccctgaccacgctctgggagggcagcccggggaagttctggaacaccaccatcgccgtgtccatggccaacatcttccgcggcagctacctggcgggcgccgggctggccttctccctcatgaagtccctgggcgggggccggcgcgggaccggcgcccagggcgagacgctgggggagaagtggaagcggcagctcaaccagctgagcaagtccgagttcaacacctacaagcgcagcggcatcatggaggtcgaccggtccgaggccaaggaggggctgaagcgcggcgagaccaccaagcacgcggtgagccgggggacggccaagctccgctggttcgtggagcggaacctggtcaagcccgagggcaaggtgatcgacctgggctgcgggcgcggcgggtggtcctactactgcgccggcctgaagaaggtgaccgaggtcaaggggtacaccaagggcggccccgggcacgaggagcccatcccgatggccacctacggctggaacatcgtgaagctccacagcgggcgggacgtgttcttcacgccgcccgagaagtgcgacacgctgctgtgcgacatcggcgagtccagccccaacccgaccatcgaggaggggcgcaccctccgggtcctgaagatggtggagccctggctgcgcggcaaccagttctgcatcaagatcctcaacccctacatgccctccgtggtcgagaccctggagcagatgcagcggaagcacggcgggatgctggtgcgcaacccgctcagccggaactccacgcacgagatgtactgggtgagctgcggcaccgggaacatcgtctccgcggtgaacatgaccagccgcatgctgctgaaccgcttcaccatggcccaccggaagcccacgtacgagcgcgacgtggacctcggcgccggcacccggcacgtcgccgtggagcccgagatcgccaacctggacatcatcgggcagcgcatcgagaacatcaagaacgagcacaagtccacctggcactacgacgaggacaacccctacaagacctgggcgtaccacggcagctacgaggtgaagccgtccgggagcgcctccagcatggtcaacggcgtggtccggctgctcacgaagccctgggacgtgatccccatggtgacccagatcgccatgaccgacaccacgcccttcgggcagcagcgcgtcttcaaggagaaggtggacacccggaccccgcgccccaagcggggcaccgcccagatcatggaggtgacggccaagtggctgtggggcttcctgagccgcaacaagaagccccggatctgcacccgcgaggagttcacccggaaggtccgctccaacgcggccatcggggccgtgttcgtggacgagaaccagtggaacagcgccaaggaggccgtcgaggacgagcggttctgggacctcgtgcaccgcgagcgggagctgcacaagcagggcaagtgcgcgacctgcgtgtacaacatgatggggaagcgcgagaagaagctgggcgagttcgggaaggccaagggctcccgggccatctggtacatgtggctcggcgcccgcttcctggagttcgaggcgctggggttcatgaacgaggaccactggttcagccgggagaactccctcagcggcgtcgagggggagggcctgcacaagctggggtacatcctccgcgacatctccaagatcccgggcggcaacatgtacgccgacgacacggccgggtgggacacccgcatcaccgaggacgacctgcagaacgaggccaagatcaccgacatcatggagcccgagcacgccctgctcgcgacgagcatcttcaagctgacctaccagaacaaggtggtgcgggtccagcgccccgccaagtccggcaccgtgatggacgtgatcagccggcgcgaccagcgggggtccggccaggtcggcacctacgggctgaacacgttcaccaacatggaggtgcagctcatccgccagatggagagcgagggcatcttctcccccagcgagctggagaactccaacctggccgagcgggtgctcgactggctggagaagcacggggtcgagcgcctgaagcggatggccatcagcggcgacgactgcgtggtgaagccgaccgacgaccgcttcgccaccgcgctcacggccctgaacgacatggggaaggtccggaaggacatcccccagtgggagccctccaagggctggaacgactggcagcaggtccccttctgcagccaccacttccaccagctgatcatgaaggacggccgcgagatcgtggtcccgtgccggaaccaggacgagctcgtggggcgcgcccgggtgagccagggcgccgggtggtccctgcgcgagaccgcctgcctgggcaagagctacgcgcagatgtggcagctcatgtacttccaccggcgcgacctgcggctggccgccaacgccatctgctccgccgtccccgtgaactgggtgcccaccagccgcaccacctggtccatccacgcgcaccaccagtggatgacgaccgaggacatgctcagcgtctggaaccgcgtgtggatcgaggagaacccctggatggaggacaagacccacgtgtccagctgggaggacgtcccgtacctggggaagcgggaggaccagtggtgcggctccctgatcggcctcaccgcccgcgccacgtgggccaccaacatccaggtggcgatcaaccaggtgcggcgcctgatcgggaacgagaactacctggactacatgaccagcatgaagcggttcaagaacgagtccgaccccgagggcgccctctggtga

SEQ ID NO: 8968 - RNA, 9876 nt, synthetic construct
  misc_feature 1..9876: note = derived and/or modified CDS sequence (opt1) from DENV-1__KF672760__SS-prME
  source 1..9876: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccaccgcccgcggggcgcgccgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccggtccaccagcctctccatgacctgcatcgccgtggggatggtgaccctgtacctgggcgtcatggtgcaggccgacagcgggtgcgtgatcaactggaagggccgcgagctcaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtcgtggtgggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtcgaggactacgggttcggcgtgttcaccacgaacatctggctgaagctgcgcgactcctacacccagatgtgcgaccaccggctcatgagcgcggccatcaaggactccaaggccgtgcacgccgacatgggctactggatcgagagcgagaagaacgagacctggaagctggcccgcgcgtccttcatcgaggtcaagacctgcacgtggcccaagagccacaccctgtggtccaacggggtgctcgagagcgagatgatcatccccaagatcttcggcgggccgatctcccagcacaactaccggcccggctacttcacccagaccgccgggccctggcacctgggcaagctggagctcgacttcgacctgtgcgagggcacgaccgtggtcgtggacgagcactgcgggaaccgcggcccgagcctgcggaccaccacggtgaccgggaagatcatccacgagtggtgctgccgctcctgcaccctgccgcccctgcggttccgcggcgaggacgggtgctggtacggcatggagatccggcccgtcaaggagaaggaggagaacctggtgcgcagcatggtgtccgccggcagcggggaggtcgacagcttctccctcggcatcctgtgcgtgagcatgatgatcgaggaggtgatgcggtcccgctggagccgcaagatgctgatgaccgggacgctcgccgtcttcctgctgctcatcatgggccagctgacctggaacgacctgatccggctctgcatcatggtgggggccaacgcgtccgaccgcatgggcatgggcaccacctacctggccctgatggccacgttcaagatgcggccgatgttcgccgtggggctcctgttccgccggctgaccagccgcgaggtcctcctgctgaccatcggcctctccctggtggcctgcgtcgagctgcccaacagcctcgaggagctgggggacggcctggcgatgggcatcatgatgctcaagctgctgaccgagttccagccccaccagctctggacgaccctgctgtccctcaccttcgtgaagaccacgctgagcctggactacgcctggaagaccaccgccatggtgctctccatcgtcagcctgttccccctgtgcctctccaccacgagccagaagaccacctggctgccggtgctgctcgggtccttcggctgcaagcccctgaccatgttcctgatcaccgagaacaagatctgggggcgcaagagctggcccctcaacgagggcatcatggccatcgggatcgtgtccatcctgctgagctccctcctgaagaacgacgtccccctggcgggcccgctcatcgccggcgggatgctgatcgcctgctacgtgatcagcggcagctccgccgacctgagcctcgagaaggccgcggaggtgtcctgggagcaggaggccgagcacagcggggcctcccacaacatcctggtcgaggtgcaggacgacggcacgatgaagatcaaggacgaggagcgcgacgacaccctgaccatcctcctgaaggccaccctgctcgccgtgagcggggtctaccccatgtccatccccgcgacgctgttcgtgtggtacttctggcagaagaagaagcagcggagcggcgtgctgtgggacaccccctccccgcccgaggtcgagcgcgccgtgctcgacgacggcatctaccggatcctgcagcgcgggctgctgggccggagccaggtgggggtcggcgtgttccaggacggggtgttccacaccatgtggcacgtcacccgcggcgccgtgctcatgtaccagggcaagcggctggagccctcctgggccagcgtgaagaaggacctgatctcctacgggggcgggtggcgcttccagggcagctggaacacgggggaggaggtccaggtgatcgccgtggagcccggcaagaacccgaagaacgtccagaccacccccggcaccttcaagacgcccgagggggaggtgggcgcgatcgccctcgacttcaagcccgggacctccggcagcccgatcgtgaaccgggagggcaagatcgtcgggctgtacggcaacggggtggtgaccacctccggcacgtacgtcagcgccatcgcccaggccaaggcgtcccaggaggggcccctgcccgagatcgaggacgaggtgttcaagaagcgcaacctcaccatcatggacctgcacccgggcagcggcaagacccggcgctacctgcccgccatcgtgcgggaggccatcaagcgcaagctccgcaccctgatcctggcccccacgcgggtcgtggcgagcgagatggccgaggccctcaaggggatgcccatccgctaccagaccaccgccgtgaagtccgagcacaccggccgggagatcgtcgacctgatgtgccacgccacgttcaccatgcgcctgctcagcccggtgcgggtgcccaactacaacatgatcatcatggacgaggcgcacttcaccgaccccgcctccatcgccgcccgcgggtacatcagcacccgggtcggcatgggggaggccgcggccatcttcatgacggccacgccgcccggctccgtggaggccttcccccagagcaacgccgtgatccaggacgaggagcgcgacatccccgagcggtcctggaacagcggctacgactggatcaccgacttccccgggaagaccgtctggttcgtgccctccatcaagagcggcaacgacatcgcgaactgcctgcgcaagaacgggaagcgggtgatccagctgtcccgcaagacgttcgacaccgagtaccagaagaccaagaacaacgactgggactacgtcgtgaccacggacatcagcgagatgggcgccaacttccgggccgaccgcgtgatcgacccccggcgctgcctcaagcccgtcatcctgaaggacgggcccgagcgggtgatcctggccggcccgatgcccgtcaccgtggcgtccgccgcccagcgccggggccgcatcgggcgcaaccagaacaaggagggcgaccagtacgtgtacatggggcagcccctcaacaacgacgaggaccacgcccactggaccgaggccaagatgctgctggacaacatcaacacccccgagggcatcatcccggccctcttcgagcccgagcgggagaagtccgccgccatcgacggggagtaccgcctgcggggcgaggcccgcaagacgttcgtcgagctgatgcggcgcggcgacctccccgtgtggctgtcctacaaggtggccagcgaggggttccagtactccgaccggcgctggtgcttcgacggcgagcggaacaaccaggtcctggaggagaacatggacgtggagatctggaccaaggagggggagcgcaagaagctccggccccgctggctggacgcgcggacctacagcgacccgctggccctccgcgagttcaaggagttcgccgccggccggcgctccgtgagcggcgacctgatcctggagatcgggaagctcccccagcacctgaccctgcgggcccagaacgcgctcgacaacctggtcatgctgcacaacagcgagcagggcgggaaggcctaccgccacgccatggaggagctccccgacaccatcgagacgctgatgctgctcgccctgatcgcggtgctgaccggcggggtgaccctcttcttcctgtccggcaagggcctggggaagaccagcatcggcctcctgtgcgtcacggcctccagcgccctgctctggatggcctccgtggagccccactggatcgccgcgagcatcatcctggagttcttcctgatggtgctcctgatcccggagcccgaccggcagcgcacgccccaggacaaccagctggcctacgtcgtgatcgggctcctgttcatgatcctgaccgtggccgccaacgagatgggcctcctggagaccacgaagaaggacctggggatcggctacgtcgccgcggagaaccaccagcacgccaccatgctcgacgtggacctgcacccggcctccgcctggaccctgtacgccgtggcgaccacggtcatcacccccatgatgcggcacaccatcgagaacaccacggccaacatcagcctcaccgccatcgccaaccaggccgcgatcctgatgggcctggacaaggggtggcccatctccaagatggacatcggcgtgcccctcctggccctggggtgctacagccaggtgaacccgctcaccctgaccgccgccgtcctgatgctcgtggcgcactacgccatcatcggccccgggctgcaggccaaggccacgcgcgaggcccagaagcgcaccgcggccggcatcatgaagaaccccaccgtggacggcatcgtcgccatcgacctggaccccgtggtgtacgacgccaagttcgagaagcagctcgggcagatcatgctgctgatcctctgcacctcccagatcctgctgatgcggacgacctgggccctctgcgagagcatcaccctggcgaccggcccgctgacgaccctctgggaggggtcccccggcaagttctggaacaccaccatcgccgtcagcatggccaacatcttccgcggctcctacctggccggggccggcctggcgttcagcctcatgaagtccctcgggggcgggcggcgcggcacgggcgcccagggggagaccctgggcgagaagtggaagcggcagctcaaccagctgagcaagtccgagttcaacacctacaagcgcagcgggatcatggaggtggaccggagcgaggccaaggagggcctgaagcgcggggagaccacgaagcacgccgtgtcccggggcaccgcgaagctccgctggttcgtcgagcggaacctggtgaagcccgagggcaaggtgatcgacctggggtgcggccgcgggggctggagctactactgcgccgggctgaagaaggtcaccgaggtgaagggctacaccaagggcgggcccggccacgaggagccgatccccatggccacctacgggtggaacctcgtgaagctgcactccggcaaggacgtcttcttcatgccgcccgagaagtgcgacacgctgctctgcgacatcggggagagctccccgaaccccaccatcgaggagggccggaccctgcgcgtgctgaagatggtggagccctggctccggggcaaccagttctgcatcaagatcctgaacccctacatgccgagcgtcgtggagaccctggagcgcatgcagcggaagcacgggggcatgctcgtgcgcaaccccctgtcccggaacagcacgcacgagatgtactgggtctcctgcgggaccggcaacatcgtgagcgccgtgaacatgacctcccgcatgctgctcaaccgcttcaccatggcccaccggaagcccacgtacgagcgcgacgtcgacctgggcgcggggacccggcacgtggccgtggagcccgaggtcgccaacctggacatcatcggccagcgcatcgagaacatcaagaacgagcacaagagcacctggcactacgacgaggacaacccgtacaagacctgggcctaccacgggtcctacgaggtgaagcccagcggctccgccagctccatggtcaacggggtggtgcggctcctgacgaagccctgggacgtcatccccatggtgacccagatcgcgatgaccgacaccacgccgttcggccagcagcgcgtgttcaaggagaaggtcgacacccggacgccccgggccaagcggggcaccacgcagatcatggaggtgaccgccaagtggctgtgggggttcctcagccgcaacaagaagccccggatctgcacccgcgaggagttcacccggaaggtgcgctccaacgccgccatcggcgcggtcttcgtggacgagaaccagtggaacagcgccaaggaggccgtggaggacgagcggttctgggacctggtccaccgcgagcgggagctgcacaagcaggggaagtgcgccacgtgcgtgtacaacatgatgggcaagcgcgagaagaagctcggggagttcggcaaggcgaagggcagccgggccatctggtacatgtggctgggggcccgcttcctggagttcgaggccctcggcttcatgaacgaggaccactggttctcccgggagaacagcctgtccggggtggagggcgaggggctgcacaagctcggctacatcctgcgcgacatcagcaagatcccgggcgggaacatgtacgccgacgacaccgcgggctgggacacccgcatcaccgaggacgacctgcagaacgaggccaagatcacggacatcatggagcccgagcacgccctcctggccacctccatcttcaagctgacctaccagaacaaggtcgtgcgggtgcagcgccccgccaagaacgggaccgtcatggacgtgatcagccggcgcgaccagcggggctccggccaggtggggacgtacggcctcaacaccttcaccaacatggaggtccagctgatccgccagatggagagcgaggggatcttcctgccctccgagctcgagaccccgaacctggcggagcgggccctggactggctcgagaagcacggcgccgagcgcctgaagcggatggccatcagcggggacgactgcgtggtgaagcccatcgacgaccgcttcgccacggcgctgaccgccctcaacgacatgggcaaggtccggaaggacatcccccagtgggagccctccaagggctggaacgactggcagcaggtcccgttctgcagccaccacttccaccagctgatcatgaaggacgggcgcgagatcgtggtcccctgccggaaccaggacgagctggtgggccgcgcccgggtgtcccagggggccggctggagcctccgcgagaccgcctgcctggggaagtcctacgcgcagatgtggcagctgatgtacttccaccggcgcgacctccggctggccgccaacgccatctgcagcgcggtccccgtggactgggtgcccgcctcccgcaccacctggagcatccacgcccaccaccagtggatgacgaccgaggacatgctgagcgtctggaaccgcgtgtggatcgaggagaacccgtggatggaggacaagacccacgtgtccagctgggaggaggtcccctacctcggcaagcgggaggaccagtggtgcggctccctgatcgggctgaccgcccgcgccacgtgggcgaccaacatccaggtggccatcaaccaggtgcggcgcctcatcggcaacgagaactacctggactacatgaccagcatgaagcggttcaagaacgagtccgaccccgagggggccctgtgg

SEQ ID NO: 8969 - RNA, 9876 nt, synthetic construct
  misc_feature 1..9876: note = derived and/or modified CDS sequence (opt1) from DENV-1__KF672759__SS-prME
  source 1..9876: mol_type = other RNA
agcgtgaccatgctgctcatgctgctgcccaccgccctcgccttccacctgaccacccggggcggggagccccacatgatcgtgagcaagcaggagcggggcaagagcctcctcttcaagacctccgtgggggtgaacatgtgcaccctgatcgcgatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtcggcctggggctcgagacgcgcaccgagacctggatgagctccgagggcgcctggaagcagatccagaaggtggagacctgggccctgcggcaccccgggttcacggtgatcgccctgttcctcgcccacgcgatcggcaccagcatcacccagaaggggatcatcttcatcctgctgatgctcgtgaccccctccatggccatgcgctgcgtgggcatcggcaaccgggacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgccgtgctccgcaagctgtgcatcgaggcgaagatcagcaacaccaccacggactcccggtgccccacccagggcgaggccaccctggtcgaggagcaggacgccaacttcgtgtgccgccggaccttcgtggaccgcggctgggggaacggctgcggcctcttcggcaaggggagcctgctgacgtgcgccaagttcaagtgcgtcaccaagctcgagggcaagatcgtgcagtacgagaacctgaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctcaccctggactgcagcccccggaccggcctggacttcaacgagatggtgctcctgacgatgaaggagaagtcctggctggtgcacaagcagtggttcctcgacctgccgctgccctggacctccggggccagcaccagccaggagacctggaaccgccaggacctcctggtcacgttcaagaccgcccacgccaagaagcaggaggtggtggtcctgggctcccaggagggcgcgatgcacaccgccctcaccggggccacggagatccagaccagcggcaccaccacgatcttcgccgggcacctgaagtgccggctgaagatggacaagctcaccctgaagggcatgtcctacgtgatgtgcaccgggagcttcaagctggagaaggaggtggccgagacccagcacggcacggtcctggtccaggtgaagtacgagggcaccgacgcgccctgcaagatccccttcctcacccaggacgagaagggggtcacccagaacggccgcctgatcacggccaacccgatcgtgaccgacaaggagaagcccgtgaacatcgagaccgagccgcccttcggggagtcctacatcgtcgtgggcgccggcgagaaggccctgaagctcagctggttcaagaaggggtccagcatcggcaagatgttcgaggcgaccgcccgcggggcccgccggatggccatcctgggcgacacggcctgggacttcgggtccatcggcggcctgttcaccagcgtggggaagctcatccaccaggtcttcggcaccgcgtacggggtgctgttctccggcgtgagctggaccatgaagatcgggatcggcatcctgctcacgtggctgggcctgaactcccgcagcacctccctcagcatgacctgcatcgccgtcgggatggtgaccctgtacctgggcgtgatggtccaggccgactccgggtgcgtgatcaactggaagggccgcgagctcaagtgcgggagcggcatcttcgtgacgaacgaggtccacacctggaccgagcagtacaagttccaggccgactccccgaagcggctgagcgccgcgatcggcaaggcctgggaggagggggtgtgcggcatccgcagcgccacccggctggagaacatcatgtggaagcagatctccaacgagctcaactacatcctgctggagaacgacatgaagttcaccgtggtcgtgggggacgtgaacggcatcctcgcccaggggaagaagatgatccgcccccagcccatggagcacaagtacagctggaagtcctggggcaaggccaagatcatcggcgcggacatccagaacacgaccttcatcatcgacgggcccgacaccccggagtgccccgacgaccagcgggcctggaacatctgggaggtcgaggactacggcttcgggatcttcaccacgaacatctggctgaagctgcgcgacagccacacccagatgtgcgaccaccggctcatgtccgccgccatcaaggacagcaaggcggtgcacgccgacatgggctactggatcgagtccgagaagaacgagacctggaagctggcccgcgccagcttcatcgaggtgaagacctgcatctggcccaagtcccacacgctgtggagcaacggcgtcctcgagtccgagatggtgatccccaagatctacgggggcccgatcagccagcacaactaccggcccgggtacttcacccagaccgccggcccctggcacctggggaagctggagctcgacttcgacctgtgcgagggcaccacggtggtcgtggacgagcactgcggctaccgcgggccgtccctgcggaccaccaccgtgacgggcaagatcatccacgagtggtgctgccgcagctgcaccctgccgcccctgcggttccgcggggaggacggctgctggtacgggatggagatccggcccgtcaaggagaaggaggagaacctggtgcgctccatggtgagcgcgggctccggcgaggtcgacagcttcagcctcgggatcctgtgcgtgtccatcctgatcgaggaggtgatgcggagccgctggtcccggaagatgctcatgaccggcaccctggccgtcttcctgctcctgatcatggggcagctgacgtggaacgacctcatccgcctgtgcatcatggtgggcgccaacgccagcgaccgcatggggatgggcaccacctacctggccctcatggcgaccttcaagatgcggccgatgttcgccgtgggcctgctgttccgccggctcacgtgccgcgaggtcctgctgctcaccgtggggctgtccctggtcgccagcgtggagctccccaactccctggaggagctgggcgacgggctcgccatgggcatcatgatgctgaagctgctcaccgacttccagccccaccagctgtggaccacgctgctcagcctgaccttcatccggacctccctgagcctcgactacgcctggaagaccatggcgatggccctgtccatcgtgagcctgttccccctctgcctgtccacgaccagccagaagaccacctggctgccggtcctcctgggctccttcgggtgcaagcccctgacgatgttcctcatcaccgagaacaagatctggggccgcaagagctggcccatcaacgaggggatcatggccgtgggcatcgtgtccatcctgctgagctccctcctgaagaacgacgtccccctggccgggccgctcatcgcgggcggcatgctgatcgcctgctacgtgatcagcgggagctccgccgacctgagcctcgagaaggccgccgaggtgtcctgggaggaggaggcggagcacagcggcacctcccacaacatcctggtcgaggtgcaggacgacgggaccatgaagatcaaggacgaggagcgggacgacaccctgacgatcctcctgaaggccaccctgctcgccgtgagcggcgtctaccccatgtccatccccgccaccctgttcgtgtggtacttctggcagaagaagaagcagcgcagcggggtgctgtgggacaccccctccccgcccaaggtcgagcgggccgtgctggacgacggcatctaccgcatcctccagcggggcctgctggggcgcagccaggtgggcgtcggggtgttccaggacggcgtgttccacacgatgtggcacgtcacccgcggggcggtgctcatgtaccagggcaagcgcctggagccctcctgggccagcgtgaagaaggacctgatctcctacggcgggggctggcggttccaggggagctggaacaccggcgaggaggtccaggtgatcgccgtggagcccgggaagaacccgaagaacgtccagaccacgcccggcaccttcaagacccccgagggcgaggtgggggccatcgccctcgacttcaagcccggcacctccgggagcccgatcgtgaaccgcgagggcaagatcgtcggcctgtacgggaacggcgtggtgacgacctccgggacctacgtcagcgcgatcgcccaggccaaggccacccaggagggccccctgcccgagatcgaggacgaggtgttcaagaagcggaacctcacgatcatggacctgcacccggggtccggcaagacccgccggtacctgcccgccatcgtgcgcgaggcgatcaagcggaagctccgcaccctgatcctggcccccacccgcgtcgtggccagcgagatggccgaggcgctcaagggcatgcccatccggtaccagacgaccgccgtcaagagcgagcacaccgggcgcgagatcgtcgacctgatgtgccacgccaccttcacgatgcggctgctctccccggtgcgcgtgcccaactacaacatgatcatcatggacgaggcccacttcaccgaccccgccagcatcgcggcccggggctacatctccacccgcgtcgggatgggcgaggccgccgccatcttcatgaccgcgacgcccccggggagcgtggaggccttcccccagtccaacgccgtgatccaggacgaggagcgggacatccccgagcgcagctggaactccggctacgactggatcaccgacttccccggcaagaccgtctggttcgtgccgagcatcaagtccgggaacgacatcgccaactgcctgcggaagaacggcaagcgcgtgatccagctgagccggaagaccttcgacacggagtaccagaagaccaagaacaacgactgggactacgtcgtgaccaccgacatctccgagatgggggccaacttccgcgcggaccgggtgatcgacccccgccggtgcctcaagcccgtcatcctgaaggagggccccgagcgcgtgatcctggccgggccgatgcccgtcacggtggccagcgccgcgcagcggcgcggccggatcggccgcaaccagaacaaggagggggaccagtacatctacatgggccagcccctcaacaacgacgaggaccacgcccactggaccgaggccaagatgctgctggacaacatcaacacccccgaggggatcatcccggccctcttcgagcccgagcgcgagaagtccgccgcgatcgacggcgagtaccggctgcgcggggaggcccggaagaccttcgtggagctgatgcgccggggcgacctccccgtctggctgagctacaaggtggcctccgagggcttccagtacagcgaccgccggtggtgcttcgacggggagcgcaacaaccaggtgctggaggagaacatggacgtcgagatctggacgaaggagggcgagcggaagaagctccgcccccggtggctggacgcccgcacctactccgacccgctggccctccgggagttcaaggagttcgcggccgggcgccggagcgtgtccggcgacctgatcctggagatcggcaagctcccccagcacctgaccctgcgcgcccagaacgccctcgacaacctggtgatgctgcacaacagcgagcagggcgggaaggcctaccggcacgcgatggaggagctccccgacaccatcgagaccctgatgctgctcgccctgatcgccgtcctgaccggcggggtgaccctcttcttcctgagcgggaaggggctgggcaagacctccatcgggctcctgtgcgtgatggccagctccgcgctgctctggatggccagcgtcgagccccactggatcgccgcctccatcatcctggagttcttcctgatggtgctcctgatcccggagcccgaccgccagcggacgccccaggacaaccagctggcctacgtggtcatcggcctcctgttcatgatcctgacggtggcggccaacgagatggggctcctggagaccaccaagaaggacctgggcatcgggcacgtggccgtcgagaaccaccaccacgccaccatgctcgacgtggacctgcgcccggccagcgcgtggacgctgtacgccgtggccaccaccgtcatcacccccatgatgcggcacacgatcgagaacaccaccgccaacatctccctcaccgccatcgcgaaccaggccgccatcctgatgggcctggacaagggctggcccatcagcaagatggacatcggggtgcccctcctggccctgggctgctactcccaggtgaacccgctcacgctgaccgccgcggtcctgatgctcgtggcccactacgccatcatcgggcccggcctgcaggccaaggcgacccgcgaggcccagaagcgcaccgccgccgggatcatgaagaaccccacggtggacggcatcgtcaccatcgacctggaccccgtggtgtacgacgccaagttcgagaagcagctcggccagatcatgctgctgatcctctgcaccagccagatcctgctgatgcggaccacgtgggcgctctgcgagtccatcaccctggccaccgggccgctgaccacgctctgggagggcagccccgggaagttctggaacaccaccatcgccgtctccatggccaacatcttccgcggcagctacctggccggcgcggggctggccttctccctcatgaagtccctgggcgggggccggcgcgggaccggcgcccagggcgagacgctgggggagaagtggaagcggcagctcaaccagctgtccaagagcgagttcaacacctacaagaagtccggcatcatggaggtggaccgcagcgaggccaaggaggggctgaagcggggcgagaccaccaagcacgccgtgagccgcgggacggcgaagctgcggtggttcgtcgagcgcaacctcgtgaagcccgagggcaaggtgatcgacctgggctgcgggcggggcgggtggtcctactactgcgccggcctgaagaaggtcaccgaggtgaaggggtacaccaagggcggccccgggcacgaggagccgatccccatggccacctacggctggaacctcgtgaagctgcacagcgggaaggacgtcttcttcacgccgcccgagaagtgcgacacgctgctctgcgacatcggcgagtccagcccgaaccccaccatcgaggaggggcgcaccctgcgggtgctgaagatggtggagccctggctccgcggcaaccagttctgcatcaagatcctgaacccctacatgccgtccgtcgtggagaccctggagcagatgcagcggaagcacggcgggatgctcgtgcgcaaccccctgagccggaactccacgcacgagatgtactgggtcagctgcggcaccgggaacatcgtgtccgccgtgaacatgaccagccgcatgctgctcaaccggttcaccatggcgcaccgcaagcccacgtacgagcgcgacgtcgacctgggcgccggcacccggcacgtggccgtggagcccgaggtcgccaacctggacatcatcgggcagcgcatcgagaacatcaagaacgagcacaagtccacctggcactacgacgaggacaacccgtacaagacctgggcctaccacggcagctacgaggtgaagccctccgggagcgcgtccagcatggtcaacggcgtggtgcggctcctgacgaagccctgggacgtcatccccatggtgacccagatcgccatgaccgacaccacgccgttcgggcagcagcgcgtgttcaaggagaaggtcgacacccggacgccccgggccaagcggggcaccgcccagatcatggaggtgacggccaagtggctgtggggcttcctctcccgcaacaagaagccccggatctgcacccgcgaggagttcacccggaaggtgcgcagcaacgcggccatcggggccgtcttcgtggacgagaaccagtggaactccgccaaggaggccgtggaggacgagcggttctgggacctggtccaccgcgagcgggagctgcacaagcagggcaagtgcgcgacctgcgtgtacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttcagccgggagaactccctgagcggcgtggagggggagggcctgcacaagctcgggtacatcctgcgcgacatctccaagatcccgggcggcaacatgtacgccgacgacacggccgggtgggacacccggatcaccgaggacgacctgcagaacgaggccaagatcaccgacatcatggagcccgagcacgccctcctggcgacgagcatcttcaagctgacctaccagaacaaggtcgtgcgcgtgcagcgccccgccaagtccggcaccgtcatggacgtgatcagccggcgcgaccagcgggggtccggccaggtgggcacctacgggctcaacacgttcaccaacatggaggtccagctgatccgccagatggagagcgagggcatcttctcccccagcgagctggagaccccgaacctcgccaagaaggtgctggactggctggagaagcacggggccgagcggctcaagcgcatggccatctccggcgacgactgcgtggtcaagcccatcgacgaccggttcgcgaccgccctgacggccctgaacgacatggggaaggtgcgcaaggacatcccccagtgggagcccagcaagggctggaacgactggcagcaggtcccgttctgctcccaccacttccaccagctcatcatgaaggacggccgggagatcgtcgtgccctgccgcaaccaggacgagctggtggggcgggcccgcgtcagccagggcgccgggtggtccctgcgggagaccgcgtgcctcggcaagagctacgcccagatgtggcagctgatgtacttccaccgccgggacctgcgcctcgccgccaacgccatctgctccgcggtgcccgtggactgggtccccaccagccggaccacctggagcatccacgcccaccaccagtggatgacgaccgaggacatgctgtccgtgtggaaccgcgtgtggatcgaggagaacccgtggatggaggacaagacccacgtcagctcctgggaggaggtgccctacctggggaagcgggaggaccagtggtgcggcagcctcatcggcctgaccgcccgcgccacgtgggcgaccaacatccaggtggccatcaaccaggtccgccggctgatcgggaacgagaactacctcgactacatgacctccatgaagcgcttcaagaacgagagcgaccccgagggcgccctgtgg

SEQ ID NO: 8970 - RNA, 9876 nt, synthetic construct
  misc_feature 1..9876: note = derived and/or modified CDS sequence (opt1) from DENV-1__KF672761__SS-prME
  source 1..9876: mol_type = other RNA
agcgtgaccatgctgttcatgctgctgcccaccgccctggccttccacctcaccacccgcggcggggagccccacatgatcgtgagcaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtcacctacgggacctgcagccagaccggcggccaccggcgcgacaagcggtccgtggccctcgcgccccacgtggggctgggcctggagacccgcaccgagacctggatgagctccgagggggcctggaagcagatccagaaggtcgagacctgggccctccggcaccccggcttcacggtgatcgccctgttcctggcgcacgccatcgggaccagcatcacccagaagggcatcatcttcatcctcctgatgctggtgaccccctccatggccatgcgctgcgtcggcatcgggaaccgggacttcgtggagggcctcagcggggccacgtgggtggacgtcgtgctggagcacggctcctgcgtgaccaccatggccaagaacaagcccaccctggacatcgagctcctgaagacggaggtcaccaaccccgcggtgctgcgcaagctctgcatcgaggccaagatcagcaacaccaccacggactcccggtgcccgacccagggcgaggccaccctggtggaggagcaggacgccaacttcgtctgccgccggaccttcgtggaccgcgggtggggcaacgggtgcggcctgttcgggaagggcagcctcctgacgtgcgccaagttcaagtgcgtgaccaagctggagggcaagatcgtccagtacgagaacctcaagtactccgtgatcgtgaccgtccacaccggggaccagcaccaggtgggcaacgagacgaccgagcacgggaccatcgcgaccatcacgccccaggcccccacgagcgagatccagctgaccgactacggcgccctgaccctcgactgcagcccccggaccgggctggacttcaacgagatggtcctgctcacgatgaaggagaagtcctggctggtgcacaagcagtggttcctggacctcccgctgccctggacctccggcgccagcaccagccaggagacctggaaccgccaggacctgctcgtgacgttcaagaccgcccacgcgaagaagcaggaggtcgtggtgctgggctcccaggagggggccatgcacaccgccctgaccggcgccacggagatccagaccagcgggaccaccacgatcttcgccggccacctcaagtgccggctgaagatggacaagctgaccctcaaggggacctcctacgtcatgtgcaccggcagcttcaagctggagaaggaggtggcggagacgcagcacggcaccgtgctggtccaggtgaagtacgaggggaccgacgccccctgcaagatccccttctccacccaggacgagaagggcgtgacgcagaacgggcgcctgatcaccgccaacccgatcgtcaccgacaaggagaagcccgtgaacatcgagaccgagccgcccttcggcgagagctacatcgtggtcggcgccggggagaaggcgctcaagctgtcctggttcaagaagggcagctccatcgggaagatgttcgaggccacggcccggggcgcccgccggatggccatcctgggggacaccgcgtgggacttcggcagcatcggcggggtgttcacctccgtgggcaagctcgtccaccaggtgttcgggaccgcctacggcgtgctgttcagcggggtctcctggacgatgaagatcggcatcggcatcctgctcacctggctggggctgaacagccgctccaccagcctctccatgacctgcatcgccgtgggcatggtgacgctgtacctgggggtcatggtgcaggccgacagcggctgcgtgatcaactggaaggggcgcgagctcaagtgcggctccggcatcttcgtcaccaacgaggtgcacacctggaccgagcagtacaagttccaggccgacagcccgaagcggctgagcgcggccatcgggaaggcctgggaggagggcgtgtgcgggatccgctccgccacccggctggagaacatcatgtggaagcagatcagcaacgagctcaaccacatcctgctggagaacgacatgaagttcacggtcgtggtgggcgacgccaacgggatcctcgcgcagggcaagaagatgatccgcccccagcccatggagcacaagtactcctggaagtcctggggcaaggccaagatcatcggggccgacatccagaacaccaccttcatcatcgacggccccgacaccccggagtgccccgacgagcagcgggcctggaacatctgggaggtcgaggactacgggttcggcatcttcacgaccaacatctggctgaagctgcgcgactcctacacccagatgtgcgaccaccggctcatgagcgcggccatcaaggactccaaggccgtgcacgccgacatgggctactggatcgagagcgagaagaacgagacctggaagctggcccgcgcgtccttcatcgaggtgaagacgtgcatctggcccaagagccacaccctgtggtccaacggggtcctcgagagcgagatgatcatccccaagatctacggcgggccgatctcccagcacaactaccggcccggctacttcacccagaccgccgggccctggcacctgggcaagctggagctcgacttcgacctgtgcgagggcacgaccgtggtggtcgacgagcactgcgggaaccgcggcccgagcctgcggaccaccacggtgaccgggaagatcatccacgagtggtgctgccgctcctgcaccctgccgcccctccggttccgcggcgaggacgggtgctggtacggcatggagatccggcccgtgaaggagaaggaggagaacctggtccgcagcatggtgtccgccggcagcggggaggtggacagcttctccctcggcatcctgtgcgtcagcatcatgatcgaggaggtgatgcggtcccgctggagccggaagatgctgatgaccgggacgctcgccgtgttcctgctgctcatcatgggccagctgacctggaacgacctgatccgcctctgcatcatggtcggggccaacgcgtccgacaagatgggcatgggcaccacctacctggccctgatggccacgttcaagatgcgcccgatgttcgccgtggggctcctgttccggcgcctgaccagccgggaggtgctcctgctgaccatcggcctctccctggtcgccagcgtggagctgcccaactccctcgaggagctgggggacggcctggcgatgggcatcatgatgctcaagctgctgaccgagttccagccccaccagctctggacgaccctgctgagcctcaccttcatcaagaccacgctgtccctggactacgcctggaagaccaccgccatggtcctcagcatcgtgtccctgttccccctgtgcctcagcaccacgtcccagaagaccacctggctgccggtgctgctcgggagcttcggctgcaagcccctgaccatgttcctgatcaccgagaacaagatctgggggcgcaagtcctggcccctcaacgagggcatcatggccatcgggatcgtcagcatcctgctgtccagcctcctgaagaacgacgtgcccctggcgggcccgctcatcgccggcgggatgctgatcgcctgctacgtgatcagcggctccagcgccgacctgtccctcgagaaggccgcggaggtcagctgggaggaggaggccgagcactccgggacgagccacaacatcctggtggaggtgcaggacgacggcaccatgaagatcaaggacgaggagcgggacgacaccctgaccatcctcctgaaggccacgctgctcgccgtctccggggtgtaccccatgagcatccccgccaccctgttcgtgtggtacttctggcagaagaagaagcagcgctccggcgtcctgtgggacacccccagcccgcccgaggtggagcgggcggtgctcgacgacggcatctaccgcatcctgcagcgggggctgctgggccgctcccaggtcggggtgggcgtgttccaggacggggtcttccacaccatgtggcacgtgacgcggggcgccgtgctcatgtaccagggcaagcgcctggagcccagctgggcctccgtcaagaaggacctgatcagctacgggggcgggtggcggttccagggctcctggaacaccggggaggaggtccaggtgatcgccgtcgagcccggcaagaacccgaagaacgtgcagaccacccccggcacgttcaagacccccgagggggaggtgggcgccatcgcgctcgacttcaagcccgggaccagcggctccccgatcgtcaaccgcgagggcaagatcgtggggctgtacggcaacggggtggtcaccacgagcggcacctacgtgtccgccatcgcccaggccaaggccagccaggaggggcccctgcccgagatcgaggacgaggtgttcaagaagcggaacctcaccatcatggacctgcacccgggcagcggcaagacccgccggtacctgcccgcgatcgtccgcgaggccatcaagcggaagctccgcacgctgatcctggcccccacccgggtggtggcctccgagatggcggaggccctcaaggggatgcccatccgctaccagaccaccgccgtcaagagcgagcacacgggccgcgagatcgtggacctgatgtgccacgccaccttcaccatgcggctgctctccccggtgcgcgtccccaactacaacatgatcatcatggacgaggcccacttcaccgaccccgcgagcatcgccgcccgggggtacatctccacgcgcgtgggcatgggggaggccgccgcgatcttcatgaccgccacgccgcccggcagcgtggaggccttcccccagtccaacgccgtcatccaggacgaggagcgggacatccccgagcgcagctggaactccggctacgactggatcaccgacttccccgggaagacggtgtggttcgtgcccagcatcaagtccggcaacgacatcgccaactgcctgcggaagaacgggaagcgcgtcatccagctgagccggaagaccttcgacaccgagtaccagaagaccaagaacaacgactgggactacgtggtgacgaccgacatctccgagatgggcgcgaacttccgcgccgaccgggtcatcgacccccgccggtgcctcaagcccgtgatcctgaaggacgggcccgagcgcgtgatcctggccggcccgatgcccgtcaccgtggccagcgcggcccagcggcgcggccggatcgggcgcaaccagaacaaggagggcgaccagtacgtctacatggggcagcccctcaacaacgacgaggaccacgcccactggaccgaggccaagatgctgctggacaacatcaacacgcccgagggcatcatcccggccctcttcgagcccgagcgggagaagtccgcggccatcgacggggagtaccgcctgcgcggcgaggcccggaagaccttcgtggagctgatgcgccggggcgacctccccgtgtggctgagctacaaggtcgcctccgaggggttccagtacagcgaccgccggtggtgcttcgacggcgagcgcaacaaccaggtgctggaggagaacatggacgtggagatctggaccaaggagggggagcggaagaagctccgcccccggtggctggacgcccgcacctactccgacccgctggcgctccgggagttcaaggagttcgccgccggccgccggagcgtcagcggcgacctgatcctggagatcgggaagctcccccagcacctgaccctgcgcgcccagaacgccctcgacaacctggtgatgctgcacaactccgagcagggcgggaaggcgtaccggcacgccatggaggagctccccgacacgatcgagaccctgatgctgctcgccctgatcgccgtgctgaccggcggggtcaccctcttcttcctgagcggcaagggcctggggaagacgtccatcggcctcctgtgcgtgaccgcgagctccgccctgctctggatggccagcgtggagccccactggatcgccgcctccatcatcctggagttcttcctgatggtcctcctgatcccggagcccgaccgccagcggacgccccaggacaaccagctggcgtacgtggtgatcgggctcctgttcatgatcctgaccgtcgccgccaacgagatgggcctcctggagacgaccaagaaggacctggggatcggccacgtggccgccgagaaccaccagcacgcgaccatgctcgacgtggacctgcgcccggccagcgcctggaccctgtacgccgtcgccacgaccgtgatcacccccatgatgcggcacaccatcgagaacacgaccgcgaacatctccctcaccgccatcgccaaccaggccgccatcctgatgggcctggacaaggggtggcccatcagcaagatggacatcggcgtgcccctcctggcgctggggtgctactcccaggtcaacccgctcaccctgacggccgccgtgctgatgctcgtggcccactacgcgatcatcggccccgggctgcaggccaaggccacccgcgaggcccagaagcggaccgccgcgggcatcatgaagaaccccaccgtcgacggcatcgtggccatcgacctggaccccgtggtctacgacgccaagttcgagaagcagctcgggcagatcatgctgctgatcctctgcacgagccagatcctgctgatgcgcaccacctgggccctctgcgagtccatcaccctggccacgggcccgctgaccaccctctgggaggggagccccggcaagttctggaacaccacgatcgcggtgtccatggccaacatcttccgcggcagctacctggccggggccggcctggccttctccctcatgaagtccctcgggggcgggcggcgcgggaccggcgcgcagggggagaccctgggcgagaagtggaagcggcagctcaaccagctgtccaagagcgagttcaacacctacaagcgcagcgggatcatggaggtggaccggtccgaggccaaggagggcctgaagcgcggggagacgaccaagcacgccgtcagccggggcaccgccaagctccgctggttcgtggagcggaacctggtgaagcccgagggcaaggtcatcgacctggggtgcggccgcgggggctggtcctactactgcgcggggctgaagaaggtgaccgaggtgaagggctacaccaagggcgggcccggccacgaggagccgatccccatggccacgtacgggtggaacctcgtcaagctgcacagcggcaaggacgtgttcttcatgccgcccgagaagtgcgacaccctgctctgcgacatcggggagtccagcccgaaccccaccatcgaggagggccggaccctgcgcgtgctgaagatggtcgagccctggctccggggcaaccagttctgcatcaagatcctgaacccctacatgccgtccgtggtggagacgctggagcagatgcagcgcaagcacgggggcatgctcgtccggaaccccctgagccgcaactccacccacgagatgtactgggtgagctgcgggaccggcaacatcgtgtccgccgtcaacatgaccagccggatgctgctcaaccgcttcacgatggcccaccggaagcccacctacgagcgcgacgtggacctgggcgccgggacccgccacgtggcggtcgagcccgaggtggccaacctggacatcatcggccagcggatcgagaacatcaagaacgagcacaagtccacctggcactacgacgaggacaacccgtacaagacgtgggcctaccacgggagctacgaggtgaagccctccggcagcgcctccagcatggtcaacggggtggtccgcctcctgaccaagccctgggacgtgatccccatggtgacccagatcgccatgaccgacacgaccccgttcggccagcagcgggtcttcaaggagaaggtggacacccgcacgccccgggcgaagcgcggcacggcccagatcatggaggtgaccgccaagtggctgtgggggttcctctcccggaacaagaagccccgcatctgcacccgggaggagttcacccgcaaggtccggagcaacgccgccatcggcgcggtgttcgtggacgagaaccagtggaacagcgccaaggaggccgtcgaggacgagcgcttctgggacctggtgcaccgggagcgcgagctgcacaagcaggggaagtgcgccacgtgcgtgtacaacatgatgggcaagcgggagaagaagctcggggagttcggcaaggcgaagggctcccgcgccatctggtacatgtggctgggggcccggttcctggagttcgaggccctcggcttcatgaacgaggaccactggttcagccgcgagaactccctgagcggggtcgagggcgaggggctgcacaagctcggctacatcctgcgggacatctccaagatcccgggcgggaacatgtacgccgacgacaccgcgggctgggacacccgcatcaccgaggacgacctgcagaacgaggccaagatcacggacatcatggagcccgagcacgccctcctggccaccagcatcttcaagctgacctaccagaacaaggtggtgcgggtccagcgccccgccaagaacgggaccgtgatggacgtgatctcccgccgggaccagcgcggcagcggccaggtcgggacgtacggcctcaacaccttcaccaacatggaggtgcagctgatccggcagatggagtccgaggggatcttcctgcccagcgagctcgagaccccgaacctggcggagcgcgtgctggactggctcgagaagcacggcgccgagcggctgaagcgcatggccatctccggggacgactgcgtcgtgaagcccatcgacgaccggttcgccacggccctgatcgcgctcaacgacatgggcaaggtgcgcaaggacatcccccagtgggagcccagcaagggctggaacgactggcagcaggtcccgttctgctcccaccacttccaccagctgatcatgaaggacgggcgggagatcgtggtgccctgccgcaaccaggacgagctggtcggccgggcccgcgtgagccagggggccggctggtccctccgggagaccgcctgcctgggcaagagctacgcccagatgtggcagctgatgtacttccaccgccgggacctccgcctggcggccaacgccatctgctccgccgtgcccgtcgactgggtgcccaccagccggaccacctggagcatccacgcgcaccaccagtggatgacgaccgaggacatgctgtccgtgtggaaccgcgtctggatcgaggagaacccgtggatggaggacaagacccacgtgagctcctgggaggaggtgccctacctcggcaagcgggaggaccagtggtgcggcagcctgatcgggctgaccgcccgcgccacgtgggccaccaacatccaggtcgccatcaaccaggtgcgccggctcatcggcaacgagaactacctggactacatgacctccatgaagcgcttcaagaacgagagcgaccccgagggggcgctgtgg

SEQ ID NO: 8971 - RNA, 9876 nt, synthetic construct
  misc_feature 1..9876: note = derived and/or modified CDS sequence (opt1) from DENV-1__KF672762__SS-prME
  source 1..9876: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggaagcagatccagaaggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccgcaagctgtgcatcgaggccaagatcagcaacaccaccacggactcccggtgcccgacccagggcgaggccaccctggtggaggagcaggacgccaacttcgtctgccgccggaccttcgtggaccgcggctgggggaacggctgcggcctgttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccgccaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtcatgtgcaccgggagcttcaagctggagaaggaggtggcggagacgcagcacggcaccgtgctggtccaggtgaagtacgagggcatcgacgccccctgcaagatccccttctccacccaggacgagaagggggtgacccagaacggccgcctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccgccggatggccatcctcggcgacacggcgtgggacttcgggagcatcggcggcgtgttcacctccgtggggaagctggtccaccaggtgctgggcaccgcctacggggtcctgttcagcggcgtctcctggaccatgaagatcgggatcggcatcctgctgacgtggctcggcctgaacagccgctccaccagcctgtccatgacctgcatcgccgtggggatggtgaccctctacctgggcgtcatggtgcaggccgacagcgggtgcgtgatcaactggaagggccgcgagctgaagtgcgggtccggcatcttcgtcacgaacgaggtgcacacctggaccgagcagtacaagttccaggccgacagcccgaagcggctcagcgcggccatcggcaaggcctgggaggagggggtgtgcggcatccgctccgccacccggctggagaacatcatgtggaagcagatcagcaacgagctgaaccacatcctcctggagaacgacatgaagttcaccgtcgtggtgggggacgccaacggcatcctggcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacgagcagcgggcctggaacatctgggaggtcgaggactacggcttcgggatcttcaccacgaacatctggctcaagctgcgcgactcctacacccagatgtgcgaccaccggctgatgagcgcggccatcaaggactccaaggccgtgcacgccgacatgggctactggatcgagagcgagaagaacgagacctggaagctcgcccgcgcgtccttcatcgaggtgaagacctgcatctggcccaagagccacacgctgtggtccaacggcgtcctggagagcgagatgatcatccccaagatctacgggggcccgatctcccagcacaactaccggcccgggtacttcacccagaccgccggcccctggcacctcgggaagctggagctggacttcgacctctgcgagggcaccacggtggtggtcgacgagcactgcggcaaccgcgggccgagcctgcggaccaccaccgtgacgggcaagatcatccacgagtggtgctgccgctcctgcaccctgccgcccctccggttccgcggggaggacggctgctggtacgggatggagatccggcccgtgaaggagaaggaggagaacctggtccgcagcatggtgtccgccggcagcggcgaggtggacagcttctccctggggatcctctgcgtcagcatcatgatcgaggaggtgatgcggtcccgctggagccggaagatgctgatgaccggcaccctggccgtgttcctcctgctgatcatggggcagctcacgtggaacgacctgatccgcctgtgcatcatggtcggcgccaacgcgtccgacaagatggggatgggcaccacctacctcgccctgatggccaccttcaagatgcgcccgatgttcgccgtggggctcctcttccggcgcctgacgagccgggaggtgctgctcctgaccatcgggctgtccctcgtcgccagcgtggagctgcccaactccctggaggagctcggcgacgggctggcgatgggcatcatgatgctgaagctcctgaccgagttccagccccaccagctgtggaccacgctcctgagcctgaccttcatcaagaccaccctctccctggactacgcctggaagacgaccgccatggtcctgagcatcgtgtccctcttccccctgtgcctgagcaccacctcccagaagacgacctggctcccggtgctgctgggcagcttcgggtgcaagcccctcaccatgttcctgatcaccgagaacaagatctggggccgcaagtcctggcccctgaacgaggggatcatggccatcggcatcgtcagcatcctcctgtccagcctgctcaagaacgacgtgcccctggcggggccgctgatcgccggcggcatgctcatcgcctgctacgtgatcagcgggtccagcgccgacctgtccctggagaaggccgcggaggtcagctgggaggaggaggccgagcactccggcaccagccacaacatcctcgtggaggtgcaggacgacgggacgatgaagatcaaggacgaggagcgggacgacaccctgaccatcctgctcaaggccaccctgctggccgtctccggcgtgtaccccatgagcatccccgccaccctcttcgtgtggtacttctggcagaagaagaagcagcgctccggggtcctgtgggacacccccagcccgcccgaggtggagcgggcggtgctggacgacggcatctaccgcatcctgcagcggggcctcctggggcgctcccaggtcggcgtgggggtgttccaggacggcgtcttccacaccatgtggcacgtgacccgcggggccgtgctgatgtaccagggcaagcgcctcgagcccagctgggcctccgtcaagaaggacctgatcagctacggcgggggctggcggttccaggggtcctggaacacgggcgaggaggtccaggtgatcgccgtcgagcccgggaagaacccgaagaacgtgcagaccacccccggcaccttcaagacgcccgagggcgaggtgggggccatcgcgctggacttcaagcccggcaccagcgggtccccgatcgtcaaccgcgagggcaagatcgtgggcctctacgggaacggcgtggtcaccaccagcgggacgtacgtgtccgccatcgcccaggccaaggccagccaggagggccccctgcccgagatcgaggacgaggtgttcaagaagcggaacctgaccatcatggacctccacccggggagcggcaagacccgccggtacctgcccgcgatcgtccgcgaggccatcaagcggaagctgcgcaccctcatcctggcccccacgcgggtggtggcctccgagatggcggaggccctgaagggcatgcccatccgctaccagaccaccgccgtcaagagcgagcacaccgggcgcgagatcgtggacctcatgtgccacgccacgttcaccatgcggctgctgtccccggtgcgcgtccccaactacaacatgatcatcatggacgaggcccacttcaccgaccccgcgagcatcgccgcccggggctacatctccacccgcgtggggatgggcgaggccgccgcgatcttcatgacggccacgccgcccgggagcgtggaggccttcccccagtccaacgccgtcatccaggacgaggagcgggacatccccgagcgcagctggaactccggctacgactggatcaccgacttccccggccggaccgtgtggttcgtgcccagcatcaagtccgggaacgacatcgccaactgcctccgcaagaacggcaagcgggtcatccagctgagccgcaagacgttcgacaccgagtaccagaagaccaagaacaacgactgggactacgtggtgaccacggacatctccgagatgggggcgaacttccgggccgaccgcgtcatcgacccccggcgctgcctgaagcccgtgatcctcaaggacggccccgagcgggtgatcctggccgggccgatgcccgtcaccgtggccagcgcggcccagcgccggggccgcatcggccggaaccagaacaaggagggggaccagtacgtctacatgggccagcccctgaacaacgacgaggaccacgcccactggaccgaggccaagatgctcctggacaacatcaacacccccgaggggatcatcccggccctgttcgagcccgagcgcgagaagtccgcggccatcgacggcgagtaccgcctccgcggggaggcccgcaagacgttcgtggagctgatgcggcgcggcgacctgcccgtgtggctcagctacaaggtcgcctccgagggcttccagtacagcgaccggcgctggtgcttcgacggggagcggaacaaccaggtgctggaggagaacatggacgtggagatctggaccaaggagggcgagcgcaagaagctgcggccccgctggctcgacgcccggacctactccgacccgctggcgctgcgcgagttcaaggagttcgccgccgggcggcgcagcgtcagcggcgacctcatcctggagatcggcaagctgccccagcacctcaccctgcgggcccagaacgccctggacaacctcgtgatgctgcacaactccgagcagggcgggaaggcgtaccgccacgccatggaggagctgcccgacaccatcgagacgctcatgctgctggccctcatcgccgtgctgaccgggggcgtcaccctgttcttcctcagcgggaagggcctgggcaagacctccatcgggctgctctgcgtgacggcgagctccgccctgctgtggatggccagcgtggagccccactggatcgccgcctccatcatcctcgagttcttcctgatggtcctgctcatcccggagcccgaccggcagcgcacgccccaggacaaccagctggcgtacgtggtgatcggcctcctcttcatgatcctgaccgtcgccgccaacgagatggggctgctcgagaccacgaagaaggacctgggcatcgggcacgtggccgccgagaaccaccagcacgcgaccatgctggacgtggacctccggccggccagcgcctggaccctgtacgccgtcgccaccacggtgatcacccccatgatgcgccacaccatcgagaacaccacggcgaacatctccctgaccgccatcgccaaccaggccgccatcctcatgggcctggacaagggctggcccatcagcaagatggacatcggggtgcccctgctcgcgctgggctgctactcccaggtcaacccgctgaccctcaccgccgccgtgctgatgctggtggcccactacgcgatcatcgggcccggcctccaggccaaggccacgcgggaggcccagaagcgcaccgccgcggggatcatgaagaaccccaccgtcgacggcatcgtggccatcgacctggaccccgtggtctacgacgccaagttcgagaagcagctgggccagatcatgctcctgatcctgtgcaccagccagatcctcctgatgcgcacgacctgggccctgtgcgagtccatcaccctcgccaccgggccgctgacgaccctgtgggagggcagccccgggaagttctggaacaccaccatcgcggtgtccatggccaacatcttccggggcagctacctcgccggcgccgggctggccttctccctgatgaagtccctcggcgggggccgccgggggacgggcgcgcagggcgagaccctgggggagaagtggaagcgccagctgaaccagctctccaagagcgagttcaacacctacaagcggagcggcatcatggaggtggaccgctccgaggccaaggaggggctgaagcggggcgagaccacgaagcacgccgtcagccgcgggaccgccaagctgcggtggttcgtggagcgcaacctggtgaagcccgagggcaaggtcatcgacctcggctgcgggcggggcgggtggtcctactactgcgcgggcctgaagaaggtgaccgaggtgaaggggtacaccaagggcggccccgggcacgaggagccgatccccatggccacctacggctggaacctggtcaagctccacagcgggaaggacgtgttcttcatgccgcccgagaagtgcgacacgctgctgtgcgacatcggcgagtccagcccgaaccccaccatcgaggaggggcgcaccctccgggtgctgaagatggtcgagccctggctgcgcggcaaccagttctgcatcaagatcctcaacccctacatgccgtccgtggtggagaccctggagcagatgcagcggaagcacggcgggatgctggtccgcaaccccctcagccggaactccacgcacgagatgtactgggtgagctgcggcaccgggaacatcgtgtccgccgtcaacatgaccagccgcatgctgctgaaccggttcaccatggcccaccgcaagcccacgtacgagcgcgacgtggacctcggcgccggcacccggcacgtggcggtcgagcccgaggtggccaacctggacatcatcgggcagcgcatcgagaacatcaagaacgagcacaagtccacctggcactacgacgaggacaacccgtacaagacctgggcctaccacggcagctacgaggtgaagccctccgggagcgcctccagcatggtcaacggcgtggtccggctgctcacgaagccctgggacgtgatccccatggtgacccagatcgccatgaccgacaccacgccgttcgggcagcagcgcgtcttcaaggagaaggtggacacccggacgccccgggcgaagcggggcaccgcccagatcatggaggtgacggccaagtggctgtggggcttcctgtcccgcaacaagaagccccggatctgcacccgcgaggagttcacccggaaggtccgcagcaacgccgccatcggggcggtgttcgtggacgagaaccagtggaacagcgccaaggaggccgtcgaggacgagcggttctgggacctcgtgcaccgcgagcgggagctgcacaagcagggcaagtgcgcgacctgcgtgtacaacatgatggggaagcgcgagaagaagctgggcgagttcgggaaggcgaagggctcccgggccatctggtacatgtggctcggcgcccgcttcctggagttcgaggccctggggttcatgaacgaggaccactggttcagccgggagaactccctcagcggcgtcgagggggagggcctgcacaagctggggtacatcctccgcgacatctccaagatcccgggcggcaacatgtacgccgacgacacggcggggtgggacacccggatcaccgaggacgacctgcagaacgaggccaagatcaccgacatcatggagcccgagcacgccctgctcgccacgagcatcttcaagctgacctaccagaacaaggtggtgcgcgtccagcgccccgccaagaacggcaccgtgatggacgtgatctcccggcgcgaccagcgggggagcggccaggtcggcacctacgggctgaacacgttcaccaacatggaggtgcagctcatccgccagatggagtccgagggcatcttcctgcccagcgagctggagaccccgaacctcgcggagcgggtgctggactggctggagaagcacggggccgagcgcctcaagcggatggccatctccggcgacgactgcgtcgtgaagcccatcgacgaccgcttcgccaccgccctgatcgcgctgaacgacatggggaaggtgcggaaggacatcccccagtgggagcccagcaagggctggaacgactggcagcaggtcccgttctgctcccaccacttccaccagctcatcatgaaggacggccgcgagatcgtggtgccctgccggaaccaggacgagctggtcgggcgcgcccgggtgagccagggcgccgggtggtccctgcgcgagacggcctgcctcggcaagagctacgcccagatgtggcagctgatgtacttccaccggcgcgacctgcggctcgcggccaacgccatctgctccgccgtgcccatcgactgggtccccaccagccgcaccacctggagcatccacgcgcaccaccagtggatgaccacggaggacatgctgtccgtgtggaaccgggtgtggatcgaggagaacccgtggatggaggacaaggcccacgtcagctcctgggaggaggtgccctacctggggaagcgcgaggaccagtggtgcggcagcctcatcggcctgaccgcccgcgccacctgggccaccaacatccaggtggcgatcaaccaggtccggcgcctgatcgggaacgagaactacctcgactacatgacgtccatgaagcggttcaagaacgagagcgaccccgagggcgccctgtgg

SEQ ID NO: 8972 - RNA, 9879 nt, synthetic construct
  misc_feature 1..9879: note = derived and/or modified CDS sequence (opt1) from DENV-1__JF459993__SS-prME
  source 1..9879: mol_type = other RNA
agcgtgaccatgctgttcatgctcctgcccaccagcctggccttccacctcaccacccggggcggggagccccacatgatcgtgagcaagcaggagcggggcaagtccctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggagacctgggtgacctacgggacctgctcccagacgggcgagcaccggcgcgacaagcggagcgtggccctcgcgccccacgtgggcctggggctggagacccgcaccgagacctggatgtccagcgagggcgcctggaagcagatccagaaggtggagacgtgggcgctcgggcaccccggcttcaccgtgatcgccctgttcctggcccacgccatcgggacctccatcacccagaagggcatcatcttcatcctcctgatgctggtgacgcccagcatggcgatgcggtgcgtcggcatcgggaaccgcgacttcgtggagggcctctccggggccacctgggtggacgtcgtgctggagcacggcagctgcgtgaccaccatggccaaggacaagcccacgctggacatcgagctcctgaagaccgaggtcaccaaccccgccatcctgcggaagctctgcatcgaggccaagatctccaacaccacgaccgacagccgctgcccgacccagggcgaggcgaccctggtggaggagcaggacacgaacttcgtgtgccggcgcaccttcgtcgaccgggggtggggcaacgggtgcggcctgttcgggaagggctccctcatcacgtgcgccaagttcaagtgcgtgaccaagctggagggcaagatcgtgcagtacgagaacctgaagtacagcgtcatcgtgacggtgcacaccggggaccagcaccaggtcggcaacgagaccaccgagcacgggaccacggccaccatcacgccccaggcccccacctccgagatccagctcacggactacggcgccctgaccctggactgcagcccccgcaccgggctcgacttcaacgagatggtgctgctgaccatgaaggagaagtcctggctcgtccacaagcagtggttcctggacctgcccctcccctggacgagcggcgcgagcacctcccaggagacctggaaccggcaggacctgctggtgaccttcaagacggcccacgccaagaagcaggaggtggtcgtgctcggcagccaggagggggccatgcacaccgccctgaccggcgcgaccgagatccagacgtccgggaccaccaccatcttcgccggccacctgaagtgccgcctcaagatggacaagctgacgctgaagggggtgagctacgtcatgtgcaccggctccttcaagctcgagaaggaggtggccgagacccagcacggcaccgtgctggtccaggtgaagtacgaggggacggacgccccctgcaagatccccttcagctcccaggacgagaagggcgtgatccagaacgggcggctgatcaccgccaacccgatcgtcaccgacaaggagaagcccgtgaacatcgaggcggagccgcccttcggcgagagctacatcgtggtcggcgccggggagaaggccctgaagctctcctggttcaagaagggcagctccatcgggaagatgttcgaggccaccgcgcgcggcgcccggcgcatggccatcctgggggacacggcctgggacttcggcagcatcggcggggtgttcacctccgtgggcaagctggtccaccagatcttcgggaccgcctacggcgtcctgttcagcggggtgtcctggaccatgaagatcggcatcggcatcctgctgacgtggctcgggctgaacagccggtccaccagcctgtccatgacctgcatcgcggtcggcatggtgaccctctacctgggggtgatggtccaggccgacagcggctgcgtgatcaactggaaggggcgcgagctgaagtgcggcagcggcatcttcgtgacgaacgaggtccacacctggaccgagcagtacaagttccaggccgactccccgaagcgcctcagcgccgccatcgggaaggcgtgggaggagggcgtgtgcgggatccggtccgccacccgcctggagaacatcatgtggaagcagatcagcaacgagctgaaccacatcctcctggagaacgacatgaagttcaccgtggtcgtgggcgacgtggccgggatcctggcccagggcaagaagatgatccggccccagcccatggagtacaagtactcctggaagtcctggggcaaggccaagatcatcggggcggacgtccagaacgccacgttcatcatcgacggccccaacaccccggagtgccccgacgaccagcgcgcctggaacatctgggaggtggaggactacgggttcggcatcttcaccaccaacatctggctcaagctgcgggactcctacacccaggtgtgcgaccaccgcctgatgagcgccgcgatcaaggactccaaggccgtccacgccgacatgggctactggatcgagagcgagaagaacgagacctggaagctcgcccgggcctccttcatcgaggtgaagacctgcgtgtggcccaagagccacaccctgtggtccaacggggtcctggagagcgagatgatcatccccaagatctacggcgggccgatctcccagcacaaccaccgccccggctacttcacgcagaccgcggggccctggcacctcggcaagctggagctggacttcgacctctgcgagggcaccaccgtggtggtcgacgagcactgcgggaaccggggcccgagcctgcgcacgaccaccgtgaccgggaagatcatccacgagtggtgctgccggtcctgcacgctgccgcccctccgcttccggggcgaggacgggtgctggtacggcatggagatccgccccgtgaaggagaaggaggagaacctggtcaagagcatggtgagcgccggctccggggaggtggacagcttctccctgggcctcctgtgcatcagcatcatgatcgaggaggtcatgcggtcccgctggagccggaagatgctgatgaccgggaccctcgccgtgttcttcctgctgatcatgggccagctcacctggaacgacctgatccgcctgtgcatcatggtgggggccaacgcctccgaccggatgggcatgggcacgacctacctcgcgctgatggccaccttcaagatgcgcccgatgttcgccgtcgggctcctcttccgccggctgaccagccgcgaggtgctgctcctgacgatcggcctgtccctcgtcgccagcgtggagctgcccaactccctggaggagctcggggacggcctggccatgggcatcatgatcctgaagctcctgaccgacttccagagccaccagctgtgggcgaccctcctgtccctgaccttcatcaagacgaccttcagcctccactacgcctggaagaccatggccatggtgctgtccatcgtcagcctgttccccctctgcctgtccaccacgagccagaagaccacctggctgcccgtgctcctggggtccctgggctgcaagccgctcaccatgttcctgatcgccgagaacaagatctgggggcgcaagagctggcccctgaacgagggcatcatggcggtggggatcgtcagcatcctcctgtccagcctgctcaagaacgacgtgcccctggccggccccctgatcgccggcgggatgctcatcgcctgctacgtgatctccggcagctccgccgacctgagcctggagaaggcggccgaggtctcctgggaggaggaggccgagcacagcggggcctcccacaacatcctcgtggaggtgcaggacgacggcacgatgaagatcaaggacgaggagcgcgacgacaccctgaccatcctgctcaaggccaccctgctggcggtcagcggggtgtacccgctctccatccccgccaccctgttcgtgtggtacttctggcagaagaagaagcagcggagcggcgtcctgtgggacacgcccagcccgcccgaggtggagcgcgccgtgctcgacgacggcatctaccggatcatgcagcgcgggctgctgggccggagccaggtcggggtgggcgtgttccaggagaacgtcttccacaccatgtggcacgtgacccgcggggccgtgctgatgtaccagggcaagcggctcgagccctcctgggccagcgtcaagaaggacctgatctcctacggcgggggctggcgcctgcaggggagctggaacaccggcgaggaggtccaggtgatcgcggtcgagcccgggaagaaccccaagaacgtgcagacggcccccggcaccttcaagacccccgagggcgaggtgggggccatcgccctcgacttcaagcccggcacctccgggagccccatcgtcaaccgggagggcaagatcgtgggcctgtacgggaacggcgtggtcacgaccagcgggacctacgtgtccgccatcgcgcaggccaaggccagccaggagggcccgctgcccgagatcgaggacgaggtgttccgcaagcggaacctcaccatcatggacctgcaccccgggtccggcaagacgcgccggtacctgccggccatcgtccgcgaggcgatcaagcggaagctccgcaccctgatcctggcccccacccgggtggtggccagcgagatggccgaggccctcaagggcatgcccatccgctaccagaccacggcggtcaagtccgagcacaccgggaaggagatcgtggacctgatgtgccacgccaccttcaccatgcgcctgctcagccccgtgcgggtcccgaactacaacatgatcatcatggacgaggcccacttcacggacccctccagcatcgccgcccgcggctacatctccacccgggtggggatgggcgaggcggccgccatcttcatgaccgccacgccgcccgggagcgtggaggccttcccgcagtccaacgcggtcatccaggacgaggagcgcgacatccccgagcggagctggaactccggctacgagtggatcacggacttccccggcaagaccgtgtggttcgtgcccagcatcaagtccgggaacgacatcgccaactgcctgcgcaagaacggcaagcgggtcatccagctgagccgcaagaccttcgacaccgagtaccagaagacgaagaacaacgactgggactacgtggtgaccaccgacatctccgagatgggggccaacttccgggccgaccgcgtcatcgacccgcggcgctgcctcaagcccgtgatcctgaaggacggccccgagcgggtcatcctggcggggcccatgccggtgaccgtggccagcgccgcccagcgccggggccgcatcggccggaaccacaacaaggagggggaccagtacatctacatgggccagcccctcaacaacgacgaggaccacgcccactggacggaggcgaagatgctgctggacaacatcaacacccccgaggggatcatccccgccctcttcgagccggagcgcgagaagtccgccgccatcgacggcgagtaccggctgcgcggggaggcccgcaagaccttcgtcgagctgatgcggcgcggcgacctccccgtgtggctgagctacaaggtggcgagcgagggcttccagtactccgaccggcgctggtgcttcgacggggagcggaacaaccaggtcctggaggagaacatggacgtggagatctggaccaaggagggcgagcgcaagaagctccggccccgctggctggacgcccggacgtacagcgaccccctggccctccgcgagttcaaggagttcgccgccgggcggcgctccgtgagcggcgacctgatcctggagatcggcaagctcccgcagcacctgacccagcgggcgcagaacgccctggacaacctcgtcatgctgcacaactccgagcagggcgggcgcgcctaccggcacgccctggaggagctccccgacaccatcgagaccctgatgctgctcgcgctgatcgccgtgctgaccgggggcgtgaccctcttcttcctgagcgggcgcggcctgggcaagacctccatcgggctcctgtgcgtcatggccagctccgccctgctctggatggccagcgtggagccccactggatcgcggcctccatcatcctggagttcttcctgatggtgctcctgatccccgagccggaccggcagcgcacgccccaggacaaccagctggcctacgtcgtgatcggcctcctgttcatgatcctgaccgtggccgccaacgagatggggctcctggagacgaccaagaaggacctgggcatcgggcacgtcgcggtggagaaccaccaccacgccagcatgctcgacgtggacctgcaccccgcctccgcctggaccctgtacgccgtcgcgaccacgatcatcaccccgatgatgcggcacaccatcgagaacaccacggccaacatcagcctcaccgccatcgccaaccaggccgcgatcctgatgggcctggacaagggctggcccatctccaagatggacatcggggtgcccctcctggccctgggctgctacagccaggtgaaccccctcaccctgaccgccgccgtcctgatgctcgtggcgcactacgccatcatcgggccgggcctgcaggccaaggccacgcgcgaggcccagaagcggaccgcggccgggatcatgaagaaccccaccgtggacggcatcgtcgccatcgacctggaccccgtggtgtacgacgccaagttcgagaagcagctcggccagatcatgctgctgatcctctgcacctcccagatcctgctgatgcgcacgacctgggccctctgcgagagcatcaccctggcgaccgggcccctgacgaccctctgggagggctccccggggaagttctggaacaccaccatcgccgtcagcatggccaacatcttccgcggcagctacctggccggcgccgggctggcgttctccctcatgaagtccctgggcgggggccggcgcgggacgggcgcccagggcgagaccctgggggagaagtggaagcggcagctcaaccagctgtccaagagcgagttcaacacctacaagcgctccggcatcatggaggtggaccggagcgaggccaaggaggggctgaagcgcggcgagaccacgaagcacgccgtgtcccgggggaccgcgaagctccgctggttcgtcgagcggaacctggtgaagcccgagggcaaggtgatcgacctgggctgcgggcgcggcgggtggagctactactgcgccggcctgaagaaggtcaccgaggtgaaggggtacaccaagggcggccccgggcacgaggagcccatcccgatggccacgtacggctggaacctcgtgaagctgcactccgggaaggacgtcttcttcatcccgcccgagaagtgcgacaccctgctctgcgacatcggcgagagctcccccaacccgaccatcgaggaggggcggaccctgcgcgtgctgaagatggtggagccctggctccggggcaaccagttctgcatcaagatcctgaacccctacatgcccagcgtcgtggagacgctggagcagatgcagcgcaagcacggcgggatgctcgtgcggaacccgctgtcccgcaacagcacccacgagatgtactgggtctcctgcggcaccgggaacatcgtgagcgccgtgaacatgacctcccggatgctgctcaaccgcttcaccatggcccaccggaagcccacgtacgagcgcgacgtcgacctgggcgcgggcacccgccacgtggccgtggagcccgaggtcgccaacctggacatcatcgggcagcggatcgagaacatcaagcacgagcacaagagcacctggcactacgacgaggacaacccctacaagacctgggcctaccacggctcctacgaggtgaagccgagcgggagcgcctccagcatggtcaacggcgtggtgaagctcctgacgaagccctgggacgtcatccccatggtgacccagatcgcgatgaccgacaccacgcccttcgggcagcagcgcgtgttcaaggagaaggtcgacacccggaccccgaaggccaagcgcggcaccgcccagatcatggaggtgacggcccggtggctgtggggcttcctctcccgcaacaagaagccccggatctgcacccgcgaggagttcacccggaaggtgcgcagcaacgccgcgatcggggccgtcttcgtggacgagaaccagtggaactccgccaaggaggccgtggaggacgagcggttctgggacctggtccaccgcgagcgggagctgcacaagcagggcaagtgcgcgacctgcgtgtacaacatgatggggaagcgcgagaagaagctcggcgagttcgggaaggccaagggcagccgggccatctggtacatgtggctgggcgcccgcttcctggagttcgaggccctcgggttcatgaacgaggaccactggttctcccgggagaacagcctgtccggcgtggagggggagggcctgcacaagctcgggtacatcctgcgcgacatcagcaagatccccggcggcaacatgtacgcggacgacacggccgggtgggacacccggatcaccgaggacgacctgcagaacgaggccaagatcaccgacatcatggagccggagcacgccctcctggccaagtccatcttcaagctgacgtaccagaacaaggtcgtgcgcgtgcagcggcccgcgaagaacggcaccgtcatggacgtgatcagccgccgcgaccagcgggggtccggccaggtgggcacctacgggctcaacaccttcacgaacatggaggcccagctgatccgccagatggagagcgaggagatcttctcccccagcgagctggagacccccaacctcgccgagcgggtcctggactggctggagaagtacggcgtggagcgcctcaagcggatggccatctccggggacgactgcgtggtcaagccgatcgacgaccgcttcgccaccgcgctgaccgccctgaacgacatgggcaaggtgcggaaggacatcccccagtgggagcccagcaaggggtggaacgactggcagcaggtccccttctgcagccaccacttccaccagctcatcatgaaggacggccgcgaggtcgtggtgccgtgccggaaccaggacgagctggtcggccgcgcccgggtgtcccagggggccggctggagcctgcgcgagacggcctgcctcgggaagtcctacgcgcagatgtggcagctgatgtacttccaccggcgcgacctgcggctcgccgccaacgccatctgcagcgcggtgcccgtcgactgggtgcccacctcccgcaccacctggagcatccacgcccaccaccagtggatgacgaccgaggacatgctgtccgtgtggaaccgggtctggatcgaggagaacccctggatggaggacaagacccacgtgagctcctgggaggacgtgccgtacctgggcaagcgcgaggaccagtggtgcgggagcctcatcggcctgaccgcccgggccacgtgggccaccaacatccaggtcgcgatcaaccaggtgcgccgcctgatcggcaacgagaactacctcgactacatgacctccatgaagcggttcaagaacgagagcgaccccgagggggccctgtggtga

SEQ ID NO: 8973 - RNA, 9876 nt, synthetic construct
  misc_feature 1..9876: note = derived and/or modified CDS sequence (opt1) from DENV-1__KF672763__SS-prME
  source 1..9876: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgggacaagcggtccgtggccctggcgccccacgtgggcctggggctcgagacccggaccgagacctggatgagctccgagggcgcctggaagcagatccagaaggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccgcaagctgtgcatcgaggccaagatcagcaacaccaccacggactcccggtgcccgacccagggcgaggccaccctggtggaggagcaggacgccaacttcgtctgccgccggaccttcgtggaccgcggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccgccaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtcatgtgcaccgggagcttcaagctggagaaggaggtggcggagacgcagcacggcaccgtgctggtccaggtgaagtacgagggcaccgacgccccctgcaagatccccttctccacccaggacgagaagggggtgacgcagaacggccgcctcatcaccgccaacccgatcgtcaccgacaaggagaagcccgtgaacatcgagaccgagccgcccttcggggagagctacatcgtggtcggcgtgggcgagaaggccctgaagctgtcctggttcaagaaggggagctccatcggcaagatgttcgaggcgacggcccgcggggcccgccggatggccatcctcggcgacaccgcctgggacttcgggagcatcggcggcgtgttcacctccgtcgggaagctggtgcaccaggtgttcggcaccgcgtacggggtcctgttcagcggcgtgtcctggacgatgaagatcgggatcggcatcctcctgacctggctgggcctcaacagccgctccaccagcctgtccatgacctgcatcgccgtggggatggtcacgctgtacctcggcgtgatggtgcaggccgacagcgggtgcgtcatcaactggaagggccgcgagctgaagtgcgggtccggcatcttcgtgaccaacgaggtgcacacctggaccgagcagtacaagttccaggccgacagcccgaagcggctgagcgccgcgatcggccgcgcctgggaggagggggtctgcggcatccggtccgccacccgcctcgagaacatcatgtggaagcagatcagcaacgagctgaaccacatcctgctcgagaacgacatcaagttcacggtggtggtcgggaacgccgacggcatcctggcccaggggaagaagatgatccggccccagcccatggagcacaagtactcctggaagtcctggggcaaggcgaagatcatcggcgccgacatccagaacaccaccttcatcatcgacgggcccgacaccccggagtgccccgacgagcagcgcgcctggaacatctgggaggtggaggactacggcttcgggatcttcacgaccaacatctggctgaagctccgggactcctacacccagatgtgcgaccaccgcctgatgagcgccgcgatcaaggactccaaggccgtgcacgccgacatgggctactggatcgagagcgagaagaacgagacctggaagctggcccgggcctccttcatcgaggtcaagacgtgcatctggcccaagagccacaccctctggtccaacggcgtgctggagagcgagatgatcatccccaagatgtacgggggcccgatctcccagcacaactaccgccccgggtacttcacccagaccgcgggcccctggcacctggggaagctcgagctggacttcgacctgtgcgagggcacgaccgtggtcgtggacgagcactgcggcagccgggggccgtccctccgcaccaccacggtgaccggcaagatcatccacgagtggtgctgccggagctgcaccctgccgcccctgcgcttccgcggggaggacggctgctggtacgggatggagatccgccccgtcaaggagaaggaggagaacctcgtgcggtccatggtgagcgccggcagcggcgaggtcgactccttcagcctggggatcctgtgcgtgtccatcatgatcgaggaggtgatgcgcagccggtggtcccgcaagatgctcatgaccggcacgctggccgtcttcctgctcctgatcatggggcagctgacctggaacgacctcatccgcctgtgcatcatggtgggcgccaacgccagcgacaagatggggatgggcaccacctacctggcgctcatggccacgttcaagatgcggccgatgttcgccgtggggctgctgttccgccggctcacctcccgcgaggtcctgctgctcaccatcgggctgagcctgatggcctccgtggagctccccaacagcctggaggagctgggcgacgggctcgccatgggcatcatgatgctgaagctgctcaccgagttccagccccaccagctgtggacgaccctgctctccctgaccttcatcaagaccacgctgagcctcgactacgcgtggaagaccaccgccatggtcctgtccatcgtgagcctgttccccctctgcctgtccaccacgagccagaagaccacctggctgccggtgctcctgggctccttcgggtgcaagcccctgaccatgttcctcatcaccgagaacgagatctggggccgcaagagctggcccctgaacgaggggatcatggccatcggcatcgtctccatcctgctcagcagcctgctgaagaacgacgtgcccctcgccgggccgctgatcgcgggcggcatgctgatcgcctgctacgtgatctccgggagctccgccgacctcagcctggagaaggccgccgaggtctcctgggaggaggaggcggagcacagcggcacgtcccacaacatcctggtggaggtgcaggacgacgggaccatgaagatcaaggacgaggagcgcgacgacaccctcaccatcctgctgaaggccacgctcctggccgtcagcggcgtgtaccccatgtccatccccgccaccctgttcgtgtggtacttctggcagaagaagaagcagcggagcggggtcctctgggacaccccctccccgcccgaggtggagcgcgccgtgctggacgacggcatctaccggatcctgcagcgcggcctgctcgggcggagccaggtcggcgtgggggtgttccaggacggcgtcttccacaccatgtggcacgtgacgcgcggggcggtgctgatgtaccagggcaagcggctggagccctcctgggccagcgtcaagaaggacctcatctcctacggcgggggctggcgcttccaggggagctggaacaccggcgaggaggtccaggtgatcgccgtcgagcccgggaagaacccgaagaacgtgcagaccacccccggcacgttcaagacccccgagggcgaggtgggggccatcgccctggacttcaagcccggcacctccgggagcccgatcgtcaaccgggagggcaagatcgtgggcctgtacgggaacggcgtggtcaccacgtccgggacctacgtgagcgcgatcgcccaggccaaggccagccaggagggccccctccccgagatcgaggacgaggtgttcaagaagcgcaacctgaccatcatggacctgcacccggggtccggcaagacccggcgctacctccccgccatcgtccgggaggcgatcaagcgcaagctgcggacgctgatcctcgcccccacccgcgtggtggccagcgagatggccgaggcgctgaagggcatgcccatccgctaccagaccaccgccgtcaagtccgagcacacggggcgggagatcgtggacctgatgtgccacgccaccttcaccatgcgcctcctgagcccggtgcgggtccccaactacaacatgatcatcatggacgaggcccacttcaccgaccccgcctccatcgcggcccgcggctacatcagcacgcgggtggggatgggcgaggccgccgccatcttcatgaccgcgacgccgcccgggtccgtggaggccttcccccagagcaacgccgtcatccaggacgaggagcgcgacatccccgagcggtcctggaacagcggctacgactggatcaccgacttccccggcaagacggtgtggttcgtgccctccatcaagagcgggaacgacatcgccaactgcctgcgcaagaacggcaagcgggtcatccagctctcccgcaagaccttcgacaccgagtaccagaagaccaagaacaacgactgggactacgtggtgacgaccgacatcagcgagatgggggccaacttccgggcggaccgcgtcatcgacccccggcgctgcctgaagcccgtgatcctgaaggacggccccgagcgggtgatcctcgccgggccgatgcccgtcaccgtggcctccgccgcgcagcgccggggccgcatcggccggaaccagaacaaggagggggaccagtacgtctacatgggccagcccctgaacaacgacgaggaccacgcccactggaccgaggccaagatgctgctcgacaacatcaacacgcccgaggggatcatcccggccctgttcgagcccgagcgcgagaagtccgccgcgatcgacggcgagtaccgcctgcgcggggaggcccgcaagaccttcgtggagctcatgcggcgcggcgacctgcccgtgtggctgtcctacaaggtcgccagcgagggcttccagtactccgaccggcgctggtgcttcgacggggagcggaacaaccaggtgctcgaggagaacatggacgtggagatctggaccaaggagggcgagcgcaagaagctgcggccccgctggctggacgcccggacctacagcgacccgctcgccctgcgcgagttcaaggagttcgcggccgggcggcgcagcgtctccggcgacctgatcctcgagatcggcaagctgccccagcacctgaccctccgggcccagaacgccctggacaacctggtgatgctccacaacagcgagcagggcgggaaggcctaccgccacgcgatggaggagctgcccgacacgatcgagaccctgatgctcctggccctgatcgccgtgctcaccgggggcgtcaccctgttcttcctgtccgggaagggcctcggcaagacgagcatcgggctgctgtgcgtgaccgcctccagcgcgctcctgtggatggcctccgtggagccccactggatcgccgccagcatcatcctggagttcttcctcatggtcctgctgatcccggagcccgaccggcagcgcacgccccaggacaaccagctcgcctacgtggtgatcggcctgctgttcatgatcctcaccgtcgcggccaacgagatggggctgctggagacgaccaagaaggacctcggcatcgggcacgtggccgccgagaaccaccagcacgccaccatgctggacgtggacctgcacccggcgtccgcctggaccctctacgccgtcgccacgaccgtgatcacccccatgatgcggcacaccatcgagaacacgaccgccaacatcagcctgaccgcgatcgccaaccaggccgccatcctgatgggcctcgacaagggctggcccatctccaagatggacctgggggtgcccctgctcgccctgggctgctacagccaggtcaacccgctgaccctcacggcggccgtgctgatgctggtggcccactacgccatcatcgggcccggcctccaggcgaaggccacccgcgaggcccagaagcggaccgccgccgggatcatgaagaaccccaccatcgacggcatcgtcgcgatcgacctggaccccgtggtgtacgacgccaagttcgagaagcagctgggccagatcatgctcctgatcctgtgcacgtcccagatcctcctgatgcgcaccacctgggccctgtgcgagagcatcaccctcgccacggggccgctgaccaccctgtgggagggctcccccgggaagttctggaacaccacgatcgccgtcagcatggcgaacatcttccgcggctcctacctcgccggcgccgggctggccttcagcctgatgaagtccctcggcgggggccggcgcgggaccggcgcccagggcgagaccctgggggagaagtggaagcggcagctgaaccagctcagcaagagcgagttcaacacctacaagcgctccggcatcatggaggtggaccggagcgaggcgaaggaggggctgaagcgcggcgagacgaccaagcacgccgtgtcccgggggaccgccaagctgcgctggttcgtcgagcggaacctggtgaagcccgagggcaaggtgatcgacctcggctgcgggcgcggcgggtggagctactactgcgccggcctgaagaaggtcaccgaggtgaaggggtacaccaagggcggccccgggcacgaggagccgatccccatggcgacgtacggctggaacctggtgaagctccactccgggaaggacgtcttcttcatgccgcccgagaagtgcgacaccctgctgtgcgacatcggcgagagctccccgaaccccaccatcgaggaggggcggaccctccgcgtgctgaagatggtggagccctggctgcggggcaaccagttctgcatcaagatcctcaacccctacatgccgagcgtcgtggagacgctggagcagatgcagcgcaagcacggcgggatgctggtgcggaaccccctctcccgcaacagcacccacgagatgtactgggtctcctgcggcaccgggaacatcgtgagcgccgtgaacatgacctcccggatgctgctgaaccgcttcacgatggcccaccggaagcccacctacgagcgcgacgtcgacctcggcgccggcacccgccacgtggccgtggagcccgaggtcgcgaacctggacatcatcgggcagcggatcgagaacatcaagaacgagcacaagagcacctggcactacgacgaggacaacccgtacaagacgtgggcctaccacggctcctacgaggtgaagcccagcgggtccgccagctccatggtgaacggcgtcgtgcgcctgctcaccaagccctgggacgtcatccccatggtgacccagatcgccatgaccgacacgaccccgttcgggcagcagcgggtgttcaaggagaaggtcgacacccgcacgccccgggccaagcgcggcacggcgcagatcatggaggtgaccgccaagtggctgtggggcttcctgagccggaacaagaagccccgcatctgcacccgggaggagttcacccgcaaggtgcggagcaacgccgccatcggggccgtcttcgtggacgagaaccagtggaactccgcgaaggaggccgtggaggacgagcgcttctgggacctcgtccaccgggagcgcgagctgcacaagcagggcaagtgcgccacgtgcgtgtacaacatgatggggaagcgggagaagaagctgggcgagttcgggaaggccaagggcagccgcgcgatctggtacatgtggctcggcgcccggttcctggagttcgaggccctggggttcatgaacgaggaccactggttctcccgcgagaacagcctctccggcgtggagggggagggcctgcacaagctggggtacatcctccgggacatcagcaagatcccgggcggcaacatgtacgccgacgacaccgccgggtgggacacccgcatcaccgaggacgacctgcggaacgaggcgaagatcacggacatcatggagcccgagcacgccctgctcgccacctccatcttcaagctgacctaccagaacaaggtcgtgcgcgtgcagcgccccgccaagaacggcaccgtcatggacgtgatcagccggcgcgaccagcgggggtccggccaggtgggcacgtacgggctgaacaccttcaccaacatggaggtccagctcatccgccagatggagagcgagggcatcttcttcccctccgagctggagagcccgaacctggccgagcgggtgctcgactggctggagaagcacggggcggagcgcctgaagcggatggccatctccggcgacgactgcgtggtcaagcccatcgacgaccgcttcgccaccgccctcatcgccctgaacgacatggggaaggtgcggaaggacatcccccagtgggagcccagcaagggctggaacgactggcagcaggtcccgttctgctcccaccacttccaccagctgatcatgaaggacggccgcgagatcgtcgtgccctgccggaaccaggacgagctcgtggggcgcgcgcgggtcagccagggcgccgggtggtccctgcgcgagacggcctgcctgggcaagagctacgcccagatgtggcagctcatgtacttccaccggcgcgacctgcggctggccgcgaacgccatctgcagcgccgtgcccgtggactgggtccccacctcccgcaccacctggagcatccacgcccaccaccagtggatgaccacggaggacatgctctccgtgtggaaccgggtgtggatcgaggagaacccgtggatggaggacaagacccacgtcagctcctgggaggaggtgccctacctggggaagcgcgaggaccagtggtgcggcagcctgatcggcctcaccgcgcgcgccacctgggccacgaacatccaggtggccatcaaccaggtccggcgcctgatcgggaacgagaactacctggactacatgacctccatgaagcggttcaagaacgagagcgaccccgagggcgccctctgg

SEQ ID NO: 8974 - RNA, 9876 nt, synthetic construct
  misc_feature 1..9876: note = derived and/or modified CDS sequence (opt1) from DENV-1__KF672764__SS-prME
  source 1..9876: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacccgcaccgagacctggatgagctccgagggcgcctggaagcagatccagaaggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccgcaagctgtgcatcgaggccaagatcagcaacaccaccacggactcccggtgcccgacccagggcgaggccaccctggtggaggagcaggacgccaacttcgtctgccgccggaccttcgtggaccgcggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccgccaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtcatgtgcaccgggagcttcaagctggagaaggaggtggcggagacgcagcacggcaccgtgctggtccaggtgaagtacgagggcaccgacgccccctgcaagatccccttctccacccaggacgagaagggggtgacgcagaacggccgcctcatcaccgccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtgttcacctccgtggggaagctggtccaccaggtgttcggcaccgcctacggggtgctgttcagcggcgtctcctggacgatgaagatcgggatcggcatcctcctgacctggctgggcctcaacagccgctccaccagcctgtccatgacctgcatcgccgtggggatggtgacgctgtacctcggcgtcatggtgcaggccgacagcgggtgcgtgatcaactggaagggccgcgagctgaagtgcgggtccggcatcttcgtcaccaacgaggtgcacacctggaccgagcagtacaagttccaggccgacagcccgaagcggctgagcgcggccatcggccgcgcctgggaggagggggtgtgcggcatccggtccgccacccgcctcgagaacatcatgtggaagcagatcagcaacgagctgaaccacatcctgctcgagaacgacatcaagttcacggtcgtggtggggaacgccaacggcatcctgacccaggggaagaagatgatccggccccagcccatggagcacaagtactcctggaagtcctggggcaaggcgaagatcatcggcgccgacatccagaacaccaccttcatcatcgacgggcccgacacgccggagtgccccgacgagcagcgcgcctggaacatctgggaggtcgaggactacggcttcgggatcttcaccaccaacatctggctgaagctccgggactcctacacccagatgtgcgaccaccgcctgatgagcgccgcgatcaaggactccaaggccgtgcacgccgacatgggctactggatcgagagcgagaagaacgagacgtggaagctggcccgggcctccttcatcgaggtgaagacctgcatctggcccaagagccacaccctctggtccaacggcgtcctggagagcgagatgatcatccccaagatgtacgggggcccgatctcccagcacaactaccgccccgggtacttcacccagacggcgggcccctggcacctggggaagctcgagctggacttcgacctgtgcgagggcaccaccgtggtggtcgacgagcactgcggcagccgggggccgtccctccgcaccacgaccgtgaccggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggatcctgtgcgtctccatcatgatcgaggaggtgatgcggagccgctggtcccggaagatgctcatgacgggcaccctggccgtgttcctgctcctgatcatggggcagctgacctggaacgacctcatccgcctgtgcatcatggtcggcgccaacgccagcgacaagatggggatgggcaccacgtacctggcgctcatggccaccttcaagatgcgcccgatgttcgccgtggggctgctgttccggcgcctcacctcccgggaggtgctgctgctcaccatcgggctgagcctggtcgcctccgtggagctccccaacagcctggaggagctgggcgacgggctcgccatgggcatcatgatgctgaagctgctcacggagttccagccccaccagctgtggaccaccctgctctccctgaccttcatcaagacgaccctgagcctcgactacgcgtggaagaccaccgccatggtcctgtccatcgtgagcctgttccccctctgcctgtccacgaccagccagaagaccacctggctgccggtgctcctgggctccttcgggtgcaagcccctgaccatgttcctcatcacggagaacaagatctggggccgcaagagctggcccctgaacgaggggatcatggccatcggcatcgtctccatcctgctcagcagcctgctgaagaacgacgtgcccctcgccgggccgctgatcgcgggcggcatgctgatcgcctgctacgtgatctccgggagctccgccgacctcagcctggagaaggccgccgaggtctcctgggaggaggaggcggagcacagcggcacctcccacaacatcctggtggaggtgcaggacgacgggaccatgaagatcaaggacgaggagcgggacgacaccctcacgatcctgctgaaggccaccctcctggccgtcagcggcgtgtaccccatgtccatccccgccaccctgttcgtgtggtacttctggcagaagaagaagcagcgcagcggggtcctctgggacaccccctccccgcccgaggtggagcgggccgtgctggacgacggcatctaccgcatcctgcagcggggcctgctcgggcgcagccaggtcggcgtgggggtgttccaggacggcgtcttccacacgatgtggcacgtgacccgcggggccgtgctgatgtaccagggcaagcgcctggagccctcctgggccagcgtcaagaaggacctcatctcctacggcgggggctggcggttccaggggagctggaacaccggcgaggaggtccaggtgatcgccgtcgagcccgggaagaacccgaagaacgtgcagaccacgcccggcaccttcaagacccccgagggcgaggtgggggccatcgccctggacttcaagcccggcacctccgggagcccgatcgtcaaccgcgagggcaagatcgtgggcctgtacgggaacggcgtggtcacgacctccgggacctacgtgagcgcgatcgcccaggccaaggccagccaggagggccccctccccgagatcgaggacgaggtgttcaagaagcggaacctgaccatcatggacctgcacccggggtccggcaagacgcgccggtacctccccgccatcgtccgcgaggcgatcaagcggaagctgcgcaccctgatcctcgcccccacccgggtggtggccagcgagatggccgaggcgctgaagggcatgcccatccgctaccagaccacggccgtcaagtccgagcacaccgggcgcgagatcgtggacctgatgtgccacgccaccttcaccatgcggctcctgagcccggtgcgcgtccccaactacaacatgatcatcatggacgaggcccacttcacggaccccgcctccatcgcggcccggggctacatcagcacccgcgtggggatgggcgaggccgccgccatcttcatgaccgcgacgccgcccgggtccgtggaggccttcccccagagcaacgccgtcatccaggacgaggagcgggacatccccgagcgctcctggaacagcggctacgactggatcacggacttccccggcaagaccgtgtggttcgtgccctccatcaagagcgggaacgacatcgccaactgcctgcggaagaacggcaagcgcgtcatccagctctcccggaagaccttcgacaccgagtaccagaagacgaagaacaacgactgggactacgtggtgaccaccgacatcagcgagatgggggccaacttccgcgcggaccgggtcatcgacccccgccggtgcctgaagcccgtgatcctgaaggacggccccgagcgcgtgatcctcgccgggccgatgcccgtcaccgtggcctccgccgcgcagcggcgcggccggatcggccgcaaccagaacaaggagggggaccagtacgtctacatgggccagcccctgaacaacgacgaggaccacgcccactggacggaggccaagatgctgctcgacaacatcaacacccccgaggggatcatcccggccctgttcgagcccgagcgggagaagtccgccgcgatcgacggcgagtaccgcctgcgcggggaggcccggaagaccttcgtggagctcatgcgccggggcgacctgcccgtgtggctgtcctacaaggtcgccagcgagggcttccagtactccgaccgccggtggtgcttcgacggggagcgcaacaaccaggtgctcgaggagaacatggacgtggagatctggaccaaggagggcgagcggaagaagctgcgcccccggtggctggacgcccgcacctacagcgacccgctcgccctgcgggagttcaaggagttcgcggccgggcgccggagcgtctccggcgacctgatcctcgagatcggcaagctgccccagcacctgacgctccgcgcccagaacgccctggacaacctggtgatgctccacaacagcgagcagggcgggaaggcctaccggcacgcgatggaggagctgcccgacaccatcgagaccctgatgctcctggccctgatcgccgtgctcaccgggggcgtcacgctgttcttcctgtccgggaagggcctcggcaagaccagcatcgggctgctgtgcgtgaccgcctccagcgcgctcctgtggatggcctccgtggagccccactggatcgccgccagcatcatcctggagttcttcctcatggtcctgctgatcccggagcccgaccgccagcggacgccccaggacaaccagctcgcctacgtggtgatcggcctgctgttcatgatcctcacggtcgcggccaacgagatggggctgctggagaccaccaagaaggacctcggcatcgggcacgtggccgccgagaaccaccagcacgccaccatgctggacgtggacctgcacccggcgtccgcctggacgctctacgccgtcgccaccaccgtgatcacccccatgatgcgccacacgatcgagaacaccaccgccaacatcagcctgaccgcgatcgccaaccaggccgccatcctgatgggcctcgacaagggctggcccatctccaagatggacctgggggtgcccctgctcgccctgggctgctacagccaggtcaacccgctgacgctcaccgcggccgtgctgatgctggtggcccactacgccatcatcgggcccggcctccaggcgaaggccacccgggaggcccagaagcgcaccgccgccgggatcatgaagaaccccacggtcgacggcatcgtggcgatcgacctggaccccgtggtctacgacgccaagttcgagaagcagctgggccagatcatgctcctgatcctgtgcacctcccagatcctcctgatgcggaccacctgggccctgtgcgagagcatcacgctcgccaccgggccgctgaccaccctgtgggagggctcccccgggaagttctggaacacgaccatcgccgtgagcatggcgaacatcttccgcggctcctacctcgccggcgccgggctggccttcagcctgatgaagtccctcggcgggggccgccgggggaccggcgcccagggcgagaccctgggggagaagtggaagcgccagctgaaccagctcagcaagagcgagttcaacacgtacaagcggtccggcatcatggaggtggaccgcaccgaggcgaaggaggggctgaagcggggcgagaccaccaagcacgccgtcagccgcgggaccgccaagctgcggtggttcgtggagcgcaacctggtgaagcccgagggcaaggtcatcgacctcggctgcgggcggggcgggtggtcctactactgcgccggcctgaagaaggtgacggaggtgaaggggtacaccaagggcggccccgggcacgaggagccgatccccatggcgacctacggctggaacctggtcaagctccacagcgggaaggacgtgttcttcatgccgcccgagaagtgcgacaccctgctgtgcgacatcggcgagtccagcccgaaccccacgatcgaggaggggcgcaccctccgggtgctgaagatggtcgagccctggctgcgcggcaaccagttctgcatcaagatcctcaacccctacatgccgtccgtggtggagaccctggagcagatgcagcggaagcacggcgggatgctggtccgcaaccccctcagccggaactccacccacgagatgtactgggtgagctgcggcacggggaacatcgtgtccgccgtcaacatgaccagccgcatgctgctgaaccggttcaccatggcccaccgcaagcccacctacgagcgggacgtggacctcggcgccggcacgcgccacgtggccgtcgagcccgaggtggcgaacctggacatcatcgggcagcgcatcgagaacatcaagaacgagcacaagtccacctggcactacgacgaggacaacccgtacaagacctgggcctaccacggcagctacgaggtgaagccctccgggagcgcctccagcatggtcaacggcgtggtccggctgctcaccaagccctgggacgtgatccccatggtgacgcagatcgccatgaccgacaccaccccgttcgggcagcagcgcgtcttcaaggagaaggtggacacgcggacgccccgggccaagcggggcaccgcgcagatcatggaggtgaccgccaagtggctgtggggcttcctgtcccgcaacaagaagccccggatctgcacgcgcgaggagttcacccggaaggtccgcagcaacgccgccatcggggccgtgttcgtggacgagaaccagtggaacagcgcgaaggaggccgtcgaggacgagcggttctgggacctcgtgcaccgcgagcgggagctgcacaagcagggcaagtgcgcgacctgcgtgtacaacatgatggggaagcgcgagaagaagctgggcgagttcgggaaggccaagggctcccgggcgatctggtacatgtggctcggcgcccgcttcctggagttcgaggccctggggttcatgaacgaggaccactggttcagccgggagaactccctcagcggcgtcgagggggagggcctgcacaagctggggtacatcctccgcgacatctccaagatcccgggcggcaacatgtacgccgacgacaccgccgggtgggacacgcggatcaccgaggacgacctgcagaacgaggcgaagatcaccgacatcatggagcccgagcacgccctgctcgccaccagcatcttcaagctgacgtaccagaacaaggtggtgcgcgtccagcggcccgccaagaacggcaccgtgatggacgtgatctcccgccgcgaccagcgggggagcggccaggtcggcacctacgggctgaacaccttcacgaacatggaggtgcagctcatccgccagatggagtccgagggcatcttcttccccagcgagctggagtccccgaacctggccgagcgggtgctcgactggctggagaagcacggggcggagcgcctgaagcggatggccatcagcggcgacgactgcgtcgtgaagcccatcgacgaccgcttcgccaccgccctcatcgccctgaacgacatggggaaggtgcggaaggacatcccccagtgggagccctccaagggctggaacgactggcagcaggtcccgttctgcagccaccacttccaccagctgatcatgaaggacggccgcgagatcgtggtgccctgccggaaccaggacgagctcgtcgggcgcgcgcgggtgtcccagggcgccgggtggagcctgcgcgagaccgcctgcctgggcaagtcctacgcccagatgtggcagctcatgtacttccaccggcgcgacctgcggctggccgcgaacgccatctgcagcgccgtgcccgtcgactgggtgcccaccagccgcaccacgtggtccatccacgcccaccaccagtggatgaccaccgaggacatgctcagcgtgtggaaccgggtctggatcgaggagaacccgtggatggaggacaagacccacgtgtccagctgggaggaggtgccctacctggggaagcgcgaggaccagtggtgcggctccctgatcggcctcacggcgcgggccacctgggccaccaacatccaggtcgccatcaaccaggtgcgccgcctgatcgggaacgagaactacctggactacatgaccagcatgaagcggttcaagaacgagtccgaccccgagggcgccctctgg

SEQ ID NO: 8975 - RNA, 9879 nt, synthetic construct
  misc_feature 1..9879: note = derived and/or modified CDS sequence (opt1) from DENV-1__EU863650__SS-prME
  source 1..9879: mol_type = other RNA
agcgtgaccatgctgctcatgctgctgcccaccgtgctcaccttccacctgaccacccgcggcggggagccccacatgatcgtgagcaagcaggagcggggcaagagcctcctgttcaagacctccgccggggtgaacatgtgcacgctgatcgccatggacctgggcgagctctgcgacgacaccatgacctacaagtgcccccgcatcaccgagacggagcccgacgacgtggactgctggtgcaacgccaccgagacctgggtgacctacgggacgtgcagccagaccggcgagcaccggcgcgacaagcggtccgtggccctggcgccccacgtcggcctggggctcgagacccgcaccgagacgtggatgagctccgagggcgcctggcggcagatccagaaggtggagacctgggccctgcgccaccccgggttcaccgtgatcgcgctgttcctcgcccacgccatcggcaccagcatcacgcagaaggggatcatcttcatcctgctgatgctcgtcaccccctccatggccatgcggtgcgtgggcatcggcaaccgcgacttcgtggaggggctgagcggcgcgacctgggtcgacgtggtgctggagcacgggtcctgcgtcaccacgatggccaaggacaagcccaccctcgacatcgagctgctgaagaccgaggtgaccaaccccgccgtgctccggaagctgtgcatcgaggccaagatcagcaacacgaccaccgactcccgctgcccgacccagggcgaggccacgctggtcgaggagcaggacaccaacttcgtgtgccggcgcaccttcgtggaccggggctgggggaacggctgcggcctgttcggcaaggggagcctgatcacgtgcgcgaagttcaagtgcgtcacgaagctggagggcaagatcgtgcagtacgagaacctcaagtactccgtgatcgtcaccgtgcacaccggcgaccagcaccaggtcgggaacgagaccaccgagcacggcacgatcgccaccatcacgccccaggcccccaccagcgagatccagctgacggactacggggccctgaccctcgactgcagcccccggaccggcctggacttcaacgagatggtgctgctcaccatgaaggagaagtcctggctggtgcacaagcagtggttcctggacctcccgctgccctggacgtccggggccagcaccagccaggagacctggaaccggcaggacctgctcgtcaccttcaagacggcgcacgccaagaagcaggaggtggtggtcctgggctcccaggagggcgccatgcacaccgccctgaccggggccaccgagatccagacgagcggcaccaccaccatcttcgcggggcacctcaagtgccgcctgaagatggacaagctgacgctcaagggcatctcctacgtgatgtgcaccgggctgttcaagctggagaaggaggtggccgagacccagcacggcaccgtcctggtccaggtgaagtacgagggcacggacgccccctgcaagatccccttcagctcccaggacgagaagggggccacccagaacggccggctcgtcaccgccaacccgatcgtgaccgacaaggagaagcccgtgaacatcgaggcggagccgcccttcggggagagctacatcgtcgtgggcgccggcgagaaggccctgaagctgtcctggttcaagaaggggagctccatcggcaagatgttcgaggccacggcgcgcggggcccggcgcatggccatcctcggcgacaccgcctgggacttcgggagcatcggcggcgtgttcacctccgtcgggaagctggtgcaccagatcttcggcaccgcctacggggtgctgttcagcggcgtctcctggacgatgaagatcgggatcggcatcctcctgacctggctgggcctcaacagccgctccaccagcctgtccatgacctgcatcgcggtggggatggtgacgctgtacctcggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctgagcgccgccatcggcaaggcgtgggaggagggggtgtgcggcatccggtccgccacccgcctcgagaacatcatgtggaagcagatcagcaacgagctgaaccacatcctgctcgagaacgacatgaagttcacggtcgtggtgggggacgtctccggcatcctggcccaggggaagaagaccatccggccccagcccatggagcacaagtacagctggaagtcctggggcaaggccaagatcatcggcgccgacgtgcagaacaccaccttcatcatcgacgggcccaacacgccggagtgccccgacgaccagcgcgcgtggaacatctgggaggtggaggactacggcttcgggatcttcaccaccaacatctggctgaagctccgggacagctacacccaggtctgcgaccaccgcctgatgtccgccgccatcaaggacagcaaggccgtgcacgcggacatgggctactggatcgagtccgagaagaacgagacgtggaagctggcccgggccagcttcatcgaggtgaagacctgcgtctggcccaagtcccacaccctctggagccacggcgtgctggagtccgagatgatcatccccaagatctacgggggcccgatcagccagcacaactaccgccccgggtacttcacccagacggccggcccctggcacctggggaagctcgagctggacttcgacctgtgcgagggcaccaccgtggtcgtggacgagcactgcggcaaccgggggccgtccctccgcaccacgaccgtgaccggcaagatcatccacgagtggtgctgccggagctgcaccctgccgcccctgcgcttcaagggggaggacggctgctggtacgggatggagatccggcccgtcaaggagaaggaggagaacctcgtgaagtccatggtgagcgccggcagcggcgaggtcgactccttcagcctggggctgctctgcatctccatcatgatcgaggaggtgatgcgcagccggtggtcccgcaagatgctgatgacgggcaccctggtggtcttcctcctgctgaccctcgggcagctgacctggaacgacctgatccggctctgcatcatggtgggcgcgaacgccagcgacaacatggggatgggcacgacctacctggccctgatggccaccttccgcatgcgcccgatgttcgccgtcgggctcctgttccggcgcctgacctcccgggaggtgctcctgctgacggtggggctcagcctggtcgcctccgtggagctgcccaacagcctcgacgagctgggcgacgggctggccatgggcatcatgatcctcaagctgctgaccgacttccagtcccaccagctctgggccaccctgctgagcctcaccttcgtgaagacgaccctgtccctgcactacgcctggaagaccatggccatgatcctcagcatcgtctccctgctgcccctctgcctgagcaccacgtcccagaagaccacctggctgcccgtgctcctgggcagcctggggtgcaagccgctcaccatgttcctgatcaccgagaacaagatctggggccgcaagtcctggcccctgaacgaggggatcatggcggtgggcatcgtcagcatcctcctgagctccctgctcaagaacgacgtgcccctggccgggcccctgatcgccggcggcatgctcatcgcctgctacgtgatcagcgggtccagcgcggacctgtccctggagaaggccgccaaggtcagctgggaggaggaggccgagcactccggcgccagccacaacatcctcgtggagatccaggacgacgggacgatgaagatcaaggacgaggagcgggacgacaccatcaccatcctgctgaaggcgaccctcctggccatctccggcgtgtacccgatgagcatccccgccacgctgttcgtctggcacttctggcagaagaagaagcagcgctccggggtgctgtgggacacccccagcccgcccgaggtggagaaggccgtcctcgacgacggcatctaccggatcctgcagcgcggcctgctcgggcggtcccaggtgggcgtgggggtcttccaggagggcgtgttccacaccatgtggcacgtgacccgcggggccgtcctgatgtaccagggcaagcggctggagcccagctgggcgtccgtgaagaaggacctcatcagctacggcgggggctggcgcttccaggggtcctggaacacgggcgaggaggtgcaggtcatcgccgtggagcccgggaagaaccccaagaacgtgcagaccgcccccggcaccttcaagaccagcgagggcgaggtcggggccatcgccctggacttcaagcccggcacgtccgggagccccatcgtgaaccgggagggcaagatcgtgggcctgtacgggaacggcgtcgtgaccaccagcgggacctacgtgtccgcgatcgcccaggccaaggccagccaggagggccccctcccggagatcgaggacgaggtcttccgcaagcggaacctgacgatcatggacctgcaccccgggtccggcaagacccgccggtacctccccgccatcgtgcgcgaggcgatcaagcggaagctgcgcaccctggtgctcgccccgacccgggtcgtggccagcgagatggccgaggcgctgaagggcatgcccatccgctaccagacgaccgccgtgaagtccgagcacaccgggaaggagatcgtcgacctgatgtgccacgccaccttcacgatgcgcctcctgagccccgtgcgggtgcccaactacaacatgatcatcatggacgaggcccacttcaccgacccggcctccatcgcggcccgcggctacatcagcacccgggtcgggatgggcgaggccgccgccatcttcatgaccgcgacgccgcccgggtccgtggaggccttcccccagagcaacgccgtgatccaggacgaggagaaggacatcccggagcgctcctggaacagcggctacgactggatcaccgacttccccggcaagaccgtctggttcgtgccctccatcaagagcgggaacgacatcgccaactgcctgcggaagaacggcaagcgcgtgatccagctctcccggaagaccttcgacacggagtaccagaagaccaagaacaacgactgggactacgtcgtgaccaccgacatcagcgagatgggggccaacttccgcgcggaccgggtcatcgacccccgccggtgcctgaagccggtgatcctgaaggacggccccgagcgcgtgatcctcgccgggcccatgcccgtcacggtggcctccgccgcgcagcggcgcggccggatcggccgcaaccagaacaaggagggggaccagtacatctacatgggccagccgctgaacaacgacgaggaccacgcccactggaccgaggccaagatgctgctcgacaacatcaacacccccgaggggatcatccccgccctgttcgagcccgagcgggagaagtccgccgcgatcgacggcgagtaccgcctgcgcggggaggcccgcaagaccttcgtggagctcatgcgccggggcgacctgccggtctggctgtcctacaaggtggccagcgagggcttccagtacagcgaccgccggtggtgcttcgacggggagcgcaacaaccaggtgctcgaggagaacatggacgtcgagatctggacgaaggagggcgagcggaagaagctgcgcccccggtggctggacgcccgcacctactccgaccccctcgccctgcgggagttcaaggagttcgcggccgggcgccggagcgtgtccggcgacctgatcctcgagatcggcaagctgccccagcacctgacccagcgcgcccagaaggccctcgacaacctggtgatgctgcacaacagcgagcagggcgggaaggcctaccggcacgcgatggaggagctcccggacaccatcgagaccatcatgctgctggccctcatcgccgtcctgaccggcggggtgaccctgttcttcctctccgggcgcgggctgggcaagaccagcatcgggctgctctgcgtgacctccagctccgccctgctgtggatggcgagcgtcgagccccactggatcgccgcctccatcatcctcgagttcttcctgatggtgctgctcatccccgagcccgaccggcagcgcacgccgcaggacaaccagctggcctacgtggtcatcggcctcctcttcatgatcctgaccgtggccgcgaccgagatggggctgctcgagaccacgaagaaggacctgggcatcgggcacgccgccgccgagaaccaccaccacgccgcgatgctggacgtggacctccaccccgccagcgcctggaccctgtacgccgtcgccaccaccatcatcacgcccatgatgcggcacaccatcgagaacaccaccgcgaacatctccctgacggccatcgccaaccaggccgccatcctcatgggcctggacaagggctggccgatcagcaagatggacatcggggtgcccctgctcgcgctgggctgctactcccaggtgaaccccctgaccctcaccgccgccgtcctgatgctggtggcccactacgcgatcatcgggcccggcctccaggccaaggccacccgcgaggcccagaagcggacggccgcggggatcatgaagaacccgaccgtggacggcatcgtcgccatcgacctggaccccgtggtgtacgacgccaagttcgagaagcagctgggccagatcatgctcctgatcctgtgcaccagccagatcctcctgatgcgcaccacgtgggccctgtgcgagtccatcaccctcgccaccgggcccctgaccacgctgtgggagggcagccccgggaagttctggaacaccaccatcgcggtctccatggccaacatcttccggggcagctacctcgccggcgccgggctggccttcagcctgatgaagtccctcggcgggggccgccgcgggaccggcgcgcagggcgagacgctgggggagaagtggaagcggcagctgaaccagctcagcaagtccgagttcaagacctacaagcgcagcggcatcatcgaggtggaccggtccgaggccaaggaggggctgaagcgcggcgagaccaccaagcacgccgtgagccgggggacggccaagctgcgctggttcgtcgagcggaacctggtgaagccggagggcaaggtgatcgacctcggctgcgggcgcggcgggtggtcctactactgcgcgggcctgaagaaggtcaccgaggtgaaggggagcaccaagggcggccccgggcacgaggagcccatccccatggccacctacggctggaacctggtgaagctccactccgggaaggacgtcttcttcatcccgcccgagaagtgcgacaccctgctgtgcgacatcggcgagagctcccccaaccccacgatcgaggaggggcggaccctccgcgtgctgaagatggtggagccgtggctgcggggcaaccagttctgcatcaagatcctcaacccctacatgcccagcgtcgtggagaccctggagcagatgcagcgcaagcacggcgggatgctggtgcggaaccccctctcccgcaacagcacccacgagatgtactgggtctcctgcggcacggggaacatcgtgagcgccgtgaacatgacctcccggatgctgctgaaccgcttcaccatggcccaccggaagccgacctacgagcgcgacgtcgacctcggcgccggcacgcggcacgtggcggtggagcccgaggtcgccaacctggacatcatcgggcagcgcatcgagaacatcaagaacgagcacaagagcacctggcactacgacgaggacaacccctacaagacctgggcctaccacggctcctacgaggtgaagcccagcgggagcgcctccagcatggtcaacggcgtggtgcgcctgctcaccaagccgtgggacgtcatccccatggtgacgcagatcgccatgaccgacaccacccccttcgggcagcagcgggtgttcaaggagaaggtcgacacgcgcacccccaaggcgaagcggggcaccgcccagatcatggaggtgaccgccaagtggctgtggggcttcctgtcccgcaacaagaagccgcggatctgcacgcgcgaggagttcacccggaaggtgcgcagcaacgccgccatcggggcggtcttcgtggacgagaaccagtggaactcccccaaggaggccgtggaggacgagcggttctgggacctcgtccaccgcgagcgggagctgcacaagcagggcaagtgcgcgacctgcgtgtacaacatgatggggaagcgcgagaagaagctgggcgagttcgggaaggccaagggcagccgggcgatctggtacatgtggctcggcgcccgcttcctggagttcgaggccctggggttcatgaacgaggaccactggttctcccgggagaacagcctctccggcgtggagggggagggcctgcacaagctggggtacatcctccgcgacatcagcaagatccccggcggcaacatgtacgccgacgacaccgccgggtgggacacgcggatcaccgaggacgacctgcagaacgaggcgaagatcaccgacatcatggagccggagcacgccctgctcgccacctccatcttcaagctgacgtaccagaacaaggtcgtgcgcgtgcagcggcccgccaagaacggcaccgtcatggacgtgatcagccgccgggaccagcgcgggtccggccaggtgggcacctacgggctgaacaccttcacgaacatggaggcccagctcatccgccagatggagagcgagggcatcttcctgccctccgagctggagcccccgaacctcgcggggcgggtccccgactggctggagaagcacggcaccgagcgcctgcggcgcatggccatcagcggggacgactgcgtggtgaagcccatcgacgaccggttcgccaccgccctcaccgccctgaacgacatgggcaaggtccgcaaggacatcccccagtgggagccgtccaagggctggaacgactggcagcaggtccccttctgcagccaccacttccaccagctgatcatgaaggacgggcgggagatcgtggtcccctgccgcaaccaggacgagctcgtgggccgggcgcgcgtgagccagggggccggctggtccctgcgggagacggcctgcctgggcaagagctacgcccagatgtggcagctcatgtacttccaccgccgggacctgcgcctggccgcgaacgccatctgctccgccgtccccgtggactgggtgccgaccagccggaccacctggtccatccacgcccaccaccagtggatgaccacggaggacatgctcagcgtctggaaccgcgtgtggatcgaggagaacccctggatggaggacaagacccacgtgtccagctgggaggacgtcccctacctgggcaagcgggaggaccagtggtgcggctccctgatcgggctcaccgcgcgcgccacctgggccacgaacatccaggtggccatcaaccaggtgcggcgcctgatcggcaacgagaactacctggactacatgaccagcatgaagcgcttcaagaacgagtccgaccccgagggggccctctggtga

SEQ ID NO: 8976 - RNA, 9879 nt, synthetic construct
  misc_feature 1..9879: note = derived and/or modified CDS sequence (opt1) from DENV-1__KU365900__SS-prME
  source 1..9879: mol_type = other RNA
agcgtgaccatgctgctcatgctgatgcccaccgccctggccttccacctcaccacccggggcggggagccccacatgatcgtcagcaagcaggagcggggcaagagcctgctgttcaagacctccgccggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtcacctacgggacctgcagccagaccggcgagcaccggcgggacaagcggtccgtggccctcgcgccccacgtgggcctggggctggagacgcggaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggcgggcatcctcgcccaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctgcgggacagctacacccaggtgtgcgaccaccgcctcatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcccgggcgaggtcgacagcttctccctcgggctgctgtgcatcagcatcatgatcgaggaggtgatgcggtcccgctggagccggaagatgctcatgaccggcaccctggccgtgttcttcctgctcatcatggggcagctgacgtggaacgacctgatccgcctctgcatcatggtcggcgcgaacgcctccgaccgcatggggatgggcaccacctacctggccctgatggccaccttcaagatgcggcccatgttcgccgtgggcctcctgctgcgccggctcacgagccgcgaggtgctgctgctcaccatcgggctgtccctggtcgcgagcgtggagctccccaactccctggaggagctgggcgacgggctcgccatgggcatcatgatcctgaagctgctcaccgacttccagagccaccagctgtgggccaccctgctctccctgacgttcatcaagaccaccttcagcctgcactacgcctggaagaccatggcgatggtcctctccatcgtgagcctgttccccctgtgcctctccacgaccagccagaagaccacctggctgccggtgctgctcggctccctggggtgcaagcccctgacgatgttcctcatcgccgagaacaagatctggggccgcaagagctggcccctgaacgaggggatcatggccgtcggcatcgtgtccatcctgctcagcagcctgctgaagaacgacgtgcccctcgccgggccgctgatcgccggcggcatgctgatcgcgtgctacgtcatctccgggagctccgccgacctcagcctggagaaggccgccgaggtgtcctgggaggaggaggccgagcacagcggcgcgtcccacaacatcctggtggaggtccaggacgacgggaccatgaagatcaaggacgaggagcgcgacgacaccctcaccatcctgctgaaggccaccctcctggccgtgagcggcgtgtaccccctgtccatccccgccaccctcttcgtctggtacttctggcagaagaagaagcagcggagcggggtgctgtgggacaccccctccccgcccgaggtggagcgcgccgtcctggacgacggcatctaccggatcatgcagcgcggcctgctcgggcggagccaggtgggcgtgggggtcttccaggagaacgtgttccacaccatgtggcacgtgacccgcggcgcggtcctgatgtaccaggggaagcggctggagccctcctgggccagcgtgaagaaggacctcatctcctacggcggcgggtggcgcctgcagggcagctggaacacgggggaggaggtgcaggtcatcgccgtggagcccggcaagaacccgaagaacgtgcagaccgcccccgggaccttcaagacccccgagggcgaggtcggcgccatcgcgctggacttcaagcccgggacgtccggcagcccgatcgtgaaccgggaggggaagatcgtgggcctctacggcaacggggtcgtgaccacctccggcacctacgtgagcgccatcgcccaggccaaggcgagccaggaggggcccctgcccgagatcgaggacgaggtcttccgcaagcggaacctgacgatcatggacctccacccgggctccgggaagacccgccggtacctgcccgccatcgtgcgcgaggccatcaagcggaagctgcgcaccctcatcctggcccccacccgcgtggtcgccagcgagatggcggaggccctgaagggcatgcccatccggtaccagacgaccgccgtgaagtccgagcacaccggcaaggagatcgtggacctcatgtgccacgccaccttcacgatgcgcctgctgagcccggtccgggtgcccaactacaacatgatcatcatggacgaggcccacttcaccgacccctccagcatcgcggcccgcgggtacatctccacccgggtgggcatgggggaggccgccgccatcttcatgaccgcgacgcccccgggcagcgtcgaggccttcccccagtccaacgccgtgatccaggacgaggagcgcgacatccccgagcggagctggaactccgggtacgagtggatcaccgacttccccggcaagaccgtgtggttcgtcccgagcatcaagtccggcaacgacatcgccaactgcctccgcaagaacgggaagcgggtgatccagctgagccgcaagaccttcgacacggagtaccagaagaccaagaacaacgactgggactacgtggtcaccaccgacatctccgagatgggcgcgaacttccgggccgaccgcgtgatcgacccccggcgctgcctgaagcccgtgatcctcaaggacgggcccgagcgggtcatcctggccggcccgatgcccgtgacggtcgccagcgccgcgcagcgccgggggcgcatcggccggaaccacaacaaggagggcgaccagtacatctacatggggcagcccctgaacaacgacgaggaccacgcccactggaccgaggccaagatgctcctggacaacatcaacacccccgagggcatcatcccggccctgttcgagcccgagcgcgagaagtccgccgcgatcgacggggagtaccgcctccggggcgaggcccgcaagaccttcgtggagctgatgcggcgcggggacctgcccgtgtggctcagctacaaggtcgcctccgagggcttccagtacagcgaccggaagtggtgcttcgacggcgagcgcaacaaccaggtgctggaggagaacatggacgtggagatctggacgaaggagggggagcggaagaagctgcgcccccggtggctcgacgcccgcacctacagcgacccgctggccctgcgggagttcaaggagttcgcggccggccgccggtccgtcagcggggacctcatcctggagatcggcaagctgccccagcacctcacccagcgcgcccagaacgccctggacaacctggtgatgctccacaactccgagcagggcgggcgggcgtaccgccacgccatggaggagctgcccgacaccatcgagacgctgatgctcctggccctgatcgccgtgctcaccggcggggtcaccctgttcttcctgagcggccgggggctcggcaagacctccatcggcctgctgtgcgtgatggccagctccgtgctcctgtggatggcgagcgtcgagccccactggatcgccgcctccatcatcctggagttcttcctcatggtgctgctgatcccggagcccgaccgccagcggacgccccaggacaaccagctcgcctacgtggtcatcgggctgctgttcatgatcctcacggtggccgcgaacgagatgggcctgctggagaccaccaagaaggacctcgggatcggccacgtggccgtcgagaaccaccaccacgccaccatgctggacgtggacctgcacccggccagcgcctggacgctctacgcggtggccaccaccatcatcacccccatgatgcgccacacgatcgagaacaccaccgccaacatctccctgaccgccatcgccaaccaggcggccatcctgatggggctcgacaagggctggcccatcagcaagatggacatcggcgtccccctgctggccctcgggtgctactcccaggtgaacccgctgacgctgaccgccgcggtgctcatgctggtcgcccactacgccatcatcggccccgggctgcaggccaaggccacccgggaggcgcagaagcgcaccgccgccggcatcatgaagaaccccacggtggacgggatcgtggccatcgacctcgaccccgtcgtgtacgacgccaagttcgagaagcagctgggccagatcatgctgctcatcctgtgcaccagccagatcctgctcatgcgcaccacctgggcgctgtgcgagtccatcacgctggccaccggcccgctcaccaccctgtgggaggggagccccggcaagttctggaacacgaccatcgccgtgtccatggccaacatcttccgggggagctacctggccggcgcgggcctcgccttctccctgatgaagtccctcgggggcgggcgccgggggaccggggcccagggcgagaccctcggcgagaagtggaagcgccagctgaaccagctgagcaagtccgagttcaacacgtacaagcggagcgggatcatggaggtcgaccgctccgaggccaaggagggcctcaagcgcggggagaccaccaagcacgcggtgagccgcggcaccgccaagctgcggtggttcgtggagcgcaacctggtcaagcccgaggggaaggtgatcgacctgggctgcggccgcgggggctggtcctactactgcgccgggctcaagaaggtgacggaggtcaagggctacaccaagggcggccccggccacgaggagccgatccccatggccacctacgggtggaacctggtgaagctgtacagcggcaaggacgtgttcttcatcccgcccgagaagtgcgacaccctcctgtgcgacatcggggagtccagcccgaaccccacgatcgaggagggccgcaccctgcgggtcctcaagatggtggagccctggctgcgcgggaaccagttctgcatcaagatcctgaacccctacatgccgtccgtggtcgagaccctcgagcagatgcagcggaagcacggcggcatgctggtgcgcaaccccctgagccggaactccacccacgagatgtactgggtgagctgcgggaccggcaacatcgtctccgccgtgaacatgacgagccgcatgctcctgaaccggttcaccatggcgcaccgcaagcccacctacgagaaggacgtggacctgggggccggcacccgccacgtcgccgtggagcccgaggtggccaacctcgacatcatcggccagcggatcgagaacatcaagcacgagcacaagtccacgtggcactacgacgaggacaacccgtacaagacctgggcctaccacgggagctacgaggtcaagccctccggcagcgcgtccagcatggtgaacggggtcgtgaagctgctgaccaagccctgggacgtgatccccatggtcacccagatcgccatgacggacaccaccccgttcggccagcagcgcgtgttcaaggagaaggtggacacccggacgcccaaggccaagcgcgggaccgcccagatcatggaggtcaccgcccggtggctctggggcttcctgagccgcaacaagaagccccggatctgcacccgcgaggagttcacgcggaaggtgcgctccaacgcggccatcggcgccgtgttcatcgacgagaaccagtggaacagcgccaaggaggcggtcgaggacgagcggttctgggacctggtgcaccgcgagcgggagctccacaagcaggggaagtgcgcgacctgcgtgtacaacatgatgggcaagcgcgagaagaagctgggggagttcggcaaggccaaggggtcccgggccatctggtacatgtggctgggcgcccgcttcctcgagttcgaggcgctgggcttcatgaacgaggaccactggttcagccgggagaactccctgagcggggtcgagggcgaggggctccacaagctgggctacatcctgcgcgacatctccaagatcagcgggggcaacatgtacgccgacgacaccgccggctgggacacccggatcacggaggacgacctccagaacgaggccaagatcaccgacatcatggagccggagcacgccctgctggcgaaggccatcttcaagctcacctaccagaacaaggtggtgcgcgtccagcggcccgccaagaacgggaccgtgatggacgtgatctcccgccgcgaccagcggggcagcgggcaggtcggcacgtacggcctgaacaccttcaccaacatggaggcccagctgatccgccagatggagtccgaggggatcttcagcccctccgagctcgagacccccaacctggccgagcgggtgctggactggctcggcaagtacggggtggagcgcctgaagcggatggcgatcagcggcgacgactgcgtcgtgaagccgatcgacgaccgcttcgccacggccctgaccgccctcaacgacatggggaaggtgcggaaggacatcccccagtgggagccctccaagggctggaacgactggcagcaggtccccttctgcagccaccacttccaccagctgatcatgaaggacggccgcgagatcgtggtgccgtgccggaaccaggacgagctggtcgggcgcgcccgggtgtcccagggcgcggggtggagcctccgcgagaccgcctgcctgggcaagagctacgcccagatgtggcagctgatgtacttccaccggcgcgacctccggctggccgcgaacgccatctgctccgccgtgcccgtcgactgggtgcccaccagccgcacgacctggtccatccacgcccaccaccagtggatgaccaccgaggacatgctgagcgtgtggaaccgggtctggatcgaggagaacccctggatggaggacaagacgcacatctccagctgggaggacgtgccgtacctcgggaagcgcgaggaccagtggtgcggctccctgatcggcctgaccgcccgggcgacctgggccaccaacatccaggtggccatcaaccaggtccgccgcctcatcgggaacgagaactacctggactacatgaccagcatgaagcggttcaagaacgagtccgaccccgagggcgccctgtggtga

SEQ ID NO: 8977 - RNA, 9879 nt, synthetic construct
  misc_feature 1..9879: note = derived and/or modified CDS sequence (opt1) from DENV-1__FJ176779__SS-prME
  source 1..9879: mol_type = other RNA
agcgtgaccatgctgctcatgctgatgcccaccgcgctggccttccacctcaccacccggggcggggagccccacatgatcgtgagcaagcaggagcggggcaagagcctgctgttcaagacctccgcgggggtgaacatgtgcaccctcgtggccatggacctgggcgagctgtgcgaggacacgatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctcgcgccccacgtcggcctggggctggagacgcggaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtcaccccctccatggccatgcggtgcgtgggcatcggcagccgcgacttcgtggaggggctctccggcgccacgtgggtcgacgtggtgctggagcacgggagctgcgtcaccaccatggccaaggacaagcccaccctggacatcgagctcctgaagacggaggtgaccaaccccgcggtgctgcggaagctctgcatcgaggccaagatctccaacaccaccacggacagccgctgccccacccagggcgaggccaccctggtcgaggagcaggacgccaacttcgtgtgccggcgcaccttcgtggaccggggctgggggaacggctgcgggctgttcggcaaggggtccctcctgacgtgcgccaagttcaagtgcgtcaccaagctggagggcaagatcgtgcagtacgagaacctcaagtacagcgtgatcgtcaccgtgcacaccggcgaccagcaccaggtcgggaacgagtccacggagcacggcaccaccgcgaccatcacgccccaggcccccacgaccgagatccagctgaccgactacggggccctgaccctcgactgcagcccccgcacgggcctggacttcaacgagatggtgctgctcaccatgaaggagaagtcctggctggtgcacaagcagtggttcctggacctcccgctgccctggaccagcggggccagcacctcccaggagacgtggaaccggcaggacctgctcgtcaccttcaagaccgcccacgcgaagaagcaggaggtggtggtcctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtgatgtgcaccgggtccttcaagctggagaaggaggtggcggagacgcagcacggcaccgtcctggtgcagatcaagtacgagggcaccgacgccccctgcaagatccccttcagcacccaggacgagaagggggtgacgcagaacggccggctgatcaccgccaacccgatcgtcaccgacaaggagaagcccgtgaacatcgaggccgagccgcccttcggggagtcctacatcgtgatcggcgtcggcgagaaggcgctcaagctgagctggttcaagaaggggtccagcatcggcaagatgttcgaggccaccgcccgcggggcccggcgcatggccatcctgggcgacacggcgtgggacttcgggtccatcggcggcgtgttcaccagcgtggggaagctcgtccaccagatcttcggcaccgcctacggggtgctgttctccggcgtgagctggaccatgaagatcgggatcggcgtcctgctcacgtggctgggcctgaactcccgcagcacctccctcagcatgacctgcatcgccgtggggctggtgaccctgtacctcggcgtcatggtgcaggccgactccgggtgcgtgatcaactggaagggccgggagctgaagtgcgggagcggcatcttcgtcacgaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcaccgtcgtggtgggggacgtcgccggcatcctggcgcaggggaagaagatgatccggccccagcccatggagcacaagtacagctggaagaactggggcaaggccaagatcatcggcgccgacgtgcagaactccacgttcatcatcgacgggcccaacaccccggagtgcagcgacgaccagcgcgcctggaacatctgggaggtggaggactacggcttcgggatcttcaccaccaacatctggctgaagctccgggactcctacacgcaggtctgcgaccaccgcctgatgagcgcggccatcaaggactccaaggccgtgcacgccgacatgggctactggatcgagagcgagaagaacgagacctggaagctggcccgggcgtccttcatcgaggtgaagacctgcatctggcccaagagccacaccctctggtccaacggcgtcctggagagcgagatgatcatccccaagatctacgggggccccatctcccagcacaactaccgcccggggtacttcacgcagaccgccggcccctggcacctggggaagctcgagctggacttcgacctgtgcgagggcaccaccgtggtggtcgacgagcactgcggcaaccgggggcccagcctccgcacgaccaccgtgaccggcaagatcatccacgagtggtgctgccggtcctgcacgctgccgcccctgcgcttccgcggggaggacggctgctggtacgggatggagatccgccccgtgaaggagaaggaggagaacctcgtcaagagcatggtgagcgccggctccggcgaggtggacagcttctccctggggctgctctgcatcagcatcatgatcgaggaggtcatgcggtcccgctggagccggaagatgctgatgaccggcaccctggccgtgttcttcctcctgatcatggggcagctgacctggaacgacctcatccgcctgtgcatcatggtgggcgccaacgcgtccgaccgcatggggatgggcacgacctacctggccctcatggccaccttcaagatgcggcccatgttcgccgtcggcctgctgttccgccggctcaccagccgcgaggtgctgctgctcacgatcgggctgtccctggtcgccagcgtggagctcccgaactccctggaggagctgggcgacgggctcgcgatgggcatcatgatcctgaagctgctcaccgacttccagagccaccagctgtgggccaccctgctctccatgaccttcatcaagacgaccttcagcctgcactacgcctggaagaccatggccatggtgctgtccatcgtcagcctcttccccctgtgcctgtccaccacgagccagaagaccacctggctccccgtgctgctgggctccctcgggtgcaagcccctgaccatgttcctgatcgcggagaacaagatctggggccgcaagagctggccgctcaacgaggggatcatggccgtgggcatcgtcagcatcctgctgtccagcctcctgaagaacgacgtgcccctggccgggcccctcatcgccggcggcatgctgatcgcctgctacgtgatctccgggagctccgcggacctgagcctcgagaaggccgccgaggtctcctgggaggaggaggccgagcacagcggcgcctcccacaacatcctggtggaggtgcaggacgacgggacgatgaagatcaaggacgaggagcgggacgacaccctgaccatcctcctgaaggcgaccctgctcgccgtcagcggcgtgtaccccctgtccatcccggccaccctgttcgtgtggtacttctggcagaagaagaagcagcggagcggggtcctctgggacacgcccagcccgcccaaggtggagcgcgccgtgctggacgacggcatctaccggatcatgcagcgcggcctgctggggcggagccaggtcggcgtgggggtgttccaggagaacgtcttccacaccatgtggcacgtgacccgcggcgccgtgctcatgtaccaggggaagcggctggagccgtcctgggcgagcgtcaagaaggacctgatctcctacggcggcgggtggcgcctccagggcagctggaacaccggggaggaggtccaggtgatcgccgtcgagcccggcaagaaccccaagaacgtgcagacggcccccgggaccttcaagaccccggagggcgaggtgggcgccatcgccctggacttcaagcccgggacctccggcagccccatcgtcaaccgggaggggaagatcgtgggcctgtacggcaacggggtggtcacgaccagcggcacctacgtgtccgcgatcgcccaggccaaggccagccaggaggggcccctcccggagatcgaggacgaggtgttccgcaagcggaacctgaccatcatggacctgcaccccggctccgggaagacgcgccggtacctccccgcgatcgtccgcgaggccatcaagcggaagatgcgcaccctgatcctggccccgacccgcgtggtggccagcgagatggccgaggcgctcaagggcatgcccatccggtaccagaccacggccgtcaagtccgagcacaccggcaaggagatcgtggacctgatgtgccacgccaccttcaccatgcgcctgctcagccccgtgcgggtccccaactacaacatgatcatcatggacgaggcccacttcacggacccgtccagcatcgccgcgcgcgggtacatctccacccgggtgggcatgggggaggccgccgccatcttcatgaccgccacgccgcccggcagcgtggaggcgttcccccagtccaacgccgtcatccaggacgaggagcgcgacatcccggagcggagctggaactccgggtacgagtggatcacggagttccccggcaagaccgtgtggttcgtgcccagcatcaaggccggcaacgacatcgccaactgcctgcgcaagaacgggaagcgggtcatccagctgtcccgcaagaccttcgacaccgagtaccagaagacgaagaacaacgactgggactacgtggtgaccaccgacatcagcgagatgggcgcgaacttccgggccgaccgcgtcatcgacccccggcgctgcctcaagccggtgatcctgaaggacgggcccgagcgggtcatcctggccggccccatgcccgtgaccgtggcctccgccgcgcagcgccgggggcgcatcggccggaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgcgagaagtccgccgcgatcgacggggagtaccgcctgcggggcgaggcccgcaagaccttcgtcgagctgatgcggcgcggggacctcccggtgtggctgtcctacaaggtggccagcgagggcttccagtacagcgaccggcgctggtgcttcgacggcgagcggaacaaccaggtcctggaggagaacatggacgtggagatctggaccaaggagggggagcgcaagaagctccggccccgctggctggacgcccggacgtactccgaccccctggccctccgcgagttcaaggagttcgcggccggccggcgcagcgtgtccggggacctgatcctggagatcggcaagctcccccagcacctgacccagcgggcccagaacgccctggacaacctcgtcatgctgcacaacagcgagcagggcgggcgcgcgtaccggcacgccatggaggagctgccggacaccatcgagaccctcatgctgctggccctcatcgccgtgctgacgggcggggtgaccctgttcttcctctccggcaaggggctgggcaagaccagcatcggcctgctctgcgtcatggcctccagcgtgctgctgtggatggcgtccgtggagccccactggatcgccgccagcatcatcctcgagttcttcctgatggtcctgctcatccccgagcccgaccgccagcggaccccgcaggacaaccagctggcctacgtggtgatcgggctcctgttcatgatcctgaccgtcgccgcgaacgagatgggcctgctcgagacgaccaagaaggacctggggatcggccacgtggccgtggagaaccaccaccacgccgccatgctggacgtcgacctccaccccgcctccgcgtggaccctgtacgccgtggccaccacgatcatcacccccatgatgcgccacaccatcgagaacaccacggccaacatcagcctgaccgccatcgcgaaccaggccgccatcctcatggggctggacaagggctggccgatctccaagatggacatcggcgtgcccctgctcgccctggggtgctacagccaggtcaaccccctgaccctcaccgcggccgtgctgatgctggtggcccactacgccatcatcggccccgggctccaggccaaggcgacgcgggaggcccagaagcgcaccgccgccggcatcatgaagaacccgaccatcgacgggatcgtcgccatcgacctggaccccgtggtgtacgacgcgaagttcgagaagcagctgggccagatcatgctcctgatcctgtgcacctcccagatcctcctgatgcgcacgacctgggccctgtgcgagagcatcaccctcgccaccggccccctgacgaccctgtgggaggggtcccccggcaagttctggaacaccaccatcgccgtcagcatggccaacatcttccgggggtcctacctcgcgggcgccggcctggccttcagcctgatgaagtccctcgggggcgggcgccggggcacgggggcccagggcgagaccctgggcgagaagtggaagcgccagctgaaccagctctccaagagcgagttcaacacctacaagcggtccgggatcatggaggtggaccgcagcgaggcgaaggagggcctgaagcgcggggagaccacgaagcacgccgtgtcccgcggcaccgccaagctgcggtggttcgtcgagcgcaacctcgtgaagccggaggggaaggtgatcgacctgggctgcggccgcggcgggtggagctactactgcgccgggctgaagaaggtcaccgaggtgaaggggtacaccaagggcggccccggccacgaggagcccatccccatggccacgtacgggtggaacctggtgaagctccactccggcaaggacgtcttcttcatcccgcccgagaagtgcgacaccctgctgtgcgacatcggggagagctcccccaaccccaccatcgaggagggccgcaccctccgggtgctgaagatggtggagccgtggctgcgcgggaaccagttctgcatcaagatcctcaacccctacatgcccagcgtcgtggagacgctggagcagatgcagcggaagcacggcggcatgctggtgcgcaaccccctctcccggaacagcacccacgagatgtactgggtctcctgcgggaccggcaacatcgtgagcgcggtgaacatgacctcccgcatgctgctgaaccggttcaccatggcccaccgcaagccgacgtacgagcgcgacgtcgacctcggggccggcacccggcacgtggccgtggagcccgaggtcaccaacctggacatcatcggccagcgcatcgagaacatcaagtacgagcacaagagcacctggcactacgacgaggacaacccctacaagacgtgggcctaccacgggtcctacgaggtgaagcccagcggctccgcgagcagcatggtcaacggggtggtgaagctgctcaccaagccgtgggacgtcatccccatggtgacccagatcgccatgaccgacacgacccccttcggccagcagcgggtgttcaaggagaaggtcgacacccgcacccccaaggccaagcgggggacggcccagatcatggaggtgaccgcccgctggctgtggtccttcctgagccggaacaagaagccgcgcatctgcacccgggaggagttcacccgcaaggtgcggtccaacgcggccatcggcgccgtcttcgtggacgagaaccagtggaacagcgccaaggaggcggtggaggacgaccgcttctgggacctcgtccaccgggagcgcgagctgcacaagcagggcaagtgcgccacgtgcgtgtacaacatgatggggaagcgggagaagaagctgggcgagttcgggaaggccaagggctcccgcgccatctggtacatgtggctcggggcccggttcctggagttcgaggcgctgggcttcatgaacgaggaccactggttcagccgcgagaactccctcagcggcgtggagggggagggcctgcacaagctggggtacatcctccgggacatctccaagatccccggcgggaacatgtacgccgacgacaccgccggctgggacacccgcatcaccgaggacgacctgcagaacgaggccaagatcacggacatcatggagcccgagcacgccctgctcgccaagagcatcttcaagctgacctaccagaacaaggtcgtgcgggtgcagcgcccggccaagaacggcaccgtcatggacgtgatctcccgccgggaccagcgcgggagcggccaggtggggacctacggcctgaacacgttcaccaacatggaggcccagctcatccggcagatggagtccgagggcatcttcagccccaacgagctggagacccccaacctggccgagcgcgtcctcgactggctggagaagtacggggtggagcggctgaagcgcatggccatctccggcgacgactgcgtggtcaagcccatcgacgaccggttcgcgaccgccctcacggccctgaacgacatggggaaggtgcgcaaggacatcccgcagtgggagcccagcaagggctggaacgactggcagcaggtccccttctgctcccaccacttccaccagctgatcatgaaggacgggcgggagatcgtcgtgccctgccgcaaccaggacgagctcgtgggccgggcccgcgtcagccagggcgccgggtggagcctgcgggagaccgcgtgcctgggcaagtcctacgcccagatgtggcagctcatgtacttccaccgccgggacctgcgcctggccgccaacgcgatctgcagcgccgtgccggtggactgggtccccacctcccggaccacgtggagcatccacgcccaccaccagtggatgaccaccgaggacatgctctccgtgtggaaccgcgtgtggatcgaggagaacccctggatggaggacaagacccggatcagctcctgggaggacgtcccctacctggggaagcgcgaggaccagtggtgcggcagcctgatcgggctcacggcccgcgccacctgggcgaccaacatccaggtggccatcaaccaggtgcggcgcctgatcggcaacgagaactactccgactacatgaccagcatgaagcggttcaagaacgagtccgagccggagggcgccctgtggtga

SEQ ID NO: 8978 - RNA, 9879 nt, synthetic construct
  misc_feature 1..9879: note = derived and/or modified CDS sequence (opt1) from DENV-1__FJ176780__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccggatcaccgaggccgagcccgacgacgtggactgctggtgcaacgccaccgacacctgggtgacctacgggacctgcagccagaccggcgagcaccggcgggacaagcggtccgtggccctcgcgccccacgtgggcctggggctggagacgcgcaccgagacctggatgagctccgagggcgcctggaagcagatccagcgggtcgagacctgggccctccggcaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggcgggcatcctcgcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctgcgggacagctacacccaggtgtgcgaccaccgcctcatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcaccctggccgtgttcttcctgctcatcatggggcagctgacgtggaacgacctgatccgcctctgcatcatggtcggcgcgaacgccagcgaccgcatggggatgggcaccacctacctggccctgatggccaccttcaagatgcggccgatgttcgccgtgggcctcctgttccgccggctgacgtcccgcgaggtgctcctgctgaccatcgggctcagcctggtcgcgtccgtggagctgcccaccagcctcgaggagctgggcgacgggctggccatgggcatcatgatcctcaagctgctgaccgacttccagtcccaccagctctgggccacgctgctgagcctcaccttcgtcaagaccaccttctccctgcactacgcctggaagacgatggcgatggtgctgagcatcgtgtccctcttccccctgtgcctgagcaccacctcccagaagaccacgtggctccccgtcctgctgggcagcctcgggtgcaagccgctgaccatgttcctgatcgccgagaacaagatctggggccggcgctcctggcccctcaacgaggggatcatggccgtgggcatcgtgagcatcctgctgagctccctcctgaagaacgacgtccccctggccgggcccctcatcgccggcggcatgctgatcgcgtgctacgtgatcagcgggtccagcgccgacctgtccctcgagaaggccgccgaggtgagctgggaggaggaggccgagcactccggcgcgagccacaacatcctggtcgaggtgcaggacgacgggaccatgaagatcaaggacgaggagcgggacgacaccctgaccatcctcctgaaggccacgctgctcgccgtgtccggcgtctacccgctgagcatccccgccaccctgttcgtgtggtacttctggcagaagaagaagcagcgctccggggtgctctgggacacccccagcccgcccgaggtcgagcgggccgtgctggacgacggcatctaccgcatcatgcagcggggcctgctggggcgctcccaggtgggcgtcggggtgttccaggagaacgtgttccacaccatgtggcacgtcacgcggggcgcggtgctcatgtaccaggggaagcgcctggagcccagctgggcctccgtgaagaaggacctgatcagctacggcggcgggtggcggctccagggctcctggaacaccggggaggaggtccaggtgatcgccgtggagcccggcaagaaccccaagaacgtccagaccgcccccgggaccttcaagacgcccgagggcgaggtgggcgccatcgcgctggacttcaagcccgggaccagcggctcccccatcgtgaaccgcgaggggaagatcgtcggcctgtacggcaacggggtggtgaccaccagcggcacgtacgtcagcgccatcgcccaggccaaggcgtcccaggaggggccgctccccgagatcgaggacgaggtgttccggaagcgcaacctgaccatcatggacctgcaccccggcagcgggaagacccggcgctacctcccggccatcgtgcgggaggccatcaagcgcaagctgcgcaccctgatcctcgcccccacgcgggtcgtggcctccgagatggcggaggccctgaagggcatgcccatccgctaccagaccaccgccgtcaagagcgagcacaccggcaaggagatcgtcgacctgatgtgccacgccacgttcaccatgcggctcctgtcccccgtgcgcgtgccgaactacaacatgatcatcatggacgaggcccacttcaccgaccccagctccatcgcggcccgggggtacatcagcacccgcgtcggcatgggggaggccgccgccatcttcatgacggcgacgccgcccggctccgtggaggccttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctctcccggaagacgttcgacaccgagtaccagaagaccaagaacaacgactgggactacgtcgtgaccacggacatcagcgagatgggcgcgaacttccgcgccgaccgggtgatcgacccgcgccggtgcctgaagcccgtcatcctgaaggacgggcccgagcgcgtgatcctcgccggccccatgccggtcaccgtggcctccgccgcgcagcggcgcgggcggatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgcgagaagtccgccgcgatcgacggggagtaccggctgcgcggcgaggcccggaagacgttcgtggagctcatgcgccgcggggacctgcccgtctggctgtcctacaaggtggccagcgagggctaccagtacagcgaccgccggtggtgcttcgacggcgagcgcaacaaccaggtgctcgaggagaacatggacgtcgagatctggaccaaggagggggagcggaagaagctgcgcccccggtggctggacgcccgcacctactccgaccccctcgccctgcgggagttcaaggagttcgcggccggccgccggagcgtgtccggggacctgatcctcgagatcggcaagctgccgcagcacctgacccagcgcgcccagaacgccctcgacaacctggtgatgctgcacaacagcgagcagggcgggcgggcgtaccgccacgccatggaggagctccccgacacgatcgagaccctgatgctgctcgccctgatcgccgtcctgaccggcggggtgaccctcttcttcctgtccggccgggggctgggcaagaccagcatcggcctcctgtgcgtgatggcctccagcgtcctgctctggatggcgtccgtggagccccactggatcgccgccagcatcatcctggagttcttcctgatggtgctcctgatccccgagccggaccgccagcggacgccccaggacaaccagctggcctacgtcgtgatcgggctcctgttcatgatcctgaccgtggccgcgaacgagatgggcctcctggagaccaccaagaaggacctggggatcggccacgtcgccgtggagaaccaccaccacgccgccatgctcgacgtggacctgcaccccgcctccgcgtggacgctgtacgccgtcgccaccaccatcatcaccccgatgatgcgccacacgatcgagaacaccaccgccaacatcagcctcaccgccatcgcgaaccaggccgccatcctgatggggctggacaagggctggcccatctccaagatggacatcggcgtgcccctcctggccctggggtgctacagccaggtgaaccccctcacgctgaccgcggccgtcctgatgctcgtggcccactacgccatcatcggcccggggctgcaggccaaggcgacccgcgaggcccagaagcggaccgccgccggcatcatgaagaaccccacggtggacgggatcgtcgccatcgacctggaccccgtggtgtacgacgcgaagttcgagaagcagctcggccagatcatgctgctgatcctctgcacctcccagatcctgctgatgcgcaccacctgggccctctgcgagagcatcacgctggccaccggccccctgaccaccctctgggaggggtccccgggcaagttctggaacacgaccatcgccgtcagcatggccaacatcttccgggggtcctacctggcgggcgccggcctggccttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtggaccgcagcgaggcgaaggagggcctgaagcgcggggagaccaccaagcacgccgtgtcccgcggcaccgccaagctccggtggttcgtcgagcgcaacctggtgaagcccgaggggaaggtgatcgacctgggctgcggccgcgggggctggagctactactgcgccgggctgaagaaggtcacggaggtgaagggctacaccaagggcggccccggccacgaggagcccatcccgatggccacctacgggtggaacctcgtgaagctgcactccggcaaggacgtcttcttcatcccgcccgagaagtgcgacaccctgctctgcgacatcggggagagctcccccaacccgacgatcgaggagggccgcaccctgcgggtgctgaagatggtggagccctggctccgcgggaaccagttctgcatcaagatcctgaacccctacatgcccagcgtcgtggagaccctggagcagatgcagcggaagcacggcggcatgctcgtgcgcaacccgctgtcccggaacagcacccacgagatgtactgggtctcctgcgggaccggcaacatcgtgagcgcggtgaacatgacgtcccgcatgctgctcaaccgcttcaccatggcccaccggaagcccacctacgagcgcgacgtcgacctgggggccggcacccggcacgtggccgtggagcccgaggtcacgaacctggacatcatcggccagcgcatcgagaacatcaagcacgagcacaagagcacctggcactacgacgaggacaacccctacaagacctgggcctaccacgggtcctacgaggtgaagccgagcggctccgcgagcagcatggtcaacggggtggtgaagctcctgaccaagccctgggacgtcatccccatggtgacgcagatcgccatgaccgacaccacccccttcggccagcagcgggtgttcaaggagaaggtcgacacgcgcaccccgaaggccaagcgggggaccgcccagatcatggaggtgaccgccaagtggctgtggggcttcctctcccgcaacaagaagccccggatctgcacgcgcgaggagttcacccggaaggtgcgcagcaacgcggccatcggcgccgtcttcgtggacgagaaccagtggaactccgccaaggaggcggtggaggacgagcggttctgggacctggtccaccgcgagcgggagctgcacaagcaggggaagtgcgcgacctgcgtgtacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacgcggatcaccgaggacgacctgcagaacgaggcccgcatcaccgacatcatggagccggagcacgccctcctggcgaagtccatcttcaagctgacctaccagaacaaggtcgtgcgcgtgcagcggcccgccaagaacgggacggtcatggacgtgatcagccgccgggaccagcgcggctccggccaggtggggacctacggcctcaacaccttcaccaacatggaggcccagctgatccggcagatggagagcgaggggatcttctcccccagcgagctggagacgcccaacctcgccgagcgcgtcctggactggctggagaagtacggcgtggagcggctcaagcgcatggccatctccggggacgactgcgtggtcaagccgatcgacgaccggttcgcgaccgccctgaccgccctgaacgacatgggcaaggtgcgcaaggacatcccccagtgggagcccagcaaggggtggaacgactggcagcaggtccccttctgctcccaccacttccaccagctcatcatgaaggacggccgggagatcgtcgtgccgtgccgcaaccaggacgagctggtgggccgggcccgcgtcagccagggggccggctggagcctgcgggagaccgcgtgcctcgggaagtcctacgcccagatgtggcagctgatgtacttccaccgccgggacctgcgcctcgccgccaacgcgatctgcagcgccgtgcccgtggactggatccccacgtcccggaccacctggagcatccacgcccaccaccagtggatgaccacggaggacatgctgtccgtctggaaccgcgtgtggatcgaggagaacccctggatggaggacaagacccacatcagctcctggggcgacgtgccgtacctggggaagcgcgaggaccagtggtgcggcagcctcatcggcctgaccgcccgggccacctgggcgaccaacatccaggtcgccatctaccaggtgcgccggctgatcgggaacgagaactacctcgactacatgacgtccatgaagcgcttcaagaacgagagcgaccccgagggcgccctgtggtga

SEQ ID NO: 8979 - RNA, 9879 nt, synthetic construct
  misc_feature 1..9879: note = derived and/or modified CDS sequence (opt1) from DENV-1__JN205310__SS-prME
  source 1..9879: mol_type = other RNA
agcgtgaccgtgctgttcatgctcctgcccaccgccctggccttccacctcaccaccctgggcggggagccccacatgatcgtgagcaagcaggagcgcggcaagagcctcctgttcaagacctccgcgggggtgaacatgtgcaccctgatcgccatggacctgggcgagctctgcgaggacaccatgacctacaagtgcccccggatcaccgagaccgagcccgacgacgtggactgctggtgcaacgccaccgagacctgggtgacctacgggacctgcagccagaccggcgagcaccgccgggacaagcgctccgtggccctggcgccccacgtcggcctggggctcgagacccggaccgagacctggatgagctccgagggcgcctggaagcagatccagaaggtggagacgtgggccctgcgccaccccgggttcaccgtgatcgccctgttcctcgcccacgcgatcggcaccagcatcacccagaaggggatcatcttcatcctgctgatgctcgtgacgccctccatggccatgcggtgcgtgggcatcggcaaccgcgacttcgtggaggggcccagcggcgccacctgggtcgacgtggtgctggagcacgggtcctgcgtcaccaccatggccaagaacaagcccacgctggacatcgagctcctgaagaccgaggtgaccaacccggccatcctgcggaagctctgcatcgaggcgaagatcagcaacaccacgaccgactcccgctgccccacccagggcgaggccaccctggtggaggagcaggacacgaacttcgtctgccggcgcaccttcgtggaccggggctgggggaacggctgcgggctgttcggcaaggggagcctcatcacgtgcgccaagttcaagtgcgtgaccaagctggagggcaagatcgtccagtacgagaacctgaagtactccgtgatcgtgacggtccacaccggcgaccagcaccaggtggggaacgagaccaccgagcacggcaccacggccatcatcacgccccaggcccccaccagcgagatccagctcaccgactacggggcgctgacgccggactgcagcccccgcaccggcctggacttcaacgagatggtcctcctgaccatgaaggagaagtcctggctggtgcacaagcagtggttcctcgacctgcccctgccctggacctccggggccagcacgagccaggagacctggaaccggcaggacctcctggtgaccttcaagaccgcccacgccaagaagcaggaggtcgtggtgctgggctcccaggagggcgccatgcacacggcgctcaccggggccaccgagatccagaccagcggcacgaccaccatcttcgccgggcacctgaagtgccgcctgaagatggacaagctcaccctgaagggcgtctcctacgtgatgtgcacggggagcttcaagctggagaaggaggtggccgagacccagcacggcaccgtcctcgtccaggtgaagtacgagggcaccgacgccccgtgcaagatcccctccagctcccaggacgagaagggggtcatccagaacggccggctgatcacggcgaaccccatcgtgaccgacaaggagaagcccgtgaacatcgaggccgagccgcccttcggggagagctacatcgtcgtgggcgccggcgagaaggccctgaagctgtcctggttcaagaaggggagctccatcggcaagatgttcgaggcgaccgcccgcggggcccggcgcatggccatcctcggcgacaccgcctgggacttcgggagcatcggcggcgtgttcacgtccgtcgggaagctggtgcaccagatcttcggcaccgcgtacggggtgctgttcagcggcgtctcctggaccatgaagatcgggatcggcatcctcctgacctggctgggcctcaacagccggtccacgagcctgtccatgacctgcatcgccgtggggatggtgaccctgtacctcggcgtcatggtgcaggccgacagcgggtgcgtgatcaactggaagggccgcgagctgaagtgcgggagcggcatcttcgtcaccaacgaggtgcacacgtggaccgagcagtacaagttccaggccgactcccccaagcgcctgagcgccgcgatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgtctccggcatcctggcccaggggaagaagatgatccggccccagccgatggagcacaagtacagctggaagtcctggggcaaggccaagatcatcggcgcggacgtgcagaacaccacgttcatcatcgacgggcccaacacccccgagtgccccgacaaccagcgcgcctggaacatctgggaggtggaggactacggcttcgggatcttcaccaccaacatctggctgaagctccgggacagcttcacgcaggtctgcgaccaccgcctgatgtccgccgccatcaaggacagcaaggcggtgcacgccgacatgggctactggatcgagtccgagaagaaggagacctggaagctggcccgggccagcttcatcgaggtgaagacctgcatctggccgaagtcccacaccctctggagcaacggcgtcctggagtccgagatgatcatccccaagatctacgggggccccgtgagccagcacaactaccgcccggggtacttcacgcagaccgccggcccctggcacctggggaagctcgagctggacttcgacctgtgcgagggcaccaccgtggtcgtggacgagaactgcggcaaccgggggccctccctccgcacgaccaccgtgaccggcaagacgacccacgagcggtgctgccgcagctgcaccctgcccccgctgcggttcaagcgcgaggacgggtgctggtacggcatggagatccggcccgtcaaggagaaggaggagaacctcgtgaagtccatggtgtccgcggggagcggcgaggtcgactccttcagcctgggcctgctctgcatctccatcatgatcgaggaggtgatgcgcagccggtggtcccgcaagatgctgatgaccgggacgctggccgtgttcctcctgctgaccatgggccagagcacctggaacgacctcatccggctgtgcaccatggtcggggccaacgcctccgacatgatgggcatggggacgacctacctggccctcatggcgaccttccgcatgcgccccatgttcgccgtgggcctgctgttccggcgcctcaccagccgggagatcctgctgctcacggtcggcctgtccctggtggccagcgtggagctccccaactccctggaggagctgggggacggcctcgccatggggatcatgatgctgaagctgctcaccgacttccagccgcaccagctgtgggccaccctgctcagcctgaccttcgtcaagacgaccctgtccctccactacgcgtggaagaccatggccatgatcctgagcatcgtgtccctgctccccctgtgcctgagcaccacgtcccagaagaccacctggctccccgtgctgctgggcagcctcggctgcaagcccctgaccatgttcctgatcaccgagaacaagatctgggggcgccggagctggccgctcaacgagggcatcatggccatcgggatcgtctccatcctgctgagcagccccctgaagaacgacgtgcccctggccggccccctgatcgccggcgggatgctcatcgcctgctacgtgatcagcgggtccagcgccgacctgtccctggagaaggccgccgaggtcagctgggaggacgaggcggagcactccggggccagccacaacatcctcgtggaggtgcaggacgacggcacgatgaagatcaaggacgaggagcgcgacgacaccctgaccatcctgctcaaggccaccctgctggtcatctccggggtgtacccgatgagcatccccgccaccctcttcgtgtggtacttctggcagaagaagaagcagcggtccggcgtcctgtgggacaccccctccccgcccgaggtggagcgcgccgtgctggacaacgggatctaccggatcctccagcgcggcctgctgggccggtcccaggtcggggtgggcgtgttccaggagggggtcttccacaccatgtggcacgtgacccgcggcgcggtgctgatgtaccaggggaagcggctcgagcccagctgggcctccgtcaagaaggacctgatcagctacggcggcgggtggcgcttccagggctcctggaacacgggggaggaggtccaggtgatcgccgtcgagcccggcaagaaccccaagaacgtgcagaccacccccgggaccttcaagacgcccgagggcgaggtgggcgccatcgccctggacttcaagcccgggaccagcggcagcaccatcgtcaaccgggaggggaagatcgtgggcctctacggcaacggggtggtcaccacgtccggcacctacgtgagcgcgatcgcccaggccaaggcctcccaggaggggccgctgcccgagatcgaggacgaggtgttccgcaagcggaacctgaccatcatggacctccaccccggcagcgggaagacccgccggtacctgcccgccatcgtccgcgaggcgatcaagcggaagctgcgcacgctcgtgctggccccgacccgcgtggtcgcctccgagatggccgaggcgctgaagggcatgcccatccggtaccagaccaccgccgtcaagagcgagcacacgggcaaggagatcgtggacctcatgtgccacgccaccttcaccatgcgcctgctgtcccccgtccgggtgcccaactacaacatgatcatcatggacgaggcccacttcaccgacccggccagcatcgcggcccgcgggtacatctccacgcgggtgggcatgggggaggccgccgccatcttcatgaccgcgacgccgcccggcagcgtcgaggccttcccccagtccaacgccgtgatccaggacgaggagcgcgacatcccggagcggagctggaactccgggtacgagtggatcaccgacttccccggcaagacggtgtggttcgtccccagcatcaagtccggcaacgacatcgccaactgcctccgcaagaacgggaagcgggtggtgcagctgagccgcaagaccttcgacaccgagtaccagaagaccaagaacaacgactgggactacgtcgtgacgaccgacatctccgagatgggcgccaacttccgggcggaccgcgtcatcgacccccggcgctgcctgaagccggtgatcctcaaggacgggcccgagcgggtgatcctggccggccccatgcccgtcaccgtggccagcgccgcgcagcgccgggggcgcatcggccggaacccgaacaaggagggcgaccagtacgtgtacatggggcagcccctgaacaacgacgaggaccacgcccactggaccgaggccaagatgctcctggacaacatcaacacgcccgagggcatcatccccgccctgttcgagccggagcgcgagaagtccgccgcgatcgacggggagtaccgcctccggggcgaggcccgcaagaccttcgtcgagctgatgcggcgcggggacctgcccgtgtggctcagctacaaggtggccagcgagggcttccagtactccgaccggcgctggtgcttcgacggcgagcggaacaaccaggtcctggaggagaacatggacgtggagatctggaccaaggagggggagcgcaagaagctgcggccccgctggctcgacgcccggacctacagcgaccccctggccctgcgcgagttcaaggagttcgcggccggccggcgctccgtgagcggggacctcatcctggagatcggcaagctgccgcagcacctcaccctgaaggcccagaacgccctggacaacctcgtcatgctgcacaactccgagcagggcgggaaggcctaccggcacgcgatggaggagctgcccgacacgatcgagaccctcatgctgctggccctcatcgccgtgctgaccggcggggtgaccctgttcttcctcagcggccgcgggctgggcaagacgtccatcggcctgctctgcgtcatggccagctccgtgctgctgtggatggcgagcgtggagccccactggatcgccgcctccatcatcctcgagttcttcctgatggtcctgctcatcccggagcccgaccggcagcgcacgccccaggacaaccagctggcctacgtggtgatcgggctcctcttcatgatcctgaccgtcgccgcgaacgagatgggcctgctcgagaccacgaagaaggacctggggatcggccacgccgccgccgagaaccaccaccacgccgcgatgctggacgtggacctccaccccgccagcgcctggaccctgtacgccgtggccaccaccatcatcacgccgatgatgcggcacaccatcgagaacaccaccgcgaacatctccctgacggccatcgccaaccacgccgccatcctcatggggctggacaagggctggcccatcagcaagatggacatcggcgtccccctgctcgcgctggggtgctactcccaggtgaaccccctgaccctcaccgccgccgtgctgatgctggtcgcccactacgcgatcatcggcccggggctccaggccaaggccacccgcgaggcccagaagcggacggccgcgggcatcatgaagaaccccaccgtggacgggatcgtggccatcgacctggaccccgtcgtgtacgacgccaagatcgagaagcagctgggccagatcatgctcctgatcctgtgcaccagccagatcctcctgatgcgcaccacgtgggccctgtgcgagtccatcaccctcgccaccggccccctgaccacgctgtgggaggggagcccgggcaagttctggaacaccaccatcgcggtgtccatggccaacatcttccgcgggagctacctcgccggcgccggcctggccttcagcctgatgaagtccctcgggggcgggcggcgcggcaccggggcgcagggcgagacgctgggcgagaagtggaagcggcagctgaaccagctcagcaagtccgagttcaacatctacaagcgcagcgggatcatcgaggtcgaccggtccgaggccaaggagggcctgaagcgcggggagaccaccaagcacgccgtgagccggggcaccgccaagctgcgctggttcgtggagcggaacctcgtcaagcccgaggggaaggtgatcgacctgggctgcggccgcgggggctggtcctactactgcgcggggctgaagaaggtgacggaggtcaagggctacaccaagggcgggcccggccacgaggagcccatcccgatggccacctacgggtggaacctggtgaagctccacagcggcaaggacgtgttcttcacgccgcccgagaagtgcgacaccctgctgtgcgacatcggggagtccagccccaacccgacgatcgaggagggccggaccctccgcgtcctgaagatggtggagccctggctgcgggggaaccagttctgcatcaagatcctcaacccctacatgccctccgtggtcgagaccctggagcagatgcagcgcaagcacggcggcatgctggtgcggaacccgctcagccgcaactccacccacgagatgtactgggtgagctgcgggacgggcaacatcgtctccgccgtgaacatgaccagccggatgctgctgaaccgcttcaccatggcccaccggaagcccacctacgagcgcgacgtggacctcggggccggcacgcgccacgtcgcggtggagcccgaggtcgccaacctggacatcatcggccagcggatcgagaacatcaagaacgagcacaagtccacctggcactacgacgaggacaacccctacaagacctgggcctaccacgggagctacgaggtgaagccgtccggcagcgccagctccatggtgaacggggtcgtgcgcctgctcaccaagccctgggacgtgatccccatggtcacgcagatcgccatgaccgacaccaccccgttcggccagcagcgggtgttcaaggagaaggtggacacgcgcacccccaaggcgaagcgggggaccgcccagatcatggaggtcaccgcccgctggctgtggggcttcctgagccggaacaagaagccccgcatctgcacgcgggaggagttcacccgcaaggtgcggtccaacgccgccatcggcgcggtgttcgtcgacgagaaccagtggaacagcgccaaggaggccgtggaggacgagcgcttctgggacctcgtgcaccgggagcgcgagctgcacaagcaggggaagtgcgcgacctgcgtctacaacatgatgggccggcgcgagaagaagctgggggagttcggcaaggcgaaggggtcccgggccatctggtacatgtggctcggcgcccgcttcctggagttcgaggccctgggcttcatgaacgaggaccactggttcagccgggagaactccctcagcggggtggagggcgaggggcaccacaagctgggctacatcctgcgcgacatctccaagatccccgggggcaacatgtacgccgacgacaccgcgggctgggacacgcggatcaccgaggacgacctccagaacgaggccaagatcaccgacatcatggagccggagcacgccctgctggccaccagcatcttcaagctcacgtaccagaacaaggtggtccgcgtgcagcgccccgccaagaacgggaccgtgatggacgtcatctcccggcgcgaccagcggggcagcggccaggtgggcacctacggcctgaacaccttcacgaacatggaggcgcagctgatccgccagatggagtccgaggggatcttcagcccctccgagctcgagacccccaacctggccgagcgggtgttcgactggctggagaagcacggcatcgagcgcctcaagcggatggccatcagcggggacgactgcgtcgtgaagccgatcgacgaccgcttcgccaccgccctgaccgcgctgaacgacatgggcaaggtgcggaaggacatcccccagtgggagccgcccaaggggtggaacgactggcagcaggtcccgttctgctcccaccacttccaccagctcatcatgaaggacggccgcgagatcgtggtgccctgccggaaccaggacgagctggtcggccgcgcccgggtgagccagggggccggctggagcctgcgcgagacggcctgcctcgggaagtcctacgcccagatgtggcagctgatgtacttccaccggcgcgacctgcggctcgcggccaacgccatctgcagcgccgtgcccgtcgactgggtgcccacctcccgcaccacctggagcatccacgcgcaccaccagtggatgaccacggaggacatgctgtccgtgtggaaccgggtctggatcgaggagaacccgtggatggaggacaagacccacgtgagctcctgggaggacgtgccctacctgggcaagcgcgaggaccagtggtgcgggagcctcatcggcctgaccgcccgcgccacctgggccacgaacatccaggtcgccatcaaccaggtgcggcgcctgatcggcaacgagaactacctcgactacatgacctccatgaagcggttcaagaacgagagcgaccccgagggggcgctgtggtga

SEQ ID NO: 8980 - RNA, 9879 nt, synthetic construct
  misc_feature 1..9879: note = derived and/or modified CDS sequence (opt1) from DENV-1__HQ332182__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcacctcctacgtcatgtgcaccgggagcttcaagctggagaaggaggtggcggagacgcagcacggcaccgtgctggtccaggtgaagtacgagggcaccgacgccccctgcaagatccccttctccacccaggacgagaagggggtgacgcagaacggccggctcatcaccgccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccacggcccgcggggcccggcgcatggccatcctcggcgacaccgcgtgggacttcgggagcatcggcggcgtgttcacctccgtggggaagctggtccaccaggtgttcggcaccgcctacggggtgctgttcagcggcgtctcctggacgatgaagatcgggatcggcatcctcctgacctggctgggcctcaacagccgctccaccagcctgtccatgacctgcatcgccgtggggatggtgacgctgtacctcggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcacggtcgtggtgggggacgccaacggcatcctggcgcaggggaagaagatgatccggccccagcccatggagcacaagtactcctggaagtcctggggcaaggccaagatcatcggcgccgacatccagaacaccaccttcatcatcgacgggcccgacaccccggagtgccccgacgaccagcgcgcctggaacatctgggaggtcgaggactacggcttcgggatcttcacgaccaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtgaagacgtgcacctggcccaagagccacaccctctggtccaacggcgtcctggagagcgagatgatcatccccaagatctacgggggcccgatctcccagcacaactaccgccccgggtacttcacccagacggccggcccctggcacctggggaagctcgagctggacttcgacctgtgcgagggcaccaccgtggtggtcgacgagcactgcggcaaccgggggccgagcctccgcaccacgaccgtgaccggcaagatcatccacgagtggtgctgccggtcctgcaccctgccgcccctgcgcttccgcggggaggacggctgctggtacgggatggagatccgccccgtgaaggagaaggaggagaacctcgtccggagcatggtgtccgccggcagcggcgaggtggacagcttctccctggggatcctgtgcgtcagcatcatgatcgaggaggtgatgcgctcccggtggagccgcaagatgctcatgacgggcaccctggccgtgttcctgctcctgatcatggggcagctgacctggaacgacctcatccgcctgtgcatcatggtcggcgccaacgcgtccgaccggatggggatgggcaccacgtacctggccctcatggccaccttcaagatgcgcccgatgttcgccgtggggctgctgttccggcgcctcaccagccgggaggtgctgctgctcaccatcgggctgtccctggtcgccagcgtggagctccccaactccctggaggagctgggcgacgggctcgcgatgggcatcatgatgctgaagctgctcacggagttccagccccaccagctgtggaccaccctgctcagcctgaccttcatcaagacgaccctgtccctcgactacgcctggaagaccaccgccatggccctgagcatcgtctccctgttccccctctgcctgagcacgacctcccagaagaccacctggctgccggtgctcctgggcagcttcgggtgcaagcccctgaccatgttcctcatcacggagaacaagatctggggccgcaagtcctggcccatcaacgaggggatcatggcgatcggcatcgtgagcatcctgctgtccagcctcctgaagaacgacgtccccctggccgggccgctcatcgccggcggcatgctgatcgcctgctacgtgatcagcgggtccagcgccgacctgtccctcgagaaggcggccgaggtgagctgggagcaggaggccgagcactccggcaccagccacaacatcctggtcgaggtgcaggacgacgggaccatgcggatcaaggacgaggagaaggacgacaccctgacgatcctcctgaaggccaccctgctcgccgtgtccggcgtctaccccatgagcatccccgcgaccctgttcgtgtggtacttctggcagaagaagaagcagcgctccggggtgctgtgggacacccccagcccgcccgaggtcgagcgggccgtgctcgacgacggcatctaccgcatcctgcagcggggcctgctggggcgctcccaggtgggcgtcggggtgttccaggacggcgtgttccacacgatgtggcacgtcacccgcggggcggtgctcatgtaccagggcaagcgcctggagcccagctgggcctccgtgaagaaggacctgatcagctacggcgggggctggcggttccaggggtcctggaacaccggcgaggaggtccaggtgatcgccgtggagcccgggaagaacccgaagaacgtccagaccacgcccggcaccttcaagacccccgagggcgaggtgggggcgatcgccctcgacttcaagcccggcaccagcgggtccccgatcgtgaaccgcgagggcaagatcgtcggcctgtacgggaacggcgtggtgacgaccagcgggacctacgtctccgccatcgcccaggccaaggcgagccaggagggccccctgcccgagatcgaggacgaggtgttcaagaagcggaacctcaccatcatggacctgcacccggggagcggcaagacgcgccggtacctgcccgccatcgtgcgcgaggccatcaagcggaagctccgcaccctgatcctggcccccacccgcgtcgtggcgtccgagatggccgaggccctcaagggcatgcccatccggtaccagaccacggccgtcaagagcgagcacaccgggcgcgagatcgtcgacctgatgtgccacgccaccttcaccatgcggctgctctccccggtgcgcgtgcccaactacaacatgatcatcatggacgaggcgcacttcacggaccccgccagcatcgccgcccggggctacatctccacccgcgtcgggatgggcgaggccgcggccatcttcatgaccgccacgccgcccgggagcgtggaggccttcccccagtccaacgccgtgatccaggacgaggagcgggacatccccgagcgcagctggaactccggctacgactggatcacggacttccccggcaagaccgtctggttcgtgcccagcatcaagtccgggaacgacatcgcgaactgcctgcggaagaacggcaagcgcgtgatccagctgagccggaagaccttcgacaccgagtaccagaagacgaagaacaacgactgggactacgtcgtgaccaccgacatctccgagatgggggccaacttccgcgccgaccgggtgatcgacccccgccggtgcctcaagcccgtcatcctgaaggacggccccgagcgcgtgatcctggccgggccgatgcccgtgaccgtcgcgagcgccgcccagcggcgcggccggatcggccgcaaccagaacaaggagggggaccagtacgtgtacatgggccagcccctcaacaacgacgaggaccacgcccactggacggaggccaagatgctgctggacaacatcaacacccccgaggggatcatcccggccctcttcgagcccgagcgcgagaagtccgccgccatcgacggcgagtaccggctgcgcggggaggcccggaagaccttcgtcgagctgatgcgccggggcgacctccccgtgtggctgagctacaaggtggcctccgagggcttccagtacagcgaccgccggtggtgcttcgacggggagcgcaacaaccaggtcctggaggagaacatggacgtggagatctggaccaaggagggcgagcggaagaagctccgcccccggtggctggacgcgcgcacctactccgacccgctggccctccgggagttcaaggagttcgccgccgggcgccggagcgtgagcggcgacctgatcctggagatcggcaagctcccccagcacctgacgctgcgcgcccagaacgcgctcgacaacctggtcatgctgcacaactccgagcagggcgggaaggcctaccggcacgccatggaggagctccccgacaccatcgagaccctgatgctgctcgccctgatcgcggtgctgaccgggggcgtgaccctcttcttcctgagcgggaagggcctgggcaagacctccatcgggctcctgtgcgtcaccgccagctccgtgctgctctggatggccagcgtggagccccactggatcgccgcctccatcatcctggagttcttcctgatggtcctcctgatcccggagcccgaccgccagcggacgccccaggacaaccagctggcgtacgtggtgatcggcctcctgttcatgatcctgacggtcgccgccaacgagatggggctcctggagaccaccaagcgcgacctgggcatcgggcacgtggccgccgagaaccaccagcacgcgaccatgctcgacgtggacctgcggccggccagcgcctggacgctgtacgccgtcgccaccaccgtgatcacccccatgatgcgccacacgatcgagaacaccaccgcgaacatctccctcaccgccatcgccaaccaggccgccatcctgatgggcctggacaagggctggcccatcagcaagatggacatcggggtgcccctcctggcgctgggctgctactcccaggtcaacccgctcacgctgaccgccgccgtgctgatgctcgtggcccactacgcgatcatcgggcccggcctgcaggccaaggccacccgcgaggcccagaagcggaccgccgcggggatcatgaagaaccccacggtcgacggcatcgtggccatcgacctggaccccgtggtctacgacgccaagttcgagaagcagctcggccagatcatgctgctgatcctctgcgccagccaggtgctgctgatgcgcaccacctgggccctctgcgagtccatcaccctggcgacggggccgctgaccaccctctgggagggcagccccgggaagttctggaacaccacgatcgccgtgtccatggccaacatcttccggggcagctacctggccggcgccgggctggcgttctccctcatgaagtccctgggcgggggccgccgggggaccggcgcccagggcgagaccctgggggagaagtggaagcgccagctcaaccagctgtccaagagcgagttcaacacctacaagcggagcggcatcatggaggtcgaccgctccgaggccaaggaggggctgaagcggggcgagacgaccaagcacgccgtgagccgcgggaccgcgaagctccggtggttcgtggagcgcaacctggtcaagcccgagggcaaggtgatcgacctgggctgcgggcggggcgggtggtcctactactgcgccggcctgaagaaggtgaccgaggtcaaggggtacaccaagggcggccccgggcacgaggagccgatccccatggccacgtacggctggaacctcgtgaagctgcacagcgggaaggacgtgttcttcatgccgcccgagaagtgcgacaccctgctctgcgacatcggcgagtccagcccgaaccccaccatcgaggaggggcgcaccctgcgggtcctgaagatggtggagccctggctccgcggcaaccagttctgcatcaagatcctgaacccctacatgccgtccgtggtcgagacgctggagcagatgcagcggaagcacggcgggatgctcgtgcgcaaccccctgagccggaactccacccacgagatgtactgggtgagctgcggcaccgggaacatcgtctccgccgtgaacatgaccagccgcatgctgctcaaccgcttcacgatggcccaccggaagcccacctacgagcgcgacgtggacctgggcgcgggcacccggcacgtcgccgtggagcccgaggtggccaacctggacatcatcgggcagcgcatcgagaacatcaagaacgagcacaagtccacctggcactacgacgaggacaacccgtacaagacgtgggcctaccacggcagctacgaggtcaagccctccgggagcgcctccagcatggtgaacggcgtcgtgcggctcctgaccaagccctgggacgtgatccccatggtcacccagatcgcgatgaccgacacgaccccgttcgggcagcagcgcgtgttcaaggagaaggtggacacccggacgccccgggccaagcggggcacgacccagatcatggaggtcaccgccaagtggctgtggggcttcctctcccgcaacaagaagccccggatctgcacccgcgaggagttcacgcggaaggtgcgcagcaacgccgccgtgggggcggtcttcgtggacgagaaccagtggaacagcgccaaggaggccgtggaggacgagcggttctgggacctggtccaccgcgagcgggagctgcacaagcagggcaagtgcgcgacctgcgtgtacaacatgatggggaagcgcgagaagaagctcggcgagttcgggaaggcgaagggctcccgggccatctggtacatgtggctgggcgcccgcttcctggagttcgaggccctcgggttcatgaacgaggaccactggttcagccgggagaactccctgagcggcgtggagggggagggcctgcacaagctcgggtacatcctgcgcgacatctccaagatcccgggcggcaacatgtacgccgacgacaccgcggggtgggacacccgcatcacggaggacgacctgcagaacgaggccaagatcaccgacatcatggagcccgagcacgccctcctggccaccagcatcttcaagctgacctaccagaacaaggtcgtgcgggtgcagcgccccgccaagaacggcacggtcatggacgtgatctcccggcgcgaccagcgggggagcggccaggtgggcacctacgggctcaacaccttcaccaacatggaggtccagctgatccgccagatggagtccgagggcatcttcctgcccagcgagctcgagacgccgaacctggcggagcgggtgctggactggctcgagaagcacggggccgagcgcctgaagcggatggccatctccggcgacgactgcgtggtcaagcccatcgacgaccgcttcgccaccgccctgaccgcgctcaacgacatggggaaggtgcggaaggacatcccccagtgggagcccagcaagggctggaacgactggcagcaggtcccgttctgctcccaccacttccaccagctgatcatgaaggacggccgcgagatcgtcgtgccctgccggaaccaggacgagctggtggggcgcgcccgggtcagccagggcgccgggtggtccctccgcgagaccgcctgcctgggcaagagctacgcccagatgtggcagctgatgtacttccaccggcgcgacctccggctggcggccaacgccatctgctccgccgtgcccgtggactgggtccccaccagccgcacgacctggagcatccacgcgcaccaccagtggatgaccaccgaggacatgctgtccgtgtggaaccgcgtgtggatcgaggagaacccgtggatggaggacaagacgcacgtcagctcctgggaggaggtgccctacctcgggaagcgggaggaccagtggtgcggcagcctgatcggcctgaccgcccgcgccacctgggccaccaacatccaggtggccatcaaccaggtccggcgcctcatcgggaacgagaactacctggactacatgacgtccatgaagcggttcaagaacgagagcgaccccgagggcgcgctgtggtga

SEQ ID NO: 8981 - RNA, 9879 nt, synthetic construct
  misc_feature 1..9879: note = derived and/or modified CDS sequence (opt1) from DENV-1__HQ332181__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccaccgcccgcggggcgcgccgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccggtccaccagcctctccatgacctgcatcgccgtggggatggtgaccctgtacctgggcgtcatggtgcaggccgacagcgggtgcgtgatcaactggaagggccgcgagctcaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtcgtggtgggggacgccaacggcatcctcgtccaggggaagaagatgatccgcccccagcccatggagcacaagtactcctggaagtcctggggcaaggcgaagatcatcggcgccgacatccagaacacgaccttcatcatcgacgggcccgacaccccggagtgccccgacggccagcgggcctggaacatctgggaggtggaggactacgggttcggcgtgttcaccacgaacatctggctgaagctgcgcgactcctacacccagatgtgcgaccaccggctcatgagcgccgcgatcaaggactccaaggccgtccacgccgacatgggctactggatcgagagcgagaagaacgagacctggaagctggcccgcgcctccttcatcgaggtgaagacctgcacgtggcccaagagccacaccctgtggtccaacggggtgctcgagagcgagatgatcatccccaagatctacggcgggccgatctcccagcacaactaccggcccggctacttcacccagaccgcggggccctggcacctgggcaagctggagctcgacttcgacctgtgcgagggcacgaccgtcgtggtggacgagcactgcgggaaccgcggcccgagcctgcggaccaccacggtcaccgggaagatcatccacgagtggtgctgccgctcctgcaccctgccgcccctgcggttccgcggcgaggacgggtgctggtacggcatggagatccggcccgtgaaggagaaggaggagaacctggtgcgcagcatggtctccgccggcaccggggaggtggacagcttcagcctcggcatcctgtgcgtgtccatcatgatcgaggaggtcatgcggagccgctggtcccgcaagatgctgatgacggggaccctcgccgtgttcctgctgctcatcatgggccagctgacctggaacgacctgatccggctctgcatcatggtgggggccaacgccagcgaccgcatgggcatgggcaccacgtacctggcgctgatggccaccttcaagatgcggccgatgttcgccgtcgggctcctgttccgccggctgacctcccgcgaggtgctcctgctgaccatcggcctcagcctggtcgcctccgtggagctgcccaacagcctcgaggagctgggggacggcctggccatgggcatcatgatgctcaagctgctgacggagttccagccccaccagctctggaccaccctgctgtccctcaccttcgtgaagacggcgctgagcctggactacgcctggaagaccaccgccatggtcctctccatcgtgagcctgttccccctgtgcctctccaccacgagccagaagaccacctggctgccggtgctgctcgggtccttcggctgcaagcccctgaccatgttcctgatcaccgagaacaagatctgggggcgcaagagctggcccctcaacgagggcatcatggccatcgggatcgtctccatcctgctgagctccctcctgaagaacgacgtgcccctggcgggcccgctcatcgccggcgggatgctgatcgcctgctacgtgatcagcggcagctccgccgacctgagcctcgagaaggccgcggaggtctcctgggagcaggaggccgagcacagcggggcctcccacaacatcctggtggaggtgcaggacgacggcacgatgaagatcaaggacgaggagcgcgacgacaccctgaccatcctcctgaaggccaccctgctcgccgtcagcggggtgtaccccatgtccatccccgcgacgctgttcgtgtggtacttctggcagaagaagaagcagcggagcggcgtcctgtgggacaccccctccccgcccgaggtggagcgcgccgtgctcgacaacggcatctaccggatcctgcagcgcgggctgctgggccggagccaggtcggggtgggcgtgttccaggacggggtcttccacaccatgtggcacgtgacccgcggcgccgtgctcatgtaccagggcaagcggctggagccctcctgggccagcgtcaagaaggacctgatctcctacgggggcgggtggcgcttccagggcagctggaacacgggggaggaggtccaggtgatcgccgtcgagcccggcaagaacccgaagaacgtgcagaccacccccggcaccttcaagacgcccgagggggaggtgggcgcgatcgccctcgacttcaagcccgggacctccggcagcccgatcgtcaaccgggagggcaagatcgtggggctgtacggcaacggggtggtcaccacctccggcacgtacgtgagcgccatcgcccaggccaaggcgtcccaggaggggcccctgcccgagatcgaggacgaggtgttcaagaagcgcaacctcaccatcatggacctgcacccgggcagcggcaagacccggcgctacctgcccgccatcgtccgggaggccatcaagcgcaagctccgcaccctgatcctggcccccacgcgggtggtggcgagcgagatggccgaggccctcaaggggatgcccatccgctaccagaccaccgccgtcaagtccgagcacaccggccgggagatcgtggacctgatgtgccacgccacgttcaccatgcgcctgctcagcccggtgcgggtccccaactacaacatgatcatcatggacgaggcgcacttcaccgaccccgcctccatcgccgcccgcgggtacatcagcacccgggtgggcatgggggaggccgcggccatcttcatgacggccacgccgcccggctccgtggaggccttcccccagagcaacgccgtcatccaggacgaggagcgcgacatccccgagcggtcctggaacagcggctacgactggatcaccgacttccccgggaagaccgtgtggttcgtgccctccatcaagagcggcaacgacatcgcgaactgcctgcgcaagaacgggaagcgggtcatccagctgtcccgcaagacgttcgacaccgagtaccagaagaccaagaacaacgactgggactacgtggtgaccacggacatcagcgagatgggcgccaacttccgggccgaccgcgtcatcgacccccggcgctgcctcaagcccgtgatcctgaaggacgggcccgagcgggtcatcctggccggcccgatgcccgtgaccgtggcgtccgccgcccagcgccggggccgcatcgggcgcaaccagaacaaggagggcgaccagtacgtctacatggggcagcccctcaacaacgacgaggaccacgcccactggaccgaggccaagatgctgctggacaacatcaacacccccgagggcatcatcccggccctcttcgagcccgagcgggagaagtccgccgccatcgacggggagtaccgcctgcggggcgaggcccgcaagacgttcgtggagctgatgcggcgcggcgacctccccgtgtggctgtcctacaaggtcgccagcgaggggttccagtactccgaccggcgctggtgcttcgacggcgagcggaacaaccaggtgctggaggagaacatggacgtggagatctggaccaaggagggggagcgcaagaagctccggccccgctggctggacgcgcggacctacagcgacccgctggccctccgcgagttcaaggagttcgccgccggccggcgctccgtcagcggcgacctgatcctggagatcgggaagctcccccagcacctgaccctgcgggcccagaacgcgctcgacaacctggtgatgctgcacaacagcgagcagggcgggaaggcctaccgccacgccatggaggagctccccgacaccatcgagacgctgatgctgctcgccctgatcgcggtgctgaccggcggggtcaccctcttcttcctgtccggcaagggcctggggaagaccagcatcggcctcctgtgcgtgacggcctccagcgccctgctctggatggcctccgtggagccccactggatcgccgcgagcatcatcctggagttcttcctgatggtcctcctgatcccggagcccgaccggcagcgcacgccccaggacaaccagctggcctacgtggtgatcgggctcctgttcatgatcctgaccgtcgccgccaacgagatgggcctcctggagaccacgaagaaggacctggggatcggctacgtggccgcggagaaccaccagcacgccaccatgctcgacgtggacctgcacccggcctccgcctggaccctgtacgccgtcgcgaccacggtgatcacccccatgatgcggcacaccatcgagaacaccacggccaacatcagcctcaccgccatcgccaaccaggccgcgatcctgatgggcctggacaaggggtggcccatctccaagatggacatcggcgtgcccctcctggccctggggtgctacagccaggtcaacccgctcaccctgaccgccgccgtgctgatgctcgtggcgcactacgccatcatcggccccgggctgcaggccaaggccacgcgcgaggcccagaagcgcaccgcggccggcatcatgaagaaccccaccgtcgacggcatcgtggccatcgacctggaccccgtggtctacgacgccaagttcgagaagcagctcgggcagatcatgctgctgatcctctgcacctcccagatcctgctgatgcggacgacctgggccctctgcgagagcatcaccctggcgaccggcccgctgacgaccctctgggaggggtcccccggcaagttctggaacaccaccatcgccgtgagcatggccaacatcttccgcggctcctacctggccggggccggcctggcgttcagcctcatgaagtccctcgggggcgggcggcgcggcacgggcgcccagggggagaccctgggcgagaagtggaagcggcagctcaaccagctgagcaagtccgagttcaacacctacaagcgcagcgggatcatggaggtggaccggagcgaggccaaggagggcctgaagcgcggggagaccacgaagcacgccgtctcccggggcaccgcgaagctccgctggttcgtggagcggaacctggtgaagcccgagggcaaggtcatcgacctggggtgcggccgcgggggctggagctactactgcgccgggctgaagaaggtgaccgaggtgaagggctacaccaagggcgggcccggccacgaggagccgatccccatggccacctacgggtggaacctcgtcaagctgcactccggcaaggacgtgttcttcatgccgcccgagaagtgcgacacgctgctctgcgacatcggggagagctccccgaaccccaccatcgaggagggccggaccctgcgcgtgctgaagatggtcgagccctggctccggggcaaccagttctgcatcaagatcctgaacccctacatgccgagcgtggtggagaccctggagcagatgcagcgcaagcacgggggcatgctcgtccggaaccccctgtcccgcaacagcacgcacgagatgtactgggtgtcctgcgggaccggcaacatcgtgagcgccgtcaacatgacctcccggatgctgctcaaccgcttcaccatggcccaccgcaagcccacgtacgagcgggacgtggacctgggcgcggggacccgccacgtggccgtcgagcccgaggtggccaacctggacatcatcggccagcggatcgagaacatcaagaacgagcacaagagcacctggcactacgacgaggacaacccgtacaagacctgggcctaccacgggtcctacgaggtcaagcccagcggctccgccagctccatggtgaacggggtggtccgcctcctgacgaagccctgggacgtgatccccatggtgacccagatcgcgatgaccgacaccacgccgttcggccagcagcgggtcttcaaggagaaggtggacacccgcacgccccgggccaagcgcggcaccacgcagatcatggaggtgaccgccaagtggctgtgggggttcctcagccggaacaagaagccccgcatctgcacccgggaggagttcacccgcaaggtccggtccaacgccgccatcggcgcggtgttcgtggacgagaaccagtggaacagcgccaaggaggccgtcgaggacgagcgcttctgggacctggtgcaccgggagcgcgagctgcacaagcaggggaagtgcgccacgtgcgtgtacaacatgatgggcaagcgggagaagaagctcggggagttcggcaaggcgaagggcagccgcgccatctggtacatgtggctgggggcccggttcctggagttcgaggccctcggcttcatgaacgaggaccactggttctcccgcgagaacagcctgtccggggtcgagggcgaggggctgcacaagctcggctacatcctgcgggacatcagcaagatcccgggcgggaacatgtacgccgacgacaccgcgggctgggacacccgcatcaccgaggacgacctgcagaacgaggccaagatcacggacatcatggagcccgagcacgccctcctggccacctccatcttcaagctgacctaccagaacaaggtggtgcgcgtccagcggcccgccaagaacgggaccgtgatggacgtgatcagccgccgggaccagcgcggctccggccaggtcgggacgtacggcctcaacaccttcaccaacatggaggtgcagctgatccggcagatggagagcgaggggatcttcctgccctccgagctcgagaccccgaacctggcggagcgcgccctggactggctcgagaagcacggcgccgagcggctgaagcgcatggccatcagcggggacgactgcgtggtcaagcccatcgacgaccggttcgccacggcgctgaccgccctcaacgacatgggcaaggtgcgcaaggacatcccccagtgggagccctccaagggctggaacgactggcagcaggtcccgttctgcagccaccacttccaccagctgatcatgaaggacgggcgggagatcgtcgtgccctgccgcaaccaggacgagctggtgggccgggcccgcgtctcccagggggccggctggagcctccgggagaccgcctgcctggggaagtcctacgcgcagatgtggcagctgatgtacttccaccgccgggacctccgcctggccgccaacgccatctgcagcgcggtgcccgtggactgggtccccacctcccggaccacgtggagcatccacgcccaccaccagtggatgaccaccgaggacatgctgagcgtgtggaaccgcgtgtggatcgaggagaacccgtggatggaggacaagacccacgtctccagctgggaggaggtgccctacctcggcaagcgcgaggaccagtggtgcggctccctgatcgggctgacggcccgggccacctgggccaccaacatccaggtggcgatcaaccaggtccgccggctcatcggcaacgagaactacctggactacatgaccagcatgaagcgcttcaagaacgagtccgacagcgagggggccctgtggtga

SEQ ID NO: 8982 - RNA, 9879 nt, synthetic construct
  misc_feature 1..9879: note = derived and/or modified CDS sequence (opt1) from DENV-1__HQ332180__SS-prME
  source 1..9879: mol_type = other RNA
agcgtgaccatgctgctcatgctgctgcccaccgccctcgccttccacctgaccacccgcggcggggagccccacatgatcatcagcaagcaggagcggggcaagagcctgctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtcgccctggcgccccacgtgggcctggggctcgagacccgcaccgagacctggatgagctccgagggcgcctggaagcagatccagcgggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtgggcatcggcaaccgcgacttcgtcgaggggctgagcggcgccacgtgggtggacgtggtcctggagcacgggtcctgcgtgaccaccatggccaagaacaagcccaccctcgacatcgagctgctgaagacggaggtgaccaaccccgcggtcctccggaagctgtgcatcgaggccaagatcagcaacaccaccacggactcccgctgcccgacccagggcgaggccaccctggtggaggagcaggacgccaacttcgtgtgccggcgcaccttcgtcgaccggggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccgcaccggcctggacttcaacgagatggtgctcctgacgatgaaggagaagtcctggctggtccacaagcagtggttcctcgacctgccgctgccctggacctccggggccagcaccagccaggagacctggaaccggcaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtgatgtgcaccgggagcttcaagctggagaaggaggtcgcggagacccagcacggcacggtgctggtgcaggtcaagtacgagggcaccgacgccccctgcaagatccccttctccacccaggacgagaagggggtgacccagaacggccggctcatcacggccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtcttcacctccgtggggaagctggtgcaccaggtcttcggcaccgcctacggggtgctgttcagcggcgtgtcctggaccatgaagatcgggatcggcatcctcctgacgtggctgggcctcaacagccgctccaccagcctgtccatgacctgcatcgccgtcgggatggtgaccctgtacctcggcgccatggtgcaggccgacagcgggtgcgtcatcaactggaagggccgggagctgaagtgcgggtccggcatcttcgtgacgaacgaggtgcacacctggaccgagcagtacaagttccaggcggacagcccgaagcgcctgagcgccgccatcggcaaggcctgggaggagggggtctgcggcatccggtccgccacccgcctcgagaacatcatgtggaagcagatcagcaacgagctgaaccacatcctgctcgagaacgacatgaagttcaccgtggtggtcggggacgcgaacggcatcctggcccaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcgtggaacatctgggaggtggaggactacgggttcggcatcttcaccacgaacatctggctgaagctccgggactcctacacccagatgtgcgaccaccgcctgatgagcgccgccatcaaggactccaaggccgtgcacgccgacatgggctactggatcgagagcgagaagaacgagacctggaagctggcgcgggcctccttcatcgaggtcaagacctgcacgtggcccaagagccacaccctctggtccaacggggtgctggagagcgagatgatcatccccaagatctacggcgggccgatctcccagcacaactaccgccccggctacttcacccagaccgccgggccctggcacctgggcaagctcgagctggacttcgacctgtgcgagggcacgaccgtggtcgtggacgagcactgcgggaaccggggcccgagcctccgcaccaccacggtgaccgggaagatcatccacgagtggtgctgccggtcctgcaccctgccgcccctgcgcttccggggcgaggacgggtgctggtacggcatggagatccgccccgtcaaggagaaggaggagaacctcgtgcggagcatggtgtccgccggcagcggggaggtcgacagcttctccctgggcatcctgtgcgtgagcatcatgatcgaggaggtgatgcgctcccggtggagccgcaagatgctcatgaccgggacgctggccgtcttcctgctcctgatcatgggccagctgacctggaacgacctcatccgcctgtgcatcatggtgggggcgaacgcctccgaccggatgggcatgggcaccacccacctggccctcatggccacgttcaagatgcgcccgatgttcgccgtggggctgctgttccggcgcctcaccagccgggaggtcctgctgctcaccatcgggctgtccctgatggcgagcatggagctccccaactccctggaggagctgggggacggcctcgccatgggcatcatgatgctgaagctgctcaccgagttccagccccaccagctgtggacgaccctgctcagcctgaccttcgtgaagaccacgctgtccctcgactacgcctggaagaccaccgccatgatcctgagcatcgtgtccctgttccccctctgcctgagcaccacgtcccagaagaccacctggctgccggtcctcctggggagcttcggctgcaagcccctgaccatgttcctcatcaccgagaacaagatctgggggcgcaagtcctggcccctgaacgagggcatcatggcgatcgggatcgtgagcatcctgctctccagcctgctgaagaacgacgtccccctcgccggcccgctgatcgccggcgggatgctgatcgcctgctacgtgatcagcggctccagcgccgacctctccctggagaaggcggccgaggtgagctgggagcaggaggccgagcactccggggccagccacaacatcctggtcgaggtgcaggacgacggcacgatgaagatcaaggacgaggagcgggacgacaccctcaccatcctgctgaaggccaccctcctggcggtgtccggggtctaccccatgagcatccccgccacgctgttcgtgtggtacttctggcagaagaagaagcagcgctccggcgtgctctgggacacccccagcccgcccgaggtcgagcgggccgtgctggacgacggcatctaccgcatcctgcagcgggggctgctcggccgctcccaggtgggggtcggcgtgttccaggacggggtgttccacaccatgtggcacgtcacccggggcgccgtgctgatgtaccagggcaagcgcctggagcccagctgggcctccgtgaagaaggacctcatcagctacgggggcgggtggcggttccagggctcctggaacacgggggaggaggtccaggtgatcgcggtggagcccggcaagaacccgaagaacgtccagaccacccccggcaccttcaagacgcccgagggggaggtgggcgccatcgccctggacttcaagcccgggaccagcggctccccgatcgtgaaccgcgagggcaagatcgtcgggctgtacggcaacggggtggtgaccaccagcggcacgtacgtctccgccatcgcccaggcgaaggccagccaggaggggcccctccccgagatcgaggacgaggtgttcaagaagcggaacctgaccatcatggacctgcacccgggcagcggcaagacccgccggtacctccccgccatcgtgcgcgaggccatcaagcggaagctgcgcaccctgatcctcgcgcccacgcgcgtcgtggcctccgagatggccgaggccctgaaggggatgcccatccggtaccagaccaccgccgtcaagagcgagcacaccggccgcgagatcgtcgacctgatgtgccacgcgacgttcaccatgcggctcctgtccccggtgcgcgtgcccaactacaacatgatcatcatggacgaggcccacttcaccgaccccgccagcatcgccgcccgggggtacatctccacccgcgtcggcatgggggaggcggccgccatcttcatgacggccacgccgcccggcagcgtggaggccttcccccagtccaacgcggtgatccaggacgaggagcgggacatccccgagcgcagctggaactccggctacgactggatcaccgacttccccgggaagaccgtctggttcgtgcccagcatcaagtccggcaacgacatcgccaactgcctgcggaagaacgggaagcgcgtgatccagctcagccggaagacgttcgacaccgagtaccagaagaccaagaacaacgactgggactacgtcgtgaccacggacatctccgagatgggcgccaacttccgcgccgaccgggtgatcgacccccgccggtgcctgaagcccgtcatcctgaaggacgggcccgagcgcgtgatcctcgcgggcccgatgcccgtgaccgtcgccagcgccgcccagcggcgcggccggatcgggcgcaaccagaacaaggagggcgaccagtacgtgtacatggggcagcccctgaacaacgacgaggaccacgcccactggaccgaggcgaagatgctgctcgacaacatcaacacccccgagggcatcatcccggccctgttcgagcccgagcgcgagaagtccgccgccatcgacggggagtaccggctgcgcggcgaggcccggaagacgttcgtggagctcatgcgccggggcgacctgcccgtctggctgagctacaaggtggcgtccgaggggttccagtacagcgaccgccggtggtgcttcgacggcgagcgcaacaaccaggtcctcgaggagaacatggacgtggagatctggaccaaggagggggagcggaagaagctgcgcccccggtggctggacgcccgcacctactccgacccgctcgccctgcgggagttcaaggagttcgccgccggccgccggagcgtgagcggcgacctgatcctcgagatcgggaagctgccccagcacctgaccctccgcgcgcagaacgccctggacaacctggtcatgctccacaactccgagcagggcgggaaggcctaccggcacgccatggaggagctgcccgacaccatcgagacgctgatgctcctggcgctgatcgccgtgctcaccggcggggtgaccctgttcttcctgagcggcaagggcctcgggaagacctccatcggcctgctgtgcgtcacggccagctccgccctcctgtggatggccagcgtggagccccactggatcgcggcctccatcatcctggagttcttcctcatggtgctgctgatcccggagcccgaccgccagcggacgccccaggacaaccagctcgcctacgtcgtgatcgggctgctgttcatgatcctcaccgtggccgccaacgagatgggcctgctggagaccacgaagaaggacctcgggatcggctacgtcgcggccgagaaccaccagcacgccaccatgctggacgtggacctgcgcccggccagcgcctggaccctctacgcggtggccaccacggtcatcacccccatgatgcggcacaccatcgagaacaccacggccaacatctccctgaccgccatcgccaaccaggcggccatcctgatgggcctcgacaaggggtggcccatcagcaagatggacatcggcgtgcccctgctggccctcgggtgctactcccaggtgaacccgctgaccctgaccgccgcggtcctcatgctggtggcccactacgccatcatcggccccgggctgcaggccaaggccacgcgcgaggcgcagaagcgcaccgccgccggcatcatgaagaaccccaccgtggacggcatcgtcgccatcgacctcgaccccgtggtgtacgacgccaagttcgagaagcagctggggcagatcatgctgctcatcctgtgcaccagccagatcctgctcatgcggacgacctgggcgctgtgcgagtccatcaccctggccaccggcccgctcacgaccctgtgggaggggagccccggcaagttctggaacaccaccatcgccgtctccatggccaacatcttccgcggcagctacctggccggggcgggcctcgccttctccctgatgaagtccctcgggggcgggcggcgcgggacgggcgcccagggggagaccctcggcgagaagtggaagcggcagctgaaccagctgtccaagagcgagttcaacacctacaagcgcagcgggatcatggaggtggaccggtccgaggccaaggagggcctcaagcgcggggagaccacgaagcacgcggtgagccggggcaccgccaagctgcgctggttcgtcgagcggaacctggtgaagcccgagggcaaggtgatcgacctggggtgcggccgcgggggctggtcctactactgcgccgggctcaagaaggtcaccgaggtgaagggctacaccaagggcgggcccggccacgaggagccgatccccatggccacctacgggtggaacctggtgaagctgcacagcggcaaggacgtcttcttcatgccgcccgagaagtgcgacacgctcctgtgcgacatcggggagtccagcccgaaccccaccatcgaggagggccggaccctgcgcgtgctcaagatggtggagccctggctgaagggcaaccagttctgcatcaagatcctgaacccctacatgccgtccgtcgtggagaccctcgagcagatgcagcggaagcacgggggcatgctggtgcgcaaccccctgagccggaactccacgcacgagatgtactgggtcagctgcgggaccggcaacatcgtgtccgccgtgaacatgaccagccgcatgctcctgaaccggttcaccatggcgcaccgcaagcccacgtacgagcgcgacgtcgacctgggcgccgggacccggcacgtggccgtggagcccgaggtcgccaacctcgacatcatcggccagcgcatcgagaacatcaagaacgagcacaagtccacctggcactacgacgaggacaacccgtacaagacctgggcctaccacgggagctacgaggtgaagccctccggcagcgcgtccagcatggtgaacggggtcgtgcggctgctgacgaagccctgggacgtgatccccatggtcacccagatcgccatgaccgacaccacgccgttcggccagcagcgcgtgttcaaggagaaggtcgacacccggacgccccgcgccaagcggggcaccacgcagatcatggaggtgaccgccaagtggctctgggggttcctgtcccgcaacaagaagccccggatctgcacccgcgaggagttcacccggaaggtgcgcagcaacgccgcgatcggcgccgtcttcgtggacgagaaccagtggaacagcgccaaggaggccgtggaggacgagcggttctgggacctggtccaccgcgagcgggagctccacaagcaggggaagtgcgcgacgtgcgtgtacaacatgatgggcaagcgcgagaagaagctgggggagttcggcaaggccaagggctcccgggccatctggtacatgtggctgggggcccgcttcctcgagttcgaggccctgggcttcatgaacgaggaccactggttcagccgggagaactccctgagcggggtggagggcgaggggctccacaagctgggctacatcctgcgcgacatctccaagatcccgggcgggaacatgtacgcggacgacaccgccggctgggacacccggatcaccgaggacgacctccagaacgaggccaagatcacggacatcatggagcccgagcacgccctgctggccaccagcatcttcaagctcacctaccagaacaaggtcgtgcgcgtgcagcgccccgcgaagaacgggaccgtcatggacgtgatctcccggcgcgaccagcggggcagcggccaggtggggacgtacggcctgaacaccttcaccaacatggaggtccagctgatccgccagatggagtccgaggggatcttcctccccagcgagctggagaccccgaacctggccgagcgggtgctcgactggctggagaagcacggcgccgagcgcctgaagcggatggccatctccggggacgactgcgtggtcaagcccatcgacgaccgcttcgccacggcgctcaccgccctgaacgacatgggcaaggtgcggaaggacatcccccagtgggagcccagcaagggctggaacgactggcagcaggtcccgttctgctcccaccacttccaccagctgatcatgaaggacgggcgcgagatcgtcgtgccctgccggaaccaggacgagctcgtgggccgcgcccgggtcagccagggggccggctggtccctgcgcgagaccgcctgcctgggcaagagctacgcgcagatgtggcagctcatgtacttccaccggcgcgacctgcggctggccgccaacgccatctgctccgcggtgcccgtggactgggtccccaccagccgcaccacgtggagcatccacgcccaccaccagtggatgaccaccgaggacatgctctccgtgtggaaccgggtgtggatcgaggagaacccgtggatggaggacaagacccacgtcagctcctgggaggaggtgccctacctgggcaagcgcgaggaccagtggtgcggcagcctgatcgggctcacggcccgcgccacctgggccaccaacatccaggtggcgatcaaccaggtccggcgcctgatcggcaacgagaactacctggactacatgacctccatgaagcggttcaagaacgagagcgaccccgagggggccctctggtga

SEQ ID NO: 8983 - RNA, 9879 nt, synthetic construct
  misc_feature 1..9879: note = derived and/or modified CDS sequence (opt1) from DENV-1__HQ332179__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgcgggggtgaacatgtgcaccctgatcgccatggacctgggggagctctgcgaggacaccatgacctacaagtgcccccgcatcaccgaggccgagcccgacgacgtggactgctggtgcaacgccaccgacacctgggtcacctacgggacctgcagccagaccggggagcaccggcgcgacaagcggtccgtggccctggcgccccacgtgggcctggggctcgagacgcgcaccgagacctggatgagcagcgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctgttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctggcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcatcttcaccacgaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtgaagacctgcacgtggcccaagagccacaccctctggtccaacggggtcctggagagcgagatgatcatccccaagatctacggcgggccgatctcccagcacaactaccgccccggctacttcacccagaccgccgggccctggcacctgggcaagctcgagctggacttcgacctgtgcgagggcacgaccgtggtggtcgacgagcactgcgggaaccggggcccgagcctccgcaccaccacggtgaccgggaagatcatccacgagtggtgctgccggtcctgcaccctgccgcccctgcgcttccggggcgaggacgggtgctggtacggcatggagatccgccccgtgaaggagaaggaggagaacctcgtccggagcatggtgtccgccggcagcggggaggtggacagcttctccctgggcatcctgtgcgccagcatcatgatcgaggaggtcatgcgctcccggtggagccgcaagatgctcatgaccgggacgctggccgtgttcctgctcctgatcatgggccagctgacctggaacgacctcatccgcctgtgcatcatggtgggggcgaacgcctccgaccggatgggcatgggcaccacctacctggccctcatggccacgttcaagatgcgcccgatgttcgccgtcgggctgctgttccggcgcctcaccagccgggaggtgctgctgctcaccatcggcctgtccctggtggcgagcgtcgagctccccaactccctggaggagctgggggacggcctcgccatgggcatcatgatgctgaagctgctcaccgagttccagccccaccagctgtggacgaccctgctcagcctgaccttcgtgaagaccacgctgtccctcgactacgcctggaagaccaccgccatggtcctgagcatcgtgtccctgttccccctctgcctgagcaccacgtcccagaagaccacctggctgccggtgctcctggggagcttcggctgcaagcccctgaccatgttcctcatcaccgagaacaagatctgggggcgcaagtcctggcccctgaacgagggcatcatggcgatcgggatcgtcagcatcctgctctccagcctgctgaagaacgacgtgcccctcgccggcccgctgatcgccggcgggatgctgatcgcctgctacgtgatcagcggctccagcgccgacctcctgctggagaaggcggccgaggtctcctgggagcaggaggccgagcacagcggggcctcccacaacatcctcgtggaggtgcaggacgacggcacgatgaagatcaaggacgaggagcgggacgacaccctgaccatcctgctcaaggccaccctgctggcggtcagcggggtgtaccccatgtccatccccgccaccctcttcgtgtggtacttctggcagaagaagaagcagcgcagcggcgtcctgtgggacaccccctccccgcccgaggtggagcgggccgtgctggacgacggcatctaccgcatcctgcagcgggggctcctgggccgcagccaggtcggggtgggcgtgttccaggacggggtcttccacaccatgtggcacgtgacccggggcgccgtgctgatgtaccagggcaagcgcctcgagccctcctgggccagcgtcaagaaggacctgatctcctacgggggcgggtggcggttccagggcagctggaacacgggggaggaggtccaggtgatcgcggtcgagcccggcaagaacccgaagaacgtgcagaccacccccggcaccttcaagacgcccgagggggaggtgggcgccatcgccctggacttcaagcccgggacctccggcagcccgatcgtcaaccgcgagggcaagatcgtggggctctacggcaacggggtggtcaccacctccggcacgtacgtgagcgccatcgcccaggcgaaggcctcccaggaggggcccctgcccgagatcgaggacgaggtgttcaagaagcggaacctgaccatcatggacctccacccgggcagcggcaagacccgccggtacctgcccgccatcgtccgcgaggccatcaagcggaagctgcgcaccctcatcctggcgcccacgcgcgtggtggccagcgagatggccgaggccctgaaggggatgcccatccggtaccagaccaccgccgtcaagtccgagcacaccggccgcgagatcgtggacctcatgtgccacgcgacgttcaccatgcggctgctgagcccggtgcgcgtccccaactacaacatgatcatcatggacgaggcccacttcaccgaccccgcctccatcgccgcccgggggtacatcagcacccgcgtgggcatgggggaggcggccgccatcttcatgacggccacgccgcccggctccgtggaggccttcccccagagcaacgcggtcatccaggacgaggagcgggacatccccgagcgctcctggaacagcggctacgactggatcaccgacttccccgggaagaccgtgtggttcgtgccctccatcaagagcggcaacgacatcgccaactgcctccggaagaacgggaagcgcgtcatccagctgtcccggaagacgttcgacaccgagtaccagaagaccaagaacaacgactgggactacgtggtgaccacggacatcagcgagatgggcgccaacttccgcgccgaccgggtcatcgacccccgccggtgcctgaagcccgtgatcctcaaggacgggcccgagcgcgtgatcctggcgggcccgatgcccgtcaccgtggcctccgccgcccagcggcgcggccggatcgggcgcaaccagaacaaggagggcgaccagtacgtctacatggggcagcccctgaacaacgacgaggaccacgcccactggaccgaggcgaagatgctcctggacaacatcaacacccccgagggcatcatcccggccctgttcgagcccgagcgcgagaagtccgccgccatcgacggggagtaccggctccgcggcgaggcccggaagacgttcgtggagctgatgcgccggggcgacctgcccgtgtggctctcctacaaggtcgcgagcgaggggttccagtactccgaccgccggtggtgcttcgacggcgagcgcaacaaccaggtgctggaggagaacatggacgtggagatctggaccaaggagggggagcggaagaagctgcgcccccggtggctcgacgcccgcacctacagcgacccgctggccctgcgggagttcaaggagttcgccgccggccgccggtccgtcagcggcgacctcatcctggagatcgggaagctgccccagcacctcaccctgcgcgcgcagaacgccctggacaacctcgtgatgctgcacaacagcgagcagggcgggaaggcctaccggcacgccatggaggagctgcccgacaccatcgagacgctcatgctgctggcgctcatcgccgtgctgaccggcggggtcaccctgttcttcctctccggcaagggcctggggaagaccagcatcggcctgctctgcgtgacggcctccagcgccctgctgtggatggcctgcgtggagccccactggatcgcggcctccatcatcctcgagttcttcctgatggtcctgctcatcccggagcccgaccgccagcggacgccccaggacaaccagctggcctacgtggtgatcgggctcctcttcatgatcctgaccgtcgccgccaacgagatgggcctgctcgagaccacgaagaaggacctggggatcggctacgtggcggccgagaaccaccagcacgccaccatgctggacgtggacctccgcccggccagcgcctggaccctgtacgcggtcgccaccacggtgatcacccccatgatgcggcacaccatcgagaacaccacggccaacatctccctgaccgccatcgccaaccaggcggccatcctcatgggcctggacaaggggtggcccatcagcaagatggacatcggcgtgcccctgctcgccctggggtgctactcccaggtcaacccgctgaccctcaccgccgcggtgctgatgctggtggcccactacgccatcatcggccccgggctccaggccaaggccacgcgcgaggcgcagaagcgcaccgccgccggcatcatgaagaaccccaccgtcgacggcatcgtggccatcgacctggaccccgtggtctacgacgccaagttcgagaagcagctggggcagatcatgctcctgatcctgtgcaccagccagatcctcctgatgcggacgacctgggcgctgtgcgagtccatcaccctcgccaccggcccgctgacgaccctgtgggaggggagccccggcaagttctggaacaccaccatcgccgtgtccatggccaacatcttccgcggcagctacctcgccggggcgggcctggccttctccctgatgaagtccctcgggggcgggcggcgcggcacgggcgcccagggggagaccctgggcgagaagtggaagcggcagctgaaccagctctccaagagcgagttcaacacctacaagcgctccgggatcatggaggtggaccggagcgaggccaaggagggcctgaagcgcggggagaccacgaagcacgcggtcagccggggcaccgccaagctgcgctggttcgtggagcggaacctggtgaagcccgagggcaaggtcatcgacctcgggtgcggccgcgggggctggtcctactactgcgccgggctgaagaaggtgaccgaggtgaagggctacaccaagggcgggcccggccacgaggagccgatccccatggccacctacgggtggaacctggtcaagctccacagcggcaaggacgtgttcttcatgccgcccgagaagtgcgacacgctgctgtgcgacatcggggagtccagcccgaaccccaccatcgaggagggccggaccctccgcgtgctgaagatggtcgagccctggctgaagggcaaccagttctgcatcaagatcctcaacccctacatgccgtccgtggtggagaccctggagcagatgcagcggaagcacgggggcatgctggtccgcaaccccctcagccggaactccacgcacgagatgtactgggtgagctgcgggaccggcaacatcgtgtccgccgtcaacatgaccagccgcatgctgctgaaccggttcaccatggcgcaccgcaagcccacgtacgagcgcgacgtggacctcggcgccgggacccggcacgtggccgtcgagcccgaggtggccaacctggacatcatcggccagcgcatcgagaacatcaagaacgagcacaagtccacctggcactacgacgaggacaacccgtacaagacctgggcctaccacgggagctacgaggtgaagccctccggcagcgcgtccagcatggtcaacggggtggtccggctgctcacgaagccctgggacgtgatccccatggtgacccagatcgccatgaccgacaccacgccgttcggccagcagcgcgtcttcaaggagaaggtggacacccggacgccccgcgccaagcggggcaccacgcagatcatggaggtgaccgccaagtggctgtgggggttcctgtcccgcaacaagaagccccggatctgcacccgcgaggagttcacccggaaggtccgcagcaacgccgcgatcggcgccgtgttcgtggacgagaaccagtggaactccgccaaggaggccgtcgaggacgagcggttctgggacctcgtgcaccgcgagcgggagctgcacaagcaggggaagtgcgcgacgtgcgtgtacaacatgatgggcaagcgcgagaagaagctgggggagttcggcaaggccaagggcagccgggccatctggtacatgtggctcggggcccgcttcctggagttcgaggccctgggcttcatgaacgaggaccactggttcagccgggagaactccctcagcggggtcgagggcgaggggctgcacaagctgggctacatcctccgcgacatctccaagatcccgggcgggaacatgtacgcggacgacaccgccggctgggacacccggatcaccgaggacgacctgcagaacgaggccaagatcacggacatcatggagcccgagcacgccctgctcgccaccagcatcttcaagctgacctaccagaacaaggtggtgcgcgtccagcgccccgcgaagaacgggaccgtgatggacgtgatctcccggcgcgaccagcggggcagcggccaggtcgggacgtacggcctgaacaccttcaccaacatggaggtgcagctcatccgccagatggagtccgaggggatcttcctgcccagcgagctggagaccccgaacctcgccgagcgggtgctggactggctggagaagcacggcgccgagcgcctcaagcggatggccatctccggggacgactgcgtcgtgaagcccatcgacgaccgcttcgccacggcgctgaccgccctgaacgacatgggcaaggtgcggaaggacatcccccagtgggagcccagcaagggctggaacgactggcagcaggtcccgttctgctcccaccacttccaccagctcatcatgaaggacgggcgcgagatcgtggtgccctgccggaaccaggacgagctggtcggccgcgcccgggtgagccagggggccggctggtccctgcgcgagaccgcctgcctcggcaagagctacgcgcagatgtggcagctgatgtacttccaccggcgcgacctgcggctcgccgccaacgccatctgctccgcggtgcccgtcgactgggtgcccaccagccgcaccacgtggtccatccacgcccaccaccagtggatgaccaccgaggacatgctgagcgtgtggaaccgggtctggatcgaggagaacccgtggatggaggacaagacccacgtgagctcctgggaggaggtgccctacctgggcaagcgcgaggaccagtggtgcggcagcctcatcgggctgacggcccgcgccacctgggccaccaacatccaggtcgcgatcaaccaggtgcggcgcctgatcggcaacgagaactacctcgactacatgacctccatgaagcggttcaagaacgagagcgaccccgagggggccctgtggtga

SEQ ID NO: 8984 - RNA, 9879 nt, synthetic construct
  misc_feature 1..9879: note = derived and/or modified CDS sequence (opt1) from DENV-1__KR919820__SS-prME
  source 1..9879: mol_type = other RNA
accgtggtggccctgctcatgctgctgcccatggtgttcagcttccacctcaccacccggggcggggagccgcacatgatcgtgaacaagcaggagcggggcaagagcctgctgttcaagaccagcgggggcatcaacatgtgcaccctcatcgccatggacctgggggacctgtgcgaggacaccatgacgtacaagtgcccccggatcaccgaggccgagcccgacgacgtggactgctggtgcaacgccaccgacacctgggtgacctacggcatctgcagccccaccggcgagcaccggcgcgagaagcggagcgtggccctcgccccgcacgtggggctgggcctggagacccgcgccgagacctggatgagcagcgagggggcgtggaagcagatccagcgggtggagacgtgggccctccgccaccccggcttcaccgtgatcgccctgttcctggcccacatcatcgggacctccatcacccagaagggcgtcatcttcatcctcctgatgctggtgacgcccagcatggcgatgcggtgcgtgggcgtcgggaaccgcgacttcgtggagggcctctccggggccacctgggtggacgtcgtgctggagcacggcagctgcgtgaccaccatggccaagaacaagcccacgctggacatcgagctcctgaagaccgaggtctccaacccggccgtgctgcggaagctctgcatcgaggcccgcatcagcaacaccaccacggactcccggtgccccacccagggcgaggcgagcctgtccgaggagcaggacaccaacttcgtgtgccgccggaccctggtcgaccgcgggtggggcaacgggtgcggcctcttcgggaagggcagcctgatcacgtgcgccaagttcgagtgcctgaccaagatggagggcaagatcgtgcagtacgagaacctcaagtactccgtgatcgtcaccgtgcacaccggggaccagcaccaggtcggcaacgagacgaccgggcacggcaccaccgccacgatcacgccccaggcccccaccagcgagatccagctgaccgactacggggccctgaccctcgactgctccccgcggacgggcctggacttcaacgagatggtgctgctcaccatgaaggagaagtcctggctggtgcacaagcagtggttcctggacctccccctgccctgggcgagcggcgcctccagcccccaggagacctggaaccgccaggacctgctcgtcaccttcaagacggcccacgccaagaagcaggaggtggtggtcctggggtcccaggagggcgccatgcacaccgcgctgaccggggccaccgagatccagacgagcggcaccaccaccatcttcgccgggcacctcaagtgccggctgaagatggacaagctgacgctcaagggcatgtcctacgtgatgtgcaccggcagcttcaagctgaagaaggaggtggccgagacccagcacgggaccgtcctggtccaggtggagtacgagggcacggacgccccgtgcaagatccccttcaccacccaggacgagaagggggtcatccagaacggccgcctgatcaccgcgaaccccatcgtgacggacaaggagaagcccgtgaacatcgaggccgagccgcccttcggcgagtcctacatggtcatcggggtgggcgacaaggccctcaagctgagctggttcaagaaggggtccagcctgggcaagatgttcgaggccaccgcgcgcggggcccgccgcatggccatcctcggcgacaccgcctgggacttcggctccgtcggcggggtcttcaccagcatggggaagctggtgcaccagatcttcgggacggcctacggggtgctgttctccggcgtcagctggaccatgaagatcggcatcgggctcctgctgacctggctcggcctgaactcccggagcacctccctgagcatgacgtgcatcgcggtggggatcatcaccctctacctgggcgtgatggtccaggccgacaccgggtgcgtggtgaactggaagggccgcgagctgaagtgcggctccgggatcttcgtcaccaacgaggtgcacacgtggaccgagcagtacaagttccaggccgacagccccaagcggctcagcgccgccatcggcaaggcgtgggaggacggggtgtgcggcatccgctccgccacccggctggagaacatcatgtggaagcagatcgccaacgagctgaactacatcctcctggagaacgacatgaagttcaccgtcgtggtgggggacgtcaagggcatcctgacgcagggcaagaaggggatccgcccccagccgatggagcacaagtacagctggaagtcctggggcaaggccaagatcatcggggccgacgtgcagaacaccaccttcatcatcgacggccccgacacccccgagtgccccgacagccagcgggcgtggaacatctgggaggtggaggactacggcttcgggatcttcaccacgaacatctggctcaagctgcgcgactcctacacccaggtctgcgaccaccggctgatgagcgccgccatcaaggactcccgcgccgtgcacgcggacatgggctactggatcgagagcgagaagaacgagacctggaagctctcccgggccagcttcatcgaggtgaagacctgcacgtggccgaagtcccacaccctgtggagcaacggggtcctggagtccgagatgatcatccccaagatctacggcgggcccatcagccagcacaactaccgcccgggctacttcacccagaccgccggcccctggcacctcgggaagctggagctggacttcgacctctgcgagggcacgaccgtggtggtcgacgagcagtgcgggaaccggggcccctccctgcgcaccaccacggtgaccgggaagatcatccacgagtggtgctgccggagctgcaccctgcccccgctccgcttcaagggcgaggacggctgctggtacgggatggagatccggcccgtgaaggagaaggaggagaacctggtcaagtccatggtgagcgccggcagcgggaaggtggacaacttctccctgggcctcctgtgcatcagcatcatggtcgaggaggtgatgcgctcccggtggagcgggaagatgctgatgaccggcacgatggccgtgttcctcctgctggtcatgggccagctcacctggaacgacctgatccgcgtgtgcatcatggtcggggcgcacgccctggactccatgggcatggggaccacctacctcgccctgatggccacgttcaagatccgccccatgctggccgtgggcctcctgttccggaagctgaccagccgcgagatcctcctgctgaccatcggcctctccctgatcacccccgtggagctgccgaacagcatcgaggagctcggggacggcctggcgatggggatcatgatgctgaagctcctgacggacttccagccctaccagctgtgggccaccctcctgtccctgaccttcgtcaagaccacgctcagcctgcactacgcctggaagaccgccgccatggtgctgtccatcgtgagcctcctgcccctgtgcctctccaccaccagccagaagacgacctggctgcccatcctgctcggctccctggggtgcaagccgctgaccatgttcctcatcagcgagaacaagatctggggccggcgctcctggcccatcaacgagggcatcatggcggtcgggatcgtgagcatcctgatgtccagcctgctcaagaacgacgtgcccctggccggccccctgatcgccgggggcatgctcgtcgcctgctacgtgatcagcgggtccagcgcggacctgaccctggagaagacggccgaggtgtcctgggaggaggaggccgagcacagcggcaccgcccacaacatcctcgtcgaggtgcaggacgacggcaccatgaagatcaaggacgaggagcgggaggacaccctgaccatcctgctcaaggccgcgctgctggccctctccggggtgtacccgatgagcatccccgccacgctgttcgtctggtacttctggcagaagaagaagcagcgctccggcgtgctgtgggacatcccctccccgcccgaggtggagaaggccgtcctggacgacgggatctaccggatcctccagcgcggcgtgttcgggcggtcccaggtgggcgtcggcgtgttccaggagggggtgttccacaccatgtggcacgtcacccgcggcgccgtgctgacctaccaggggaagcggctggagcccagctgggcgtccgtgaagaaggacctcatcagctacggcgggggctggcgcctgcagggctcctggaacgtcggggaggaggtccaggtgatcgccgtcgagcccggcaagaaccccaagaacgtgcagacggtgcccgggaccttcaagacccacgagggcgaggtcggcgccatcgccctggacttcaagcccgggaccagcggctcccccatcgtgaaccgggacgggaaggtggtcggcctctacgggaacggcgtggtgacgaccagcggcacctacgtctccgccatcgcgcagagcaaggtgtcccaggaggggccgctgcccgagatcgaggacgaggtgttcaagaagaagaacctgaccatcatggacctccaccccggcagcgggaagacgcgccggtacctgcccgccatcgtccgcgagagcatcaagcggcgcctgcggaccctcatcctggccccgacccgcgtggtggcctccgagatggccgaggcgctgaagggcctccccatccggtaccagaccacggccgtccgcaacgagcacaccgggcgcgagatcgtggacctgatgtgccacgccaccttcaccatgcggctgctcagccccgtgcgcgtccccaactacaacatgatcatcatggacgaggcccacttcacggacccggcgtccatcgccgcccggggctacatcagcacccgcgtgggcatgggggaggccgccgcgatcttcatgaccgccacgccgcccggctccgccgaggccttcccccagagcaactccgtgatctacgacgaggagaaggacatcccggagcggagctggaactccgggtacgactggatcacggacttccagggcaagaccgtctggttcgtgcccagcatcaagaccgggaacgacatcgccaactgcctgcgcaagaacggcaagcgggtcatccagctgtcccgcaagaccttcgacacggagtaccagaagaccaagaacagcgactgggacttcgtggtgaccaccgacatctccgagatgggcgcgaacttccgggccgaccgcgtcatcgacccccggcgctgcctcaagcccgtgatcctgcgggacgggccggagcgcgtgatcctggccggccccatgcccgtcacggtggccagcgccgcgcagcggcgcgggcggatcggccgcaaccagtccaaggagggggaccagtacatctacatgggccagcccctcaacaacgacgaggaccacgcccactggaccgaggccaagatgctgctggacaacatcaacaccccggagggcatcatccccgccctcttcgagcccgagcgggagaagtccgcggccatcgacggggagtaccgcctgcgcggcgaggcccggaagaccttcgtggagctgatgcgccgcggggacctccccgtctggctgtcctacaaggtggccagcgagggcatccagtacgccgaccgcaagtggtgcttcgacggcgagcggaacaaccagatcctggaggagaacatggacgtggagatctggacgaaggagggggagcgcaagaagctccggccgcgctggctggacgcgcggacctactccgaccccctggccctccgcgagttcaaggagttcgccgccggccggcgcagcgtcagcggggacctgatcctggagatcggcaagctcccccaccacctgacccagcgggcccagaacgcgctggacaacctcgtgatgctgcacaactccgagcagggcgggcgcgcctaccggcacgccatggaggagctgcccgacaccatcgagacgctcatgctgctggccatgatcgccaccctcaccggcggggtggcgctgttcttcctgagcggcaaggggctcggcaagacctccatcgggctgctgtgcgtcatggccagctccaccctcctgtggatggccagcgtggagccgcactggatcgccgcgtccatcgtgctggagttcttcctcatggtcctgctgatccccgagcccgaccgccagcggacgccgcaggacaaccagctcgcctacgtggtgatcggcctgctggtcctcatcctgaccgtggccgccaacgagatgggcctgctcgagaccaccaagaaggacctggggatcggcagcgccgcggccgagatccagcaccacacgaccatcctggacgtggacctccaccccgcctccgcctggaccctgtacgccgtcgcgaccacggtgatcacccccatgctgcgccacaccatcgagaacaccacggccaacatgagcctcaccgccatcgccaaccaggccgcgatcctgatggggctggacaagggctggcccatctccaagatggacatcggggtgccgctcctggccctgggctgctacagccaggtcaaccccatgaccctcaccgccgccgtgctgatgctggtggcccactacgcgatcatcggccccgggctccaggccaaggccacgcgggacgcccagaagcgcaccgcggccggcatcatgaagaaccccaccgtcgacgggatcgtggccatcgacctggacccggtggtctacgacaccaagttcgagaagcagctgggccagatcatgctcctgatcctgtgcacgtcccagatcctcctgatgcggaccacctgggccttctgcgagagcatcaccctggccacgggccccctcaccaccctgtgggaggggtcccccggcaagttctggaacaccacgatcgcggtgagcatggccaacatcttccgcgggtcctacctggccggcgccgggctcgccttcagcctgatgaagtccctgggcggcaaccgccgggggaccggcgcgcagggggagaccctcggcgagaagtggaagcgccagctgaaccagctgagcaagctcgagttcaacacctacaagcggagcgggatcatggaggtggaccgcacggaggccaaggagggcctgaagcggggcgagaccacccgccacgccgtctcccgggggaccgccaagctgcgctggttcgtggagcggaacctggtgaagcccgagggcaaggtcatcgacctcgggtgcggccgcgggggctggagctactactgcgccggcctgaagaaggtgacggaggtgaaggggtacaccaagggcgggccgggccacgaggagcccatccccatggcgacctacgggtggaacctggtcaagctccactccggcaaggacgtgttcttcatcccgcccgagaagtgcgacaccctgctgtgcgacatcggcgagagctcccccaaccccaccatcgaggaggggcggacgctccgcgtgctgaagatggtcgagccctggctgcggggcaaccagttctgcatcaaggtgctcaacccgtacatgcccagcgtggtcgagaccctggagcgcatgcagcggaagcacgggggcatgctggtgcgcaaccccctctcccggaacagcacccacgagatgtactgggtgtcctgcggcaccgggaacatcgtcagcgccgtgaacatgacgtcccgcatgctgctgaaccggttcaccatgacccaccgcaagcccacctacgagaaggacgtcgacctcggcgccgggacgcgccacgtggccgtggagccggaggtcgcgaacctggacatcatcggccagcggatcgagaacatcaagaacgagcacaagagcacctggcactacgacgaggacaacccctacaagacctgggcctaccacgggtcctacgaggtgaagcccagcggctccgccagctccatggtgaacggcgtcgtgcgcctgctcaccaagccctgggacgtgatcccgatggtcacgcagatcgccatgaccgacaccacccccttcgggcagcagcgggtgttcaaggagaaggtggacacgcgcacccccaaggccaagcggggcaccgcgcaggtcatggagatcaccgccgggtggctgtggaagttcctgagccgcaagaagaagccgcggatctgcacgcgcgaggagttcacccggaaggtgcgctccaacgccgccatcggcgccgtgttcgtcgacgagaaccagtggaacagcgcgaaggaggccgtggacgacgagcggttctgggacctcgtgaaccgcgagcgggagctgcacaagcaggggaagtgcgcgacctgcgtctacaacatgatgggcaagcgcgagaagaagctgggcgagttcgggaaggccaagggcagccgggccatctggtacatgtggctcggggcgcgcttcctggagttcgaggccctgggcttcatgaacgaggaccactggttctcccgggacaacagcctctccggggtggagggcgagggcctgcacaagctggggtacatcctccgcgacatcgcccggatccccggcgggaacatgtacgccgacgacaccgcgggctgggacacgcgcatcaccgaggaggacctgcagaacgaggcccgggtgaccgagctgatggagcccgaccacgcccagctcgccaccagcatcttccgcctgacgtaccagaacaaggtcgtgcgcgtgcagcggcccggcaagaacgggaccgtcatggacgtgatctcccgccgggaccagcgcggcagcggccaggtgggcacctacgggctgaacaccttcacgaacatggaggcccagctcatccggcagatggagtccgagggcgtcttcagcccgtccgagctggagacccccaacctggcgaaccgcgtgctcgactggctggagaagtacggcgtggagcggctgaagcgcatggccatcagcggggacgactgcgtcgtgaagcccatcgacgaccggttcgccaccgccctcaccgccctgaacgacatgggcaaggtgcgcaaggacatcccccagtgggagccgtcccgggggtggaacgactggcagcaggtccccttctgcagccaccacttccaccagctgatcatgaaggacggccgcgagatcgtggtgccctgccggaaccaggacgagctcgtcgggcgcgcgcgggtgtcccagggcgccggctggagcctgcgcgagacggcctgcctggggaagtcctacgcccagatgtggcagctcatgtacttccaccggcgcgacctgcggctggccgcgaacgccatctgcagcgccgtgcccgtcgactgggtgccgacctcccgcaccacctggagcatccacgcccaccaccagtggatgaccacggaggacatgctcagcgtgtggaaccgcgtctggatcgaggagaacccctggatggaggacaagacccacgtgacctcctgggaggacgtgccctacctgggcaagcgggaggaccagtggtgcgggagcctgatcggcctctccgcccgcgcgacctgggccatcaacatccaggtcgccatcaaccaggtgcggaagctgatcgggaacgagcactaccaggactacatgacgagcatgcgccggttcaagaacgagtccgagcccgagggcgccctgtggtga

SEQ ID NO: 8985 - RNA, 9879 nt, synthetic construct
  misc_feature 1..9879: note = derived and/or modified CDS sequence (opt1) from DENV-1__DQ285561__SS-prME
  source 1..9879: mol_type = other RNA
agcgtgaccatgctgctcatgctgctgcccaccgccctcaccttccacctgaccacccggggcggggagccccacatgatcgtgggcaagcaggagcggggcaagagcctcctgttcaagaccagcgccggggtgaacatgtgcaccctgatcgcgatggacctgggggagctctgcgacgacaccatgacctacaagtgcccccgcatcaccgagaccgagcccgacgacgtggactgctggtgcaacgccaccgagacctgggtgacctacggcacgtgcagccagaccggcgagcaccggcgcgacaagcggagcgtggccctggcgccccacgtggggctgggcctcgagacccgcaccgagacgtggatgtccagcgagggggcctggcggcagatccagaaggtggagacctgggccctgcgccaccccggcttcaccgtgatcgccctgttcctcgcccacgccatcgggacctccatcacgcagaagggcatcatcttcatcctgctgatgctcgtgacccccagcatggcgatgcggtgcgtcggcatcgggaaccgcgacttcgtggagggcctgtccggggccacctgggtggacgtcgtgctggagcacggcagctgcgtgaccacgatggccaaggacaagcccaccctcgacatcgagctgctgaagaccgaggtcaccaaccccgccgtgctccggaagctgtgcatcgaggccaagatctccaacacgaccaccgacagccgctgcccgacccagggcgaggcgacgctggtggaggagcaggacaccaacttcgtctgccggcgcaccttcgtggaccgggggtggggcaacgggtgcggcctcttcgggaagggctccctgatcacgtgcgccaagttcaagtgcgtgacgaagctggagggcaagatcgtccagtacgagaacctcaagtacagcgtgatcgtgaccgtccacaccggggaccagcaccaggtgggcaacgagaccaccgagcacgggacgatcgccaccatcacgccccaggcccccacctccgagatccagctgacggactacggcgccctgaccctcgactgcagcccccgcaccgggctggacttcaacgagatggtcctgctcaccatgaaggagaagtcctggctggtgcacaagcagtggttcctggacctcccgctgccctggacgagcggcgcgtccaccagccaggagatctggaaccggcaggacctgctcgtgaccttcaagaccgcccacgccaagaagcaggaggtcgtggtgctgggcagccaggagggggccatgcacacggccctgaccggcgcgaccgagatccagacctccgggacgaccaccatcttcgccggccacctcaagtgccgcctgaagatggacaagctgaccctcaaggggatcagctacgtcatgtgcacgggctccttcaagctggagaaggaggtggccgagacccagcacggcaccgtgctggtccaggtgaagtacgaggggaccgacgccccctgcaagatccccttcagctcccaggacgagaagggcgtgacgcagaacgggcggctggtcaccgccaacccgatcgtgaccgacaaggagaagcccgtgaacatcgaggcggagccgcccttcggcgagagctacatcgtcgtgggcgccggggagaaggccctcaagctgtcctggttcaagaagggcagctccatcgggaagatgttcgaggccaccgcgcgcggcgcccggcgcatggccatcctgggggacacggcctgggacttcggcagcatcggcggggtgttcacctccgtcggcaagctcgtgcaccagatcttcgggaccgcctacggcgtgctgttcagcggggtctcctggaccatgaagatcggcatcggcatcctgctcacgtggctggggctgaacagccgctccaccagcctctccatgacctgcatcgcggtgggcatgatcaccctgtacctgggggtgatggtccaggccgacagcggctgcgtgatcaactggaaggggcgggagctcaagtgcggctccggcatcttcgtgacgaacgaggtccacacctggaccgagcagtacaagttccaggccgacagcccgaagcgcctgagcgccgccatcgggaaggcgtgggaggagggcgtgtgcgggatccggtccgccacccgcctggagaacatcatgtggaagcagatcagcaacgagctcaaccacatcctgctggagaacgacatgaagttcaccgtggtcgtgggcgacgtgtccgggatcctcgcccagggcaagaagtccatccggccccagcccatggagcacaagtactcctggaagtcctggggcaaggccaagatcatcggggccgacgtccagaacacgaccttcatcatcgacggccccaacaccccggagtgccccgacgaccagcgcgcgtggaacatctgggaggtggaggactacgggttcggcatcttcaccacgaacatctggctgaagctgcgggactcctacacccaggtgtgcgaccaccgcctcatgagcgccgccatcaaggactccaaggccgtccacgcggacatgggctactggatcgagagcgagaagaacgagacctggaagctggcccgggcctccttcatcgaggtgaagacctgcatctggcccaagagccacacgctgtggtccaacggggtgctcgagagcgagatgatcatccccaagatctacggcgggccgatctcccagcacaactaccgccccggctacttcacccagaccgccgggccctggcacctgggcaagctggagctcgacttcgacctgtgcgagggcaccacggtcgtggtggacgagcactgcgggaaccggggcccgagcctgcgcaccaccaccgtcacggggaagatcatccacgagtggtgctgccggtcctgcaccctgccgcccctgcgcttcaagggcgaggacgggtgctggtacggcatggagatccggcccgtgaaggagaaggaggagaacctggtcaagagcatggtcagcgccggctccggggaggtggacagcttctccctcggcctgctgtgcatcagcatcatgatcgaggaggtgatgcgctcccggtggagccgcaagatgctcatgaccgggaccctggcggtcttcctgctcctgacgatgggccagctgacctggaacgacctcatccggctgtgcatcatggtgggggccaacgcctccgacaacatgggcatgggcaccacctacctggccctcatggccacgttccgcatgcgcccgatgttcgcggtggggctgctgttccggcgcctcaccagccgggaggtcctgctgctcaccgtgggcctgtccctggtcgccagcgtggagctccccaactccctggaggagctgggggacggcctcgccatgggcatcatgatcctgaagctgctcaccgacttccagagccaccagctgtgggccacgctgctctccctgaccttcgtgaagaccaccttcagcctgcactacgcctggaagacgatggcgatgatcctctccatcgtcagcctgttccccctgtgcctctccaccaccagccagaagaccacgtggctgcccgtgctgctcgggtccctgggctgcaagccgctgaccatgttcctcatcaccgagaacaagatctgggggcgcaagagctggcccctgaacgagggcatcatggccgtggggatcgtcagcatcctgctctccagcctgctgaagaacgacgtgcccctcgccggccccctgatcgccggcgggatgctgatcgcgtgctacgtgatctccggcagctccgccgacctcagcctggagaaggccgccgaggtctcctgggaggaggaggccgagcacagcggggcgtcccacaacatcctggtggagatccaggacgacggcaccatgaagatcaaggacgaggagcgggacgacaccatcacgatcctcctgaaggccaccctgctcgccatcagcggggtgtacccgatgtccatccccgccaccctgttcgtctggtacttctggcagaagaagaagcagcgcagcggcgtgctgtgggacacccccagcccgcccgaggtggagcgggccgtcctcgacgacggcatctaccgcatcctgcagcgggggctgctgggccgcagccaggtgggggtgggcgtcttccaggagggggtgttccacacgatgtggcacgtgacccggggcgcggtcctcatgtaccagggcaagcgcctggagccctcctgggccagcgtgaagaaggacctgatctcctacgggggcgggtggcggttccagggcagctggaacaccggggaggaggtgcaggtcatcgccgtggagcccggcaagaaccccaagaacgtgcagaccgcccccggcacgttcaagacctccgagggggaggtcggcgccatcgcgctcgacttcaagcccgggaccagcggcagccccatcgtgaaccgcgagggcaagatcgtggggctgtacggcaacggggtcgtgaccacgtccggcacctacgtgagcgccatcgcccaggccaaggcctcccaggaggggcccctgccggagatcgaggacgaggtcttccggaagcgcaacctcaccatcatggacctgcaccccggcagcggcaagacccggcgctacctgcccgcgatcgtgcgggaggccatcaagcgcaagctccggacgctggtgctggccccgacccgcgtcgtggcctccgagatggcggaggccctcaaggggatgcccatccgctaccagaccaccgccgtcaagagcgagcacacgggccgggagatcgtcgacctgatgtgccacgccaccttcaccatgcgcctgctctcccccgtgcgggtgcccaactacaacatgatcatcatggacgaggcccacttcaccgacccggcgagcatcgccgcccgcgggtacatctccacgcgggtcggcatgggggaggccgccgcgatcttcatgaccgccacgccgcccggcagcgtggaggccttcccccagtccaacgccgtgatccaggacgaggagaaggacatcccggagcgcagctggaactccggctacgactggatcaccgggttccccggcaagacggtctggttcgtgcccagcatcaagtccgggaacgacatcgccaactgcctgcggaagaacggcaagcgcgtgatccagctgagccggaagaccttcgacaccgagtaccagaagaccaagaacaacgactgggactacgtcgtgacgaccgacatctccgagatgggggcgaacttccgcgccgaccgggtgatcgacccccgccggtgcctcaagccggtcatcctgaaggacggccccgagcgcgtgatcctggccggccccatgcccgtcaccgtggccagcgcggcccagcggcgcgggcggatcggccgcaaccagaacaaggagggggaccagtacatctacatgggccagccgctcaacaacgacgaggaccacgcccactggaccgaggccaagatgctgctggacaacatcaacacgcccgaggggatcatccccgccctcttcgagcccgagcgggagaagtccgcggccatcgacggcgagtaccgcctgcgcggcgaggcccggaagaccttcgtggagctgatgcgccgcggggacctcccggtctggctgagctacaaggtggccagcgagggcttccagtactccgaccgccggtggtgcttcgacggggagcgcaacaaccaggtgctggaggagaacatggacgtcgagatctggaccaaggagggcgagcggaagaagctccgcccccggtggctggacgcccgcacctacagcgaccccctggcgctccgggagttcaaggagttcgccgccggccgccggtccgtgagcggggacctgatcctggagatcggcaagctcccccagcacctgacgcagcgcgcccagaacgccctggacaacctcgtgatgctgcacaactccgagcagggcgggaaggcgtaccggcacgccatggaggagctgccggacaccatcgagaccctcatgctgctggccctcatcgccgtcctgaccgggggcgtgaccctgttcttcctcagcggccgcgggctgggcaagacgtccatcgggctgctctgcgtgatgagctccagcgcgctgctgtggatggcctccgtcgagccccactggatcgccgccagcatcatcctcgagttcttcctgatggtgctgctcatccccgagcccgaccggcagcgcaccccgcaggacaaccagctggcctacgtggtcatcggcctcctcttcatgatcctgaccgtggcggccaacgagatggggctgctcgagaccacgaagaaggacctgggcatcggccacgccgccgccgagaaccaccaccacgcggccatgctggacgtggacctccaccccgcctccgcctggaccctgtacgccgtcgcgaccaccatcatcacgcccatgatgcggcacaccatcgagaacaccaccgccaacatcagcctgacggccatcgccaaccaggccgcgatcctcatggggctggacaagggctggccgatctccaagatggacatcggggtgcccctgctcgccctgggctgctacagccaggtgaaccccctgaccctcaccgccgccgtcctgatgctggtggcgcactacgccatcatcgggcccggcctccaggccaaggccacccgcgaggcccagaagcggacggcggccggcatcatgaagaacccgaccgtggacgggatcgtcgccatcgacctggaccccgtggtgtacgacgccaagttcgagaagcagctgggccagatcatgctcctgatcctgtgcacctcccagatcctcctgatgcgcaccacgtgggccctgtgcgagagcatcaccctcgcgaccgggcccctgaccacgctgtgggagggctcccccggcaagttctggaacaccaccatcgccgtcagcatggccaacatcttccgcgggagctacctcgccggcgccgggctggcgttctccctgatgaagtccctcggcgggggccggcgcggcaccggggcccagggcgagacgctgggggagaagtggaagcggcagctgaaccagctctccaagagcgagttcaacatctacaagcgctccggcatcgtggaggtggaccggagcgaggccaaggaggggctgaagcgcggcgagaccatcaagcacgccgtctcccggggcaccgcgaagctgcgctggttcgtggagcggaacctcgtgaagccggaggggaaggtcatcgacctgggctgcgggcgcggcgggtggagctactactgcgccggcctgaagaaggtgaccgaggtgaagggctacacgaagggcgggcccgggcacgaggagcccatccccatggccacctacggctggaacctggtcaagctctactccgggaaggacgtgttcttcatcccgcccgagaagtgcgacaccctgctgtgcgacatcggcgagagctcccccaaccccaccatcgaggagggccggacgctccgcgtgctgaagatggtcgagccgtggctgcgggggaaccagttctgcatcaagatcctcaacccctacatgcccagcgtggtggagaccctggagcagatgcagcgcaagcacggcgggatgctggtccggaaccccctctcccgcaacagcacccacgagatgtactgggtgtcctgcggcaccggcaacatcgtgagcgccgtcaacatgacctcccggatgctgctgaaccgcttcacgatggcccaccggaagccgacctacgagcgcgacgtggacctcggggcgggcacccgccacgtggccgtcgagcccgaggtggccaacctggacatcatcgggcagcggatcgagaacatcaagaacgagcacaagagcacctggcactacgacgaggacaacccctacaagacgtgggcctaccacggctcctacgaggtgaagcccagcgggagcgcctccagcatggtcaacggcgtggtccgcctgctcaccaagccgtgggacgtgatccccatggtgacccagatcgcgatgaccgacacgacccccttcggccagcagcgggtcttcaaggagaaggtggacacccgcacccccaaggccaagcgggggacggcccagatcatggaggtgaccgccaagtggctgtggggcttcctgtcccgcaacaagaagccgcggatctgcacccgcgaggagttcacccggaaggtccgcagcaacgccgcgatcggggccgtgttcgtggacgagaaccagtggaactccgccaaggaggccgtcgaggacgagcggttctgggacctcgtgcgccgggagcgcgagctgcacaagcagggcaagtgcgcgacgtgcgtgtacaacatgatggggaagcgggagaagaagctgggcgagttcggcaaggccaaggggagccgcgccatctggtacatgtggctcggcgcccggttcctggagttcgaggccctggggttcatgaacgaggaccactggttctcccgcgagaacagcctctccggcgtcgagggggagggcctgcacaagctgggctacatcctccgggacatcagcaagatccccgggggcaacatgtacgcggacgacaccgccgggtgggacacccgcatcaccgaggacgacctgcagaacgaggccaagatcacggacatcatggagcccgagcacgccctgctcgccacctccatcttcaagctgacctaccagaacaaggtggtgcgggtccagcgcccggcgaagaacggcaccgtgatggacgtgatcagccgccgggaccagcgcggctccgggcaggtcggcacgtacgggctgaacaccttcaccaacatgggcgcccagctcatccggcagatggagagcgaggggatcttctcccccagcgagctggagacccccaacctggccggccgcgtgctcgactggctggagaagcacggcatcgagcggctgcgccggatggccatctccggggacgactgcgtggtcaagcccatcgacgaccgcttcgccacggcgctcaccgccctgaacgacatgggcaaggtgcggaaggacatcccgcagtgggagcccagcaaggggtggaacgactggcagcaggtccccttctgcagccaccacttccaccagctgatcatgaaggacggccgcgagatcgtcgtgccctgccggaaccaggacgagctcgtggggcgcgcccgggtctcccagggcgccggctggagcctgcgcgagaccgcctgcctggggaagtcctacgcgcagatgtggcagctcatgtacttccaccggcgcgacctgcggctggccgccaacgccatctgcagcgcggtgccggtggactgggtccccacctcccgcacgacctggagcatccacgcccaccaccagtggatgaccaccgaggacatgctctccgtgtggaaccgggtgtggatcgaggagaacccctggatggaggacaagacgcacgtcagctcctgggaggacgtgccctacctgggcaagcgcgaggaccagtggtgcgggagcctgatcggcctcaccgcccgcgccacctgggccaccaacatccaggtggcgatcaaccaggtccggcgcctgatcgggaacgagaactacctggactacatgacctccatgaagcggttcaagaacgagagcgacccggagggcgccctctggtga

SEQ ID NO: 8986 - RNA, 9879 nt, synthetic construct
  misc_feature 1..9879: note = derived and/or modified CDS sequence (opt1) from DENV-1__DQ285562__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagacctccgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctggggctcgagacgcgcaccgagacctggatgagctccgagggcgcctggcggcagatccagaaggtcgagacctgggccctgcgccaccccgggttcacggtgatcgccctgttcctcgcgcacaccatcggcaccagcatcacccagaaggggatcatcttcatcctgctgatgctcgtgacgccctccatggccatgcggtgcgtcggcatcggcaaccgcgacttcgtggaggggctgagcggcgccacctgggtggacgtcgtgctggagcacgggtcctgcgtgaccaccatggccaagaacaagcccacgctcgacatcgagctgctgaagaccgaggtcaccaaccccgccgtgctccggaagctgtgcatcgaggcgaagatcagcaacaccacgaccgactcccgctgccccacccagggcgaggccaccctggtggaggagcaggacgccaacttcgtctgccggcgcacgttcgtggaccggggctgggggaacggctgcggcctcttcggcaaggggagcctgctgacctgcgccaagttcaagtgcgtgaccaagctcgagggcaagatcgtccagtacgagaacctgaagtactccgtgatcgtgaccgtccacacgggcgaccagcaccaggtggggaacgagaccaccgagcacggcaccatcgccaccatcacgccccaggcgcccaccagcgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggacctccggggccagcaccagccaggagacgtggaaccggcaggacctcctggtgaccttcaagaccgcccacgccaagaagcaggaggtcgtggtgctgggctcccaggagggcgcgatgcacaccgccctcacgggggccaccgagatccagaccagcggcaccacgaccatcttcgccgggcacctgaagtgccgcctgaagatggacaagctcaccctgaagggcgtctcctacgtgatgtgcaccgggagcttcaagctggagaaggaggtggccgagacgcagcacggcaccgtcctggtccaggtgaagtacgagggcaccgacgcgccctgcaagatccccttctccacccaggacgagaagggggtcacgcagaacggccggctcatcaccgccaacccgatcgtgaccgacaaggagaagcccgtgaacatcgagaccgagccgcccttcggggagagctacatcgtcatcggcgccggcgagaaggccctgaagctgtcctggttcaagaaggggagctccatcggcaagatgttcgaggcgacggcccgcggggcccggcgcatggccatcctcggcgacaccgcctgggacttcgggagcatcggcggcgtgttcacctccgtggggaagctggtccaccaggtgttcggcaccgcgtacggggtgctgttcagcggcgtctcctggacgatgaagatcgggatcggcatcctcctgacctggctgggcctcaacagccgctccaccagcctgtccatgacctgcatcgtggtggggatggtcacgctgtacctcggcgtgatggtgcaggccgacagcgggtgcgtcatcaactggaagggccgggagctgaagtgcgggtccggcatcttcgtgaccaacgaggtgcacacctggaccgagcagtacaagttccaggccgacagcccgaagcgcctgagcgccgccatcggcaaggcgtgggaggagggggtctgcggcatccggtccgccacccgcctcgagaacatcatgtggaagcagatcagcaacgagctgaaccacatcctgctcgagaacgacatgaagttcacggtggtggtcggggacgccaacggcatcctgacccaggggaagaagatgatccggccccagcccatggagcacaagtactcctggaagtcctggggcaaggccaagatcatcggcgccgacatccagaacaccaccttcatcatcgacgggcccgacacgccggagtgccccgacgaccagcgcgcgtggaacatctgggaggtggaggactacggcttcgggatcttcaccaccaacatctggctgaagctccgggactcctacacccagatgtgcgaccaccgcctgatgagcgccgccatcaaggactccaaggccgtgcacgcggacatgggctactggatcgagagcgagaagaacgagacgtggaagctggcccgggcctccttcatcgaggtcaagacctgcatctggccccgcagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtggtcgtggacgagcactgcggcaaccgcgggccgagcctccggaccacgaccgtgaccggcaagatcatccacgagtggtgctgccgctcctgcaccctgccgcccctgcggttcaagggggaggacggctgctggtacgggatggagatccgccccgtcaaggagaaggaggagaacctcgtgcggagcatggtgtccgccggcagcggcgaggtcgacagcttctccctggggctgctctgcgtgagcatcatggtggaggaggtcatgcgctcccggtggagccgcaagatgctgatgacgggcaccctggcggtgttcttcctcctgatcatggggcagctgacctggaacgacctcatccgcctgtgcatcatggtgggcgccaacgtctccgaccggatggggatgggcaccacgtacctggccctcatggccaccttcaagatgcgcccgatgttcgccgtggggctgctgttccggcgcctcaccagccgggaggtcctgctgctcaccatcgggctgtccctggtggcgagcgtggagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcctggaagaccatcgccatggtcctgtccatcgtgagcctgttccccctctgcctgtccaccacgagccagaagaccacctggctgcccgtgctcctgggctccttcgggtgcaagccgctgaccatgttcctcatcaccgagaacaagatctggggccgcaagagctggcccctgaacgaggggatcatggccgtcggcatcgtgtccatcctgctcagcagcctgctgaagaacgacgtgcccctcgcggggcccctgatcgccggcggcatgctgatcacgtgctacgtcatctccgggagctccgccgacctcagcctggagaaggccgcggaggtgtcctgggaggaggaggccgagcacagcggcgcctcccacaacatcctggtggaggtccaggacgacgggaccatgaagatcaaggacgaggagcgggacgacaccctcaccatcctgctgaaggccacgctcctggccgtgagcggcgtgtacccgatgtccatccccgcgaccctgttcgtctggtacttctggcagaagaagaagcagcgcagcggggtgctctgggacacccccagcccgcccgaggtggagcgggccgtcctggacgacggcatctaccgcatcctgcagcggggcctgctcgggcgcagccaggtgggcgtgggggtcttccaggacggcgtgttccacaccatgtggcacgtgacgcgcggggccgtcctgatgtaccagggcaagcgcctggagccctcctgggccagcgtgaagaaggacctcatctcctacggcgggggctggcggttccaggggagctggaacaccggcgaggaggtgcaggtcatcgccgtggagcccgggaagaaccccaagaacgtgcagaccacccccggcacgttcaagacccccgagggcgaggtcggggcgatcgccctggacttcaagcccggcacctccgggagccccatcgtgaaccgcgagggcaagatcgtgggcctgtacgggaacggcgtcgtgaccacgtccgggacctacgtgagcgccatcgcccaggccaaggcgagccaggagggcccgctccccgagatcgaggacgaggtcttcaagaagcggaacctgaccatcatggacctgcaccccgggtccggcaagacccgccggtacctcccggccatcgtgcgcgaggccatcaagcggaagctgcgcacgctgatcctcgcccccacccgcgtggtcgccagcgagatggcggaggccctgaagggcatgcccatccggtaccagaccaccgccgtgaagtccgagcacacggggcgcgagatcgtggacctgatgtgccacgccaccttcaccatgcggctcctgagccccgtccgcgtgccgaactacaacatgatcatcatggacgaggcgcacttcaccgaccccgcctccatcgccgcccggggctacatcagcacgcgcgtggggatgggcgaggccgcggccatcttcatgaccgccacgccgcccgggtccgtcgaggccttcccgcagagcaacgccgtgatccaggacgaggagcgggacatccccgagcgctcctggaacagcggctacgactggatcaccgacttccccggcaagacggtgtggttcgtcccctccatcaagagcgggaacgacatcgcgaactgcctgcggaagaacggcaagcgcgtgatccagctctcccggaagaccttcgacaccgagtaccagaagaccaagaacaacgactgggactacgtggtcacgaccgacatcagcgagatgggggccaacttccgcgccgaccgggtgatcgacccgcgccggtgcctgaagcccgtcatcctgaaggacggccccgagcgcgtgatcctcgccgggcccatgccggtgaccgtcgcctccgcggcccagcggcgcggccggatcggccgcaaccagaacaaggagggggaccagtacatctacatgggccagcccctgaacaacgacgaggaccacgcccactggaccgaggccaagatgctgctcgacaacatcaacacgcccgaggggatcatccccgcgctgttcgagccggagcgcgagaagtccgccgccatcgacggcgagtaccggctgcgcggggaggcccggaagaccttcgtggagctcatgcgccggggcgacctgcccgtgtggctgtcctacaaggtcgccagcgagggcttccagtactccgaccgccggtggtgcttcgacggggagcgcaacaaccaggtgctcgaggagaacatggacgtggagatctggaccaaggagggcgagcggaagaagctgcgcccccggtggctggacgcgcgcacctacagcgaccccctcgccctgcgggagttcaaggagttcgccgccgggcgccggagcgtctccggcgacctgatcctcgagatcggcaagctgccgcagcacctgaccctccgcgcccagaacgcgctggacaacctggtgatgctccacaacagcgagcagggcgggaaggcctaccggcacgccatggaggagctgcccgacacgatcgagaccctgatgctcctggccctgatcgccgtgctcaccgggggcgtcaccctgttcttcctgtccgggaagggcctcggcaagacgagcatcgggctgctgtgcgtgatggcgtccagcgtgctcctgtggatggcctccgtcgagccccactggatcgccgccagcatcatcctggagttcttcctcatggtgctgctgatccccgagccggaccgccagcggacgccccaggacaaccagctcgcgtacgtggtcatcggcctgctgttcatgatcctcaccgtggccgccaacgagatggggctgctggagaccacgaagaaggacctcggcatcgggcacgccgtggccgagaaccaccaccacgcgaccatgctggacatcgacctgcaccccgcctccgcctggaccctctacgccgtcgccaccacgatcatcaccccgatgatgcgccacaccatcgagaacaccacggcgaacatcagcctgaccgccatcgccaaccaggccgccatcctgatgggcctcgacaagggctggcccatctccaagatggacatcggggtgcccctgctggcgctcggctgctacagccaggtgaaccccctgaccctgaccgccgccgtcctcatgctggtggcccactacgccatcatcgggccgggcctgcaggcgaaggccacgcgggaggcccagaagcgcaccgccgcggggatcatgaagaaccccaccgtggacggcatcgtcgccatcgacctcgaccccgtggtgtacgacgccaagttcgagaagcagctgggccagatcatgctgctcatcctgtgcacctcccagatcctgctcatgcgcacgacctgggccctgtgcgagagcatcaccctggccaccgggcccctcacgaccctgtgggagggctccccggggaagttctggaacaccaccatcgcggtcagcatggccaacatcttccggggctcctacctggccggcgccgggctcgccttcagcctgatgaagtccctgggcgggggccgccgggggacgggcgcgcagggcgagaccctcggggagaagtggaagcgccagctgaaccagctgagcaagagcgagttcaacacctacaagcggtccggcatcatggaggtggaccgcagcgaggccaaggaggggctcaagcggggcgagaccacgaagcacgccgtgtcccgcgggaccgccaagctgcggtggttcgtcgagcgcaacctggtgaagcccgagggcaaggtgatcgacctgggctgcgggcggggcgggtggagctactactgcgccggcctcaagaaggtcaccgaggtgaaggggtacaccaagggcggccccgggcacgaggagcccatcccgatggcgacctacggctggaacctggtgaagctgcactccgggaaggacgtcttcttcacgccgcccgagaagtgcgacaccctcctgtgcgacatcggcgagagctcccccaacccgaccatcgaggaggggcgcaccctgcgggtgctcaagatggtggagccctggctgcgcggcaaccagttctgcatcaagatcctgaacccctacatgcccagcgtcgtggagacgctcgagcagatgcagcggaagcacggcgggatgctggtgcgcaacccgctgtcccggaacagcacccacgagatgtactgggtctcctgcggcaccgggaacatcgtgagcgccgtgaacatgacctcccgcatgctcctgaaccggttcacgatggcccaccgcaagcccacctacgagcgcgacgtcgacctgggcgccggcacccggcacgtggcggtggagcccgagatcgccaacctcgacatcatcgggcagcgcatcgagaacatcaagaacgagcacaagagcacctggcactacgacgaggacaacccctacaagacgtgggcctaccacggctcctacgaggtcaagccgagcgggtccgccagctccatggtgaacggcgtcgtgcggctgctgaccaagccctgggacgtgatccccatggtcacccagatcgccatgaccgacacgacccccttcgggcagcagcgcgtgttcaaggagaaggtggacacccggaccccgcgccccaagcggggcacggcgcagatcatggaggtcaccgccaagtggctctggggcttcctgagccgcaacaagaagccccggatctgcacccgcgaggagttcacccggaaggtgcgcagcaacgccgccatcggggccgtgttcgtcgacgagaaccagtggaactccgcgaaggaggccgtggaggacgagcggttctgggacctggtgcaccgcgagcgggagctccacaagcagggcaagtgcgccacgtgcgtctacaacatgatggggaagcgcgagaagaagctgggcgagttcgggaaggccaagggcagccgggccatctggtacatgtggctgggcgcgcgcttcctcgagttcgaggccctggggttcatgaacgaggaccactggttctcccgggagaacagcctgtccggcgtggagggggagggcctccacaagctggggtacatcctgcgcgacatcagcaagatcccgggcggcaacgtgtacgccgacgacaccgccgggtgggacacccggatcaccgaggacgacctccagaacgaggcgaagatcacggacatcatggagcccgagcacgccctgctggccacctccatcttcaagctcacctaccagaacaaggtcgtgcgcgtgcagcgccccgccaagagcggcaccgtcatggacatcatctcccggcgcgaccagcgggggagcggccaggtgggcacgtacgggctgaacaccttcaccaacatggaggtgcagctgatccgccagatggagtccgagggcatcttcagcccctccgagctcgagaacagcaacctggccgagcgggtcctggactggctcgagaagcacggggtggagcgcctgaagcggatggcgatctccggcgacgactgcgtggtcaagccgaccgacgaccgcttcgccacggccctgaccgccctcaacgacatggggaaggtgcggaaggacatcccccagtgggagcccagcaagggctggaacgactggcagcaggtccccttctgctcccaccacttccaccagctgatcatgaaggacggccgcgagatcgtcgtgccgtgccggaaccaggacgagctggtggggcgcgcccgggtcagccagggcgcggggtggagcctccgcgagaccgcctgcctgggcaagtcctacgcccagatgtggcagctgatgtacttccaccggcgcgacctccggctggccgccaacgcgatctgcagcgccgtgcccgtggactgggtccccacctcccgcaccacgtggagcatccacgcccaccaccagtggatgaccaccgaggacatgctgtccgtgtggaaccgggtgtggatcgaggagaacccctggatggaggacaagacccacgtcagctcctgggaggacgtgccgtacctcgggaagcgcgaggaccagtggtgcggcagcctgatcggcctgacggcccgcgccacctgggcgaccaacatccaggtggccatcaagcaggtccggcgcctcatcgggaacgagaactacctggactacatgacctccatgaagcggttcaagaacgagagcgaccccgagggcgccctgtggtga

SEQ ID NO: 8987 - RNA, 9879 nt, synthetic construct
  misc_feature 1..9879: note = derived and/or modified CDS sequence (opt1) from DENV-1__DQ285558__SS-prME
  source 1..9879: mol_type = other RNA
agcgtgaccatgctgctcatgctgctgcccaccgccctcaccttccacctgaccacccgcggcggggagccccacatgatcgtgggcaagcaggagcggggcaagagcctgctgttcaagaccagcgccggggtgaacatgtgcaccctgatcgcgatggacctgggggagctctgcgacgacaccatgacctacaagtgcccccgcatcaccgagacggagcccgacgacgtggactgctggtgcaacgccaccgagacctgggtgacctacggcacgtgcagccagaccggcgagcaccggcgcgacaagcggagcgtggccctggcgccccacgtggggctgggcctcgagacccgcaccgagacgtggatgtccagcgagggggcctggcggcagatccagaaggtggagacctgggccctgcgccaccccggcttcaccgtgatcgccctgttcctcgcccacgccatcgggacctccatcacgcagaagggcatcatcttcatcctgctgatgctcgtgacccccagcatggcgatgcggtgcgtcggcatcgggaaccgcgacttcgtggagggcctgtccggggccacctgggtggacgtcgtgctggagcacggcagctgcgtgaccacgatggccaaggacaagcccaccctcgacatcgagctgctgaagaccgaggtcaccaaccccgccgtgctccggaagctgtgcatcgaggccaagatctccaacacgaccaccgacagccgctgcccgacccagggcgaggcgacgctggtggaggagcaggacaccaacttcgtctgccggcgcaccttcgtggaccgggggtggggcaacgggtgcggcctcttcgggaagggctccctgatcacgtgcgccaagttcaagtgcgtgacgaagctggagggcaagatcgtccagtacgagaacctcaagtacagcgtgatcgtgaccgtccacaccggggaccagcaccaggtgggcaacgagaccaccgagcacgggacgatcgccaccatcacgccccaggcccccacctccgagatccagctgacggactacggcgccctgaccctcgactgcagcccccgcaccgggctggacttcaacgagatggtcctgctcaccatgaaggagaagtcctggctggtgcacaagcagtggttcctggacctcccgctgccctggacgagcggcgcgtccaccagccaggagacctggaaccggcaggacctgctcgtgaccttcaagacggcccacgccaagaagcaggaggtcgtggtgctgggcagccaggagggggccatgcacaccgccctgaccggcgcgaccgagatccagacgtccgggaccaccaccatcttcgccggccacctcaagtgccgcctgaagatggacaagctgacgctcaaggggatcagctacgtcatgtgcaccggctccttcaagctggagaaggaggtggccgagacccagcacggcaccgtgctggtccaggtgaagtacgaggggacggacgccccctgcaagatccccttcagctcccaggacgagaagggcgtgacccagaacgggcggctggtcaccgccaacccgatcgtgaccgacaaggagaagcccgtgaacatcgaggcggagccgcccttcggcgagagctacatcgtcgtgggcgccggggagaaggccctcaagctgtcctggttcaagaagggcagctccatcgggaagatgttcgaggccacggcgcgcggcgcccggcgcatggccatcctgggggacaccgcctgggacttcggcagcatcggcggggtgttcacctccgtcggcaagctcgtgcaccagatcttcgggaccgcctacggcgtgctgttcagcggggtctcctggacgatgaagatcggcatcggcatcctgctcacctggctggggctgaacagccgctccaccagcctctccatgacctgcatcgcggtgggcctgatcacgctgtacctcggggtgatggtccaggccgacagcggctgcgtgatcaactggaaggggcgggagctgaagtgcggctccggcatcttcgtgaccaacgaggtccacacctggaccgagcagtacaagttccaggccgacagcccgaagcgcctgagcgccgccatcgggaaggcgtgggaggagggcgtgtgcgggatccggtccgccacccgcctcgagaacatcatgtggaagcagatcagcaacgagctgaaccacatcctgctcgagaacgacatgaagttcacggtggtcgtgggcgacgtgtccgggatcctggcccagggcaagaagtccatccggccccagcccatggagcacaagtactcctggaagtcctggggcaaggccaagatcatcggggccgacgtccagaacaccaccttcatcatcgacggccccaacaccccggagtgccccgacgaccagcgcgcgtggaacatctgggaggtggaggactacgggttcggcatcttcacgaccaacatctggctgaagctccgggactcctacacccaggtgtgcgaccaccgcctgatgagcgccgccatcaaggactccaaggccgtccacgcggacatgggctactggatcgagagcgagaagaacgagacctggaagctggcccgggcctccttcatcgaggtgaagacgtgcatctggcccaagagccacaccctctggtccaacggggtgctggagagcgagatgatcatccccaagatctacggcgggccgatctcccagcacaactaccgccccggctacttcacccagaccgccgggccctggcacctgggcaagctcgagctggacttcgacctgtgcgagggcacgaccgtcgtggtggacgagcactgcgggaaccggggcccgagcctccgcaccaccacggtcaccgggaagatcatccacgagtggtgctgccggtcctgcaccctgccgcccctgcgcttcaagggcgaggacgggtgctggtacggcatggagatccggcccgtgaaggagaaggaggagaacctcgtcaagagcatggtcagcgccggctccggggaggtggacagcttctccctgggcctgctctgcatcagcatcatgatcgaggaggtgatgcgctcccggtggagccgcaagatgctgatgaccgggacgctggcggtcttcctcctgctgaccatgggccagctcacctggaacgacctgatccggctgtgcatcatggtgggggccaacgcctccgacaacatgggcatgggcaccacgtacctcgccctgatggccaccttccgcatgcgcccgatgttcgcggtggggctcctgttccggcgcctgaccagccgggaggtcctgctcctgaccgtgggcctgtccctcgtcgccagcgtggagctgcccaactccctggaggagctcggggacggcctggccatgggcatcatgatcctgaagctcctgacggacttccagagccaccagctgtgggccaccctcctgtccctgaccttcgtgaagaccacgttcagcctccactacgcctggaagaccatggcgatgatcctgtccatcgtcagcctgttccccctctgcctgtccaccaccagccagaagacgacctggctgcccgtgctcctggggtccctgggctgcaagccgctcaccatgttcctgatcaccgagaacaagatctgggggcgcaagagctggcccctgaacgagggcatcatggccgtggggatcgtcagcatcctcctgtccagcctgctcaagaacgacgtgcccctggccggccccctgatcgccggcgggatgctcatcgcgtgctacgtgatctccggcagctccgccgacctgagcctggagaaggccgccgaggtctcctgggaggaggaggccgagcacagcggggcgtcccacaacatcctcgtggagatccaggacgacggcaccatgaagatcaaggacgaggagcgggacgacacgatcaccatcctgctgaaggccaccctcctggccatcagcggggtgtacccgatgtccatccccgccaccctgttcgtctggtacttctggcagaagaagaagcagcgcagcggcgtgctctgggacacgcccagcccgcccgaggtggagcgggccgtcctggacgacggcatctaccgcatcctgcagcgggggctgctcggccgcagccaggtgggggtgggcgtcttccaggagggggtgttccacaccatgtggcacgtgacccggggcgcggtcctgatgtaccagggcaagcgcctggagccctcctgggccagcgtgaagaaggacctcatctcctacgggggcgggtggcggttccagggcagctggaacaccggggaggaggtgcaggtcatcgccgtggagcccggcaagaaccccaagaacgtgcagacggcccccggcaccttcaagacctccgagggggaggtcggcgccatcgcgctggacttcaagcccgggaccagcggcagccccatcgtgaaccgcgagggcaagatcgtggggctgtacggcaacggggtcgtgacgacctccggcacctacgtgagcgccatcgcccaggccaaggcctcccaggaggggcccctcccggagatcgaggacgaggtcttccggaagcgcaacctgaccatcatggacctgcaccccggcagcggcaagacgcggcgctacctccccgcgatcgtgcgggaggccatcaagcgcaagctgcggaccctggtgctcgccccgacccgcgtcgtggcctccgagatggcggaggccctgaaggggatgcccatccgctaccagaccacggccgtcaagagcgagcacaccggccgggagatcgtcgacctgatgtgccacgccaccttcaccatgcgcctcctgtcccccgtgcgggtgcccaactacaacatgatcatcatggacgaggcccacttcacggacccggcgagcatcgccgcccgcgggtacatctccacccgggtcggcatgggggaggccgccgcgatcttcatgaccgccacgccgcccggcagcgtggaggccttcccccagtccaacgccgtgatccaggacgaggagaaggacatcccggagcgcagctggaactccggctacgactggatcacggacttccccgggaagaccgtctggttcgtgcccagcatcaagtccggcaacgacatcgccaactgcctgcggaagaacgggaagcgcgtgatccagctcagccggaagaccttcgacaccgagtaccagaagacgaagaacaacgactgggactacgtcgtgaccaccgacatctccgagatgggcgcgaacttccgcgccgaccgggtgatcgacccccgccggtgcctgaagccggtcatcctgaaggacgggcccgagcgcgtgatcctcgccggccccatgcccgtcaccgtggccagcgcggcccagcggcgcggccggatcgggcgcaaccagaacaaggagggcgaccagtacatctacatggggcagccgctgaacaacgacgaggaccacgcccactggacggaggccaagatgctgctcgacaacatcaacacccccgagggcatcatccccgccctgttcgagcccgagcgggagaagtccgcggccatcgacggggagtaccgcctgcgcggcgaggcccggaagaccttcgtggagctcatgcgccggggcgacctgccggtctggctgagctacaaggtggccagcgaggggttccagtactccgaccgccggtggtgcttcgacggcgagcgcaacaaccaggtgctcgaggagaacatggacgtcgagatctggaccaaggagggggagcggaagaagctgcgcccccggtggctggacgcccgcacgtacagcgaccccctcgcgctgcgggagttcaaggagttcgccgccggccgccggtccgtgagcggcgacctgatcctcgagatcgggaagctgccccagcacctgacccagcgcgcccagaacgccctcgacaacctggtgatgctgcacaactccgagcagggcgggaaggcgtaccggcacgccatggaggagctcccggacaccatcgagaccctgatgctgctcgccctgatcgccgtcctgaccggcggggtgaccctcttcttcctgagcggccgcggcctggggaagacctccatcggcctcctgtgcgtgatgagctccagcgcgctgctctggatggcctccgtcgagccccactggatcgccgccagcatcatcctggagttcttcctgatggtgctcctgatccccgagcccgaccggcagcgcaccccgcaggacaaccagctggcctacgtggtcatcgggctcctgttcatgatcctgaccgtggcggccaacgagatgggcctcctggagacgaccaagaaggacctggggatcggccacgccgccgccgagaaccaccaccacgcggccatgctcgacgtggacctgcaccccgcctccgcctggaccctgtacgccgtcgcgaccacgatcatcacccccatgatgcggcacaccatcgagaacaccacggccaacatcagcctcaccgccatcgccaaccaggccgcgatcctgatgggcctggacaaggggtggccgatctccaagatggacatcggcgtgcccctcctggccctggggtgctacagccaggtgaaccccctcaccctgaccgccgccgtcctgatgctcgtggcgcactacgccatcatcggccccgggctgcaggccaaggccacgcgcgaggcccagaagcggaccgcggccggcatcatgaagaacccgaccgtggacggcatcgtcgccatcgacctggaccccgtggtgtacgacgccaagttcgagaagcagctcgggcagatcatgctgctgatcctctgcacctcccagatcctgctgatgcgcacgacctgggccctctgcgagagcatcaccctggcgaccggccccctgacgaccctctgggaggggtcccccggcaagttctggaacaccaccatcgccgtcagcatggccaacatcttccgcggcagctacctggccggggccggcctggcgttctccctcatgaagtccctcgggggcgggcggcgcggcacgggcgcccagggggagaccctgggcgagaagtggaagcggcagctcaaccagctgtccaagagcgagttcaacatctacaagcgctccgggatcgtggaggtggaccggagcgaggccaaggagggcctgaagcgcggggagaccatcaagcacgccgtctcccggggcaccgcgaagctccgctggttcgtggagcggaacctggtgaagccggagggcaaggtcatcgacctggggtgcggccgcgggggctggagctactactgcgccgggctgaagaaggtgacggaggtgaagggctacaccaagggcgggcccggccacgaggagcccatccccatggccacctacgggtggaacctcgtcaagctgtactccggcaaggacgtgttcttcatcccgcccgagaagtgcgacaccctgctctgcgacatcggggagagctcccccaaccccacgatcgaggagggccggaccctgcgcgtgctgaagatggtcgagccgtggctccggggcaaccagttctgcatcaagatcctgaacccctacatgcccagcgtggtggagaccctggagcagatgcagcgcaagcacgggggcatgctcgtccggaaccccctgtcccgcaacagcacccacgagatgtactgggtgtcctgcgggaccggcaacatcgtgagcgccgtcaacatgacgtcccggatgctgctcaaccgcttcaccatggcccaccggaagccgacctacgagcgcgacgtggacctgggcgcggggacccgccacgtggccgtcgagcccgaggtggccaacctggacatcatcggccagcggatcgagaacatcaagaacgagcacaagagcacgtggcactacgacgaggacaacccctacaagacctgggcctaccacgggtcctacgaggtgaagcccagcggcagcgcctccagcatggtcaacggggtggtccgcctcctgaccaagccgtgggacgtgatccccatggtgacccagatcgcgatgacggacaccacccccttcggccagcagcgggtcttcaaggagaaggtggacacccgcacgcccaaggccaagcggggcaccgcccagatcatggaggtgaccgccaagtggctgtgggggttcctctcccgcaacaagaagccgcggatctgcacccgcgaggagttcacgcggaaggtccgcagcaacgccgcgatcggcgccgtgttcgtggacgagaaccagtggaactccgccaaggaggccgtcgaggacgagcggttctgggacctggtgcgccgggagcgcgagctgcacaagcaggggaagtgcgcgacctgcgtgtacaacatgatgggcaagcgggagaagaagctcggggagttcggcaaggccaagggcagccgcgccatctggtacatgtggctgggggcccggttcctggagttcgaggccctcggcttcatgaacgaggaccactggttctcccgcgagaacagcctgtccggggtcgagggcgaggggctgcacaagctcggctacatcctgcgggacatcagcaagatccccggcgggaacatgtacgcggacgacaccgccggctgggacacccgcatcacggaggacgacctgcagaacgaggccaagatcaccgacatcatggagcccgagcacgccctcctggccacctccatcttcaagctgacctaccagaacaaggtggtgcgggtccagcgcccggcgaagaacgggacggtgatggacgtgatcagccgccgggaccagcgcggctccggccaggtcgggacctacggcctcaacaccttcaccaacatgggggcccagctgatccggcagatggagagcgagggcatcttctcccccagcgagctggagacgcccaacctcgccgggcgcgtgctggactggctggagaagcacggcatcgagcggctccgccggatggccatctccggcgacgactgcgtggtcaagcccatcgacgaccgcttcgccaccgcgctgaccgccctgaacgacatggggaaggtgcggaaggacatcccgcagtgggagcccagcaagggctggaacgactggcagcaggtccccttctgcagccaccacttccaccagctcatcatgaaggacgggcgcgagatcgtcgtgccctgccggaaccaggacgagctggtgggccgcgcccgggtctcccagggggccggctggagcctgcgcgagaccgcctgcctcggcaagtcctacgcgcagatgtggcagctgatgtacttccaccggcgcgacctgcggctcgccgccaacgccatctgcagcgcggtgccggtggactgggtccccacgtcccgcaccacctggagcatccacgcccaccaccagtggatgaccacggaggacatgctgtccgtgtggaaccgggtgtggatcgaggagaacccctggatggaggacaagacccacgtcagctcctgggaggacgtgccctacctggggaagcgcgaggaccagtggtgcggcagcctcatcgggctgaccgcccgcgccacctgggccaccaacatccaggtggcgatcaaccaggtccggcgcctgatcggcaacgagaactacctcgactacatgacgtccatgaagcggttcaagaacgagagcgacccggagggggccctgtggtga

SEQ ID NO: 8988 - RNA, 9879 nt, synthetic construct
  misc_feature 1..9879: note = derived and/or modified CDS sequence (opt1) from DENV-1__DQ285559__SS-prME
  source 1..9879: mol_type = other RNA
agcgtgaccatgctgctcatgctgctgcccaccgccctcaccttccacctgaccacccgcggcggggagccgcacatgatcgtgagcaagcaggagcggggcaagagcctgctgttcaagaccagcgtgggggtgaacatgtgcaccctgatcgccatggacctgggcgagctctgcgaggacaccatgacctacaagtgcccccgcatcaccgaggcggagcccgacgacgtggactgctggtgcaacgccaccgacacctgggtgacctacgggacctgcagccagacgggcgagcaccggcgcgacaagcggtccgtggccctggcgccccacgtcggcctggggctcgagacccgcaccgagacctggatgagctccgagggcgcctggaagcagatccagaaggtggagacgtgggcgctgcggcaccccgggttcaccgtgatcgccctgttcctcgcccacgccatcggcaccagcatcacccagaaggggatcatcttcatcctgctgatgctcgtgacgccctccatggcgatgcgctgcgtgggcatcggcaaccgggacttcgtggaggggctgagcggcgccacctgggtcgacgtggtgctggagcacgggtcctgcgtcaccaccatggccaagaacaagcccacgctcgacatcgagctgctgaagaccgaggtgaccaaccccgccgtgctccgcaagctgtgcatcgaggccaagatcagcaacaccacgaccgactcccggtgccccacccagggcgaggcgaccctggtcgaggagcaggacgccaacttcgtgtgccgccggacgttcgtggaccgcggctgggggaacggctgcggcctgttcggcaaggggagcctgctgacctgcgccaagttcaagtgcgtcaccaagctcgagggcaagatcgtgcagtacgagaacctgaagtactccgtgatcgtcaccgtgcacacgggcgaccagcaccaggtcgggaacgagaccaccgagcacggcaccatcgccaccatcacgccccaggcccccaccagcgagatccagctgatcgactacggggcgctcaccctggactgcagcccccggaccggcctggacttcaacgagatggtgctcctgacgatgaaggggaagtcctggctggtgcacaagcagtggttcctcgacctgccgctgccctggacctccggcgccagcaccagccaggagacctggaaccgccaggacctcctggtcacgttcaagaccgcccacgccaagaagcaggaggtggtggtcctgggctcccaggagggggccatgcacaccgcgctcaccggcgccacggagatccagaccagcgggaccaccacgatcttcgccggccacctgaagtgccggctgaagatggacaagctcaccctgaaggggatgtcctacgtgatgtgcaccggcagcttcaagctggagaaggaggtggccgagacccagcacggcacggtcctggtccaggtgaagtacgaggggaccgacgccccctgcaagatccccttctccacccaggacgagaagggcgtcacccagaacgggcgcctcatcacggcgaacccgatcgtgaccgacaaggagaagcccgtgaacatcgagaccgagccgcccttcggcgagagctacatcgtcgtgggcgccggggagaaggccctgaagctgtcctggttcaagaagggcagctccatcgggaagatgttcgaggccaccgcgcggggcgcccgccggatggccatcctcggggacacggcctgggacttcggcagcatcggcggggtgttcacctccgtcggcaagctgacccaccaggtgttcgggaccgcctacggcgtgctgttcagcggggtctcctggacgatgaagatcggcatcggcatcctcctgacctggctggggctcaacagccgctccaccagcctgtccatgacctgcatcgcggtgggcatggtgacgctgtacctcggggtcatggtgcaggccgacagcggctgcgtgatcaactggaaggggcgcgagctgaagtgcggctccggcatcttcgtcaccaacgaggtgcacacctggaccgagcagtacaagttccaggccgacagcccgaagaagctgagcgccgccatcgggaaggcgtgggaggagggcgtgtgcgggatccggtccgccacccgcctcgagaacatcatgtggaagcagatcagcaacgagctgaactacatcctgctcgagaacgacatgaagttcacggtcgtggtgggcgacgccaacgggatcctggcccagggcaagaagatgatccggccccagcccatggagcacaagtactcctggaagtcctggggcaaggccaagatcatcggggcggacatccagaacaccaccttcatcatcgacggccccgacaccccggagtgccccgacgaccagcgcgcctggaacatctgggaggtcgaggactacgggttcggcatcttcacgaccaacatctggctgaagctccgggactcctacacccagatgtgcgaccaccgcctgatgagcgccgccatcaaggactccaaggcggtgcacgccgacatgggctactggatcgagagcgagaagaacgagacctggaagctggcccgggcctccttcatcgaggtgaagacgtgcatctggcccaagagccacaccctctggtccaacggggtcctggagagcgagatgatcatccccaagatctacggcgggccgatctcccagcacaactaccgccccggctacttcacccagaccgccgggccctggcacctgggcaagctcgagctggacttcgacctgtgcgagggcacgaccgtggtggtcgacgagcactgcgggaaccggggcccgagcctccgcaccaccacggtgaccgggaagatcatccacgagtggtgctgccggtcctgcaccctgccgcccctgcgcttccggggcgaggacgggtgctggtacggcatggagatccgccccgtgaaggagaaggaggagaacctcgtccggagcatggtgtccgcgggcagcggggaggtggacagcttctccctgggcatcctgtgcgtcagcatcctcatcgaggaggtgatgcgctccaagtggagccggaagatgctgatgaccgggacgctggccgtgttcctcctgctgatcatgggccagctcacctggaacgacctgacccgcctgtgcatcatggtcggggccaacgcctccgaccggatgggcatgggcaccacgtacctcgccctgatggccaccttcaagatgcgcccgatgttcgccgtggggctcctcttccgccggctgaccagccgcgaggtgctgctcctgaccatcgggctgtccctcgtcgccagcgtggagctgcccaactccctggaggagctcggggacggcctggccatgggcatcatgatcctgaagctcctgacggacttccagccccaccagctgtggaccaccctcctgagcctgaccttcatcaagacgaccctctccctggactacgcctggaagaccatggcgatgaccctgagcatcgtctccctcttccccctgtgcctgagcacgacctcccagaagaccacctggctcccggtgctgctggggagcttcggctgcaagcccctcaccatgttcctgatcacggagaacaagatctgggggcggaagtcctggcccatcaacgagggcatcatggccgtggggatcgtcagcatcctgctctccagcctgctgaagaacgacgtgcccctcgccggcccgctgatcgccggcgggatgctgatcgcgtgctacgtgatcagcggctccagcgccgacctctccctggagaaggccgccgaggtcagctgggaggaggaggccgagcactccgggaccagccacaacatcctggtggaggtgcaggacgacggcaccatgaagatcaaggacgaggagcgcgacgacaccctcacgatcctgctgaaggcgaccctcctggccgtctccggggtgtaccccatgagcatccccgccaccctgttcgtgtggtacttctggcagaagaagaagcagcggtccggcgtcctctgggacacccccagcccgcccgaggtggagcgcgccgtgctggacgacggcatctaccggatcctgcagcgcgggctgctcggccggtcccaggtcggggtgggcgtgttccaggacggggtcttccacacgatgtggcacgtgacccgcggcgccgtgctgatgtaccagggcaagcggctggagcccagctgggcgtccgtcaagaaggacctcatcagctacgggggcgggtggcgcttccagggctcctggaacaccggggaggaggtccaggtgatcgccgtcgagcccggcaagaacccgaagaacgtgcagaccacgcccggcaccttcaagacccccgagggggaggtgggcgccatcgccctggacttcaagcccgggaccagcggctccccgatcgtcaaccgggagggcaagatcgtggggctgtacggcaacggggtggtcacgaccagcggcacctacgtgtccgccatcgcgcaggccaaggccagccaggaggggcccctccccgagatcgaggacgaggtgttcaagaagcgcaacctgaccatcatggacctgcacccgggcagcggcaagacgcggcgctacctccccgccatcgtccgggaggccatcaagcgcaagctgcggaccctgatcctcgcgcccacccgcgtggtggcctccgagatggccgaggccctgaaggggatgcccatccggtaccagaccacggcggtcaagagcgagcacaccggccgcgagatcgtggacctgatgtgccacgccaccttcaccatgcgcctcctgtccccggtgcgggtccccaactacaacatgatcatcatggacgaggcccacttcacggaccccgccagcatcgccgcgcgcgggtacatctccacccgggtgggcatgggggaggccgccgccatcttcatgaccgccacgccgcccggcagcgtggaggcgttcccccagtccaacgccgtcatccaggacgaggagaaggacatccccgagcgcagctggaactccggctacgactggatcacggacttccccgggaagaccgtgtggttcgtgcccagcatcaagtccggcaacgacatcgccaactgcctgcggaagaacgggaagcgcgtcatccagctcagccggaagaccttcgacaccgagtaccagaagacgaagaacaacgactgggactacgtggtgaccaccgacatctccgagatgggcgccaacttccgcgccgaccgggtcatcgacccccgccggtgcctgaagcccgtgatcctgaaggacgggcccgagcgcgtgatcctcgcgggcccgatgcccgtcaccgtggccagcgccgcccagcggcgcggccggatcgggcgcaaccagaacaaggagggcgaccagtacgtctacatggggcagcccctgaacaacgacgaggaccacgcgcactggacggaggccaagatgctgctcgacaacatcaacacccccgagggcatcatcccggccctgttcgagcccgagcgggagaagtccgccgccatcgacggggagtaccgcctgcggggcgaggcgcgcaagaccttcgtggagctcatgcgccggggcgacctgcccgtgtggctgagctacaaggtcgcctccgaggggttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacctactccgacccgctcgccctgcgggagttcaaggagttcgccgcgggccgccggagcgtcagcggcgacctgatcctcgagatcgggaagctgccccagcacctgacgctccgcgcccagaacgccctggacaacctggtgatgctccacaactccgagcagggcgggaaggcctaccggcacgccatggaggagctgcccgacaccatcgagaccctgatgctcctggcgctgatcgccgtgctcaccggcggggtcacgctgttcttcctgagcggcaagggcctcgggaagacctccatcggcctgctgtgcgtgatggccagctccgccctcctgtggatggcgagcgtggagccccactggatcgccgcctccatcatcctggagttcttcctcatggtcctgctgatcccggagcccgaccgccagcggacgccccaggacaaccagctcgcctacgtggtgatcgggctgctgttcatgatcctcaccgtcgccgcgaacgagatgggcctgctggagacgaccaagaaggacctcgggatcggccacgtggccgccgagaaccaccaccacgccaccatgctggacgtggacctgcgcccggccagcgcgtggaccctctacgccgtcgccacgaccgtgatcacccccatgatgcggcacaccatcgagaacacgaccgccaacatctccctgaccgccatcgcgaaccaggccgccatcctgatgggcctcgacaaggggtggcccatcagcaagatggacatcggcgtgcccctgctggccctcgggtgctactcccaggtcaacccgctgaccctgacggccgcggtgctcatgctggtggcccactacgccatcatcggccccgggctgcaggccaaggcgacccgcgaggcccagaagcggaccgccgccggcatcatgaagaaccccaccgtcgacggcatcgtggccatcgacctcgaccccgtggtctacgacgcgaagttcgagaagcagctggggcagatcatgctgctcatcctgtgcacgagccagatcctgctcatgcgcaccacctgggccctgtgcgagtccatcaccctggccacgggcccgctcaccaccctgtgggaggggagccccggcaagttctggaacaccacgatcgccgtgtccatggccaacatcttccggggcagctacctggcgggggccggcctcgccttctccctgatgaagtccctcgggggcgggcgccgcgggaccggcgcccagggggagaccctcggcgagaagtggaagcggcagctgaaccagctgtccaagagcgagttcaacacctacaagcgcagcgggatcatggaggtggaccggtccgaggccaaggagggcctcaagcgcggggagacgaccaagcacgcggtcagccggggcaccgccaagctgcgctggttcgtggagcggaacctggtgaagcccgagggcaaggtcatcgacctggggtgcggccgcgggggctggtcctactactgcgccgggctcaagaaggtgaccgaggtgaagggctacaccaagggcgggcccggccacgaggagccgatccccatggccacgtacgggtggaacctggtcaagctgcacagcggcaaggacgtgttcttcatcccgcccgagaagtgcgacaccctcctgtgcgacatcggggagtccagcccgaaccccaccatcgaggagggccggaccctgcgcgtgctcaagatggtcgagccctggctgaagggcaaccagttctgcatcaagatcctgaacccctacatgccgtccgtggtggagacgctcgagcagatgcagcggaagcacgggggcatgctggtccgcaaccccctgagccggaactccacccacgagatgtactgggtgagctgcgggaccggcaacatcgtgtccgcggtcaacatgaccagccgcatgctcctgaaccggttcacgatggcccaccgcaagcccacctacgagcgggacgtggacctgggcgccgggacccgccacgtggccgtcgagcccgaggtggccaacctcgacatcatcggccagcggatcgagaacatcaagaacgagcacaagtccacctggcactacgacgaggacaacccgtacaagacgtgggcgtaccacgggagctacgaggtgaagccctccggcagcgcctccagcatggtcaacggggtggtccgcctgctgaccaagccctgggacgtgatccccatggtgacccagatcgccatgaccgacacgaccccgttcggccagcagcgcgtcttcaaggagaaggtggacacccggacgccccgcgccaagcggggcacggcccagatcatggaggtgaccgcgaagtggctctgggggttcctgtcccgcaacaagaagccccggatctgcacccgcgaggagttcacccggaaggtccgcagcaacgccgccatcggcgccgtgttcgtggacgagaaccagtggaacagcgccaaggaggcggtcgaggacgagcggttctgggacctggtgcaccgcgagcgggagctccacaagcaggggaagtgcgccacgtgcgtgtacaacatgatgggcaagcgcgagaagaagctgggggagttcggcaaggccaagggctcccgggccatctggtacatgtggctgggggcgcgcttcctcgagttcgaggccctgggcttcatgaacgaggaccactggttcagccgggagaactccctgagcggggtcgagggcgaggggctccacaagctgggctacatcctgcgcgacatctccaagatcccgggcgggaacatgtacgccgacgacaccgccggctgggacacccggatcaccgaggacgacctccagaacgaggccaagatcacggacatcatggagcccgagcacgcgctgctggccaccgccatcttcaagctcacctaccagaacaaggtggtgcgcgtccagcggcccgccaagagcgggaccgtgatggacgtgatctcccgccgggaccagcgcggcagcggccaggtcgggacgtacggcctgaacaccttcaccaacatggaggcccagctgatccgccagatggagtccgaggggatcttcctccccagcgagctggagaccccgaacctggcgaagcgggtgctcgactggctggagaagtacggcgccgagcgcctgaagcggatggccatctccggggacgactgcgtggtcaagcccatcgacgaccgcttcgccaaggccctcacggcgctgaacgacatgggcaaggtgcggaaggacatcccccagtgggagcccagcaagggctggaacgactggcagcaggtcccgttctgctcccaccacttccaccagctgatcatgaaggacgggcgcgagatcgtcgtgccctgccggaaccaggacgagctcgtgggccgcgcccgggtcagccagggggccggctggtccctgcgcgagaccgcctgcctgggcaagagctacgcccagatgtggcagctcatgtacttccaccggcgcgacctgcggctggcggccaacgccatctgctccgccgtgcccgtggactgggtccccaccagccgcaccacctggagcatccacgcgcaccaccagtggatgacgaccgaggacatgctctccgtgtggaaccgggtgtggatcgaggagaacccgtggatggaggacaagacccacgtcagctcctgggaggaggtgccctacctgggcaagcgcgaggaccagtggtgcggcagcctgatcgggctcaccgcccgggccacgtgggccaccaacatccaggtggccatcaaccaggtccgccggctgatcggcaacgagaactacctggactacatggcgtccatgaagcgcttcaagaacgagagcgaccccgagggggccctctggtga

SEQ ID NO: 8989 - RNA, 9879 nt, synthetic construct
  misc_feature 1..9879: note = derived and/or modified CDS sequence (opt1) from DENV-1__AF311956__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtcacctacgggacctgcagccagaccggcgagcaccggcgggacaagcggtccgtggccctggcgccccacgtgggcctggggctcgagacccggaccgagacctggatgagctccgagggcgcctggaagcagatccagaaggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccgcaagctgtgcatcgaggccaagatcagcaacaccaccacggactcccggtgcccgacccagggcgaggccaccctggtggaggagcaggacgccaacttcgtctgccgccggaccttcgtggaccgcggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccgccaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtcatgtgcaccgggagcttcaagctggagaaggaggtggcggagacgcagcacggcaccgtgctggtccaggtgaagtacgagggcaccgacgccccctgcaagatccccttctccacccaggacgagaagggggtgacgcagaacggccgcctcatcaccgccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtgttcacctccgtggggaagctggtccaccaggtgttcggcaccgcctacggggtgctgttcagcggcgtctcctggacgatgaagatcgggatcggcatcctcctgacctggctgggcctcaacagccgctccaccagcctgtccatgacctgcatcgccgtggggatggtgacgctgtacctcggcgtcatggtgcaggccgacagcgggtgcgtgatcaactggaagggccgcgagctgaagtgcgggtccggcatcttcgtcaccaacgaggtgcacacctggaccgagcagtacaagttccaggccgacagcccgaagcggctgagcgcggccatcggccgcgcctgggaggagggggtgtgcggcatccggtccgccacccgcctcgagaacatcatgtggaagcagatcagcaacgagctgaaccacatcctgctcgagaacgacatcaagttcacggtcgtggtggggaacgccaacggcatcctggcgcaggggaagaagatgatccggccccagcccatggagcacaagtactcctggaagtcctggggcaaggccaagatcatcggcgccgacatccagaacaccaccttcatcatcgacgggcccgacaccccggagtgccccgacgagcagcgcgcctggaacatctgggaggtcgaggactacggcttcgggatcttcacgaccaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtgaagacgtgcatctggcccaagagccacaccctctggtccaacggcgtcctggagagcgagatgatcatccccaagatgtacgggggcccgatctcccagcacaactaccgccccgggtacttcacccagaccgccggcccctggcacctggggaagctcgagctggacttcgacctgtgcgagggcacgaccgtggtggtcgacgagcactgcggcagccgggggccgtccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtccggtccatggtgagcgccggcagcggcgaggtggactccttcagcctggggatcctgtgcgtctccatcatgatcgaggaggtgatgcgcagccggtggtcccgcaagatgctcatgaccggcacgctggccgtgttcctgctcctgatcatggggcagctgacctggaacgacctcatccgcctgtgcatcatggtcggcgccaacgcgagcgacaagatggggatgggcaccacctacctggccctcatggccacgttcaagatgcggccgatgttcgccgtggggctgctgttccgccggctcacctcccgcgaggtgctgctgctcaccatcgggctgagcctggtcgcctccgtggagctccccaacagcctggaggagctgggcgacgggctcgcgatgggcatcatgatgctgaagctgctcaccgagttccagccccaccagctgtggacgaccctgctctccctgaccttcatcaagaccacgctgagcctcgactacgcctggaagaccaccgccatggtcctgtccatcgtgagcctgttccccctctgcctgtccaccacgagccagaagaccacctggctgccggtgctcctgggctccttcgggtgcaagcccctgaccatgttcctcatcaccgagaacgagatctggggccgcaagagctggcccctgaacgaggggatcatggccatcggcatcgtctccatcctgctcagcagcctgctgaagaacgacgtgcccctcgcggggccgctgatcgccggcggcatgctgatcgcctgctacgtgatctccgggagctccgccgacctcagcctggagaaggccgcggaggtctcctgggaggaggaggccgagcacagcggcacgtcccacaacatcctggtggaggtgcaggacgacgggaccatgaagatcaaggacgaggagcgcgacgacaccctcaccatcctgctgaaggccacgctcctggccgtcagcggcgtgtaccccatgtccatccccgccaccctgttcgtgtggtacttctggcagaagaagaagcagcggagcggggtcctctgggacaccccctccccgcccgaggtggagcgcgcggtgctggacgacggcatctaccggatcctgcagcgcggcctgctcgggcggagccaggtcggcgtgggggtgttccaggacggcgtcttccacaccatgtggcacgtgacgcgcggggccgtgctgatgtaccagggcaagcggctggagccctcctgggccagcgtcaagaaggacctcatctcctacggcgggggctggcgcttccaggggagctggaacaccggcgaggaggtccaggtgatcgccgtcgagcccgggaagaacccgaagaacgtgcagaccacccccggcacgttcaagacccccgagggcgaggtgggggccatcgcgctggacttcaagcccggcacctccgggagcccgatcgtcaaccgggagggcaagatcgtgggcctgtacgggaacggcgtggtcaccacgtccgggacctacgtgagcgccatcgcccaggccaaggccagccaggagggccccctccccgagatcgaggacgaggtgttcaagaagcgcaacctgaccatcatggacctgcacccggggtccggcaagacccggcgctacctccccgcgatcgtccgggaggccatcaagcgcaagctgcggacgctgatcctcgcccccacccgcgtggtggccagcgagatggcggaggccctgaagggcatgcccatccgctaccagaccaccgccgtcaagtccgagcacacggggcgggagatcgtggacctgatgtgccacgccaccttcaccatgcgcctcctgagcccggtgcgggtccccaactacaacatgatcatcatggacgaggcccacttcaccgaccccgcgtccatcgccgcccgcggctacatcagcacgcgggtggggatgggcgaggccgccgcgatcttcatgaccgccacgccgcccgggtccgtggaggccttcccccagagcaacgccgtcatccaggacgaggagcgcgacatccccgagcggtcctggaacagcggctacgactggatcaccgacttccccggcaagacggtgtggttcgtgccctccatcaagagcgggaacgacatcgccaactgcctgcgcaagaacggcaagcgggtcatccagctctcccgcaagaccttcgacaccgagtaccagaagaccaagaacaacgactgggactacgtggtgacgaccgacatcagcgagatgggggcgaacttccgggccgaccgcgtcatcgacccccggcgctgcctgaagcccgtgatcctgaaggacggccccgagcgggtgatcctcgccgggccgatgcccgtcaccgtggcctccgcggcccagcgccggggccgcatcggccggaaccagaacaaggagggggaccagtacgtctacatgggccagcccctgaacaacgacgaggaccacgcccactggaccgaggccaagatgctgctcgacaacatcaacacgcccgaggggatcatcccggccctgttcgagcccgagcgcgagaagtccgcggccatcgacggcgagtaccgcctgcgcggggaggcccgcaagaccttcgtggagctcatgcggcgcggcgacctgcccgtgtggctgtcctacaaggtcgccagcgagggcttccagtactccgaccggcgctggtgcttcgacggggagcggaacaaccaggtgctcgaggagaacatggacgtggagatctggaccaaggagggcgagcgcaagaagctgcggccccgctggctggacgcccggacctacagcgacccgctcgcgctgcgcgagttcaaggagttcgccgccgggcggcgcagcgtctccggcgacctgatcctcgagatcggcaagctgccccagcacctgaccctccgggcccagaacgccctggacaacctggtgatgctccacaacagcgagcagggcgggaaggcgtaccgccacgccatggaggagctgcccgacacgatcgagaccctgatgctcctggccctgatcgccgtgctcaccgggggcgtcaccctgttcttcctgtccgggaagggcctcggcaagacgagcatcgggctgctgtgcgtgaccgcgtccagcgccctcctgtggatggcctccgtggagccccactggatcgccgccagcatcatcctggagttcttcctcatggtcctgctgatcccggagcccgaccggcagcgcacgccccaggacaaccagctcgcgtacgtggtgatcggcctgctgttcatgatcctcaccgtcgccgccaacgagatggggctgctggagacgaccaagaaggacctcggcatcgggcacgtggccgccgagaaccaccagcacgcgaccatcctggacgtggacctgcacccggcctccgcctggaccctctacgccgtcgccacgaccgtgatcacccccatgatgcggcacaccatcgagaacacgaccgcgaacatcagcctgaccgccatcgccaaccaggccgccatcctgatgggcctcgacaagggctggcccatctccaagatggacctgggggtgcccctgctcgcgctgggctgctacagccaggtcaacccgctgaccctcacggccgccgtgctgatgctggtggcccactacgcgatcatcgggcccggcctccaggccaaggccacccgcgaggcccagaagcggaccgccgcggggatcatgaagaaccccaccgtcgacggcatcgtggccatcgacctggaccccgtggtctacgacgccaagttcgagaagcagctgggccagatcatgctcctgatcctgtgcacgtcccagatcctcctgatgcgcaccacctgggccctgtgcgagagcatcaccctcgccacggggccgctgaccaccctgtgggagggctcccccgggaagttctggaacaccacgatcgcggtgagcatggccaacatcttccgcggctcctacctcgccggcgccgggctggccttcagcctgatgaagtccctcggcgggggccggcgcgggaccggcgcgcagggcgagaccctgggggagaagtggaagcggcagctgaaccagctcagcaagagcgagttcaacacctacaagcgctccggcatcatggaggtggaccggagcgaggccaaggaggggctgaagcgcggcgagacgaccaagcacgccgtctcccgggggaccgccaagctgcgctggttcgtggagcggaacctggtgaagcccgagggcaaggtcatcgacctcggctgcgggcgcggcgggtggagctactactgcgcgggcctgaagaaggtgaccgaggtgaaggggtacaccaagggcggccccgggcacgaggagccgatccccatggccacgtacggctggaacctggtcaagctccactccgggaaggacgtgttcttcatgccgcccgagaagtgcgacaccctgctgtgcgacatcggcgagagctccccgaaccccaccatcgaggaggggcggaccctccgcgtgctgaagatggtcgagccctggctgcggggcaaccagttctgcatcaagatcctcaacccctacatgccgagcgtggtggagacgctggagcagatgcagcgcaagcacggcgggatgctggtccggaaccccctctcccgcaacagcacccacgagatgtactgggtgtcctgcggcaccgggaacatcgtgagcgccgtcaacatgacctcccggatgctgctgaaccgcttcacgatggcccaccggaagcccacctacgagcgcgacgtggacctcggcgccggcacccgccacgtggcggtcgagcccgaggtggccaacctggacatcatcgggcagcggatcgagaacatcaagaacgagcacaagagcacctggcactacgacgaggacaacccgtacaagacgtgggcctaccacggctcctacgaggtgaagcccagcgggtccgccagctccatggtcaacggcgtggtccgcctgctcaccaagccctgggacgtgatccccatggtgacccagatcgccatgaccgacacgaccccgttcgggcagcagcgggtcttcaaggagaaggtggacacccgcacgccccgggcgaagcgcggcacggcccagatcatggaggtgaccgccaagtggctgtggggcttcctgagccggaacaagaagccccgcatctgcacccgggaggagttcacccgcaaggtccggagcaacgccgccatcggggcggtgttcgtggacgagaaccagtggaactccgccaaggaggccgtcgaggacgagcgcttctgggacctcgtgcaccgggagcgcgagctgcacaagcagggcaagtgcgccacgtgcgtgtacaacatgatggggaagcgggagaagaagctgggcgagttcgggaaggcgaagggcagccgcgccatctggtacatgtggctcggcgcccggttcctggagttcgaggccctggggttcatgaacgaggaccactggttctcccgcgagaacagcctctccggcgtcgagggggagggcctgcacaagctggggtacatcctccgggacatcagcaagatcccgggcggcaacatgtacgccgacgacaccgcggggtgggacacccgcatcaccgaggacgacctgcagaacgaggccaagatcacggacatcatggagcccgagcacgccctgctcgccacctccatcttcaagctgacctaccagaacaaggtggtgcgggtccagcgccccgccaagaacggcaccgtgatggacgtgatcagccgccgggaccagcgcgggtccggccaggtcggcacgtacgggctgaacaccttcaccaacatggaggtgcagctcatccggcagatggagagcgagggcatcttcttcccctccgagctggagagcccgaacctggcggagcgcgtgctcgactggctggagaagcacggggccgagcggctgaagcgcatggccatctccggcgacgactgcgtcgtgaagcccatcgacgaccggttcgccaccgccctcatcgcgctgaacgacatggggaaggtgcgcaaggacatcccccagtgggagcccagcaagggctggaacgactggcagcaggtcccgttctgctcccaccacttccaccagctgatcatgaaggacggccgggagatcgtggtgccctgccgcaaccaggacgagctcgtcgggcgggcccgcgtgagccagggcgccgggtggtccctgcgggagacggcctgcctgggcaagagctacgcccagatgtggcagctcatgtacttccaccgccgggacctgcgcctggcggccaacgccatctgcagcgccgtgcccgtcgactgggtgcccacctcccggaccacctggagcatccacgcgcaccaccagtggatgaccacggaggacatgctctccgtgtggaaccgcgtctggatcgaggagaacccgtggatggaggacaagacccacgtgagctcctgggaggaggtgccctacctggggaagcgggaggaccagtggtgcggcagcctgatcggcctcaccgcccgcgccacctgggccacgaacatccaggtcgccatcaaccaggtgcgccggctgatcgggaacgagaactacctggactacatgacctccatgaagcgcttcaagaacgagagcgaccccgagggcgcgctctggtga

SEQ ID NO: 8990 - RNA, 9879 nt, synthetic construct
  misc_feature 1..9879: note = derived and/or modified CDS sequence (opt1) from DENV-1__AF311958__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtcacctacgggacctgcagccagaccggcgagcaccggcgggacaagcggtccgtggccctggcgccccacgtgggcctggggctcgagacccgcaccgagacctggatgagctccgagggcgcctggaagcagatccagaaggtcgagacctgggccctgcggcacccggggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccgcaagctgtgcatcgaggccaagatcagcaacaccaccacggactcccggtgcccgacccagggcgaggccaccctggtggaggagcaggacgccaacttcgtctgccgccggaccttcgtggaccgcggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacgggaccctcaccctggactgcagcccccggacgggcctggacttcaacgagatggtcctcctgaccatgaaggagaagtcctggctggtgcacaagcagtggttcctcgacctgccgctgccctggacctccggggccagcaccagccaggagacgtggaaccgccaggacctcctggtgaccttcaagaccgcccacgccaagaagcaggaggtcgtggtgctgggctcccaggagggcgcgatgcacaccgccctcacgggggccaccgagatccagaccagcggcaccacgaccatcttcgccgggcacctgaagtgccggctgaagatggacaagctcaccctgaagggcacctcctacgtcatgtgcacggggagcttcaagctggagaaggaggtggccgagacccagcacggcaccgtgctggtccaggtgaagtacgagggcaccgacgcgccctgcaagatccccttctccacgcaggacgagaagggggtgacccagaacggccgcctcatcaccgccaacccgatcgtcaccgacaaggagaagcccgtgaacatcgagacggagccgcccttcggggagagctacatcgtggtcggcgccggcgagaaggccctgaagctgtcctggttcaagaaggggagctccatcggcaagatgttcgaggcgaccgcccgcggggcccgccggatggccatcctcggcgacaccgcctgggacttcgggagcatcggcggcgtgttcacctccgtggggaagctggtccaccaggtgttcggcacggcgtacggggtgctgttcagcggcgtctcctggaccatgaagatcgggatcggcatcctcctgacctggctgggcctcaacagccgctccaccagcctgtccatgacgtgcatcgccgtggggatggtgaccctgtacctcggcgtcatggtgcaggccgacagcgggtgcgtgatcaactggaagggccgcgagctgaagtgcgggtccggcatcttcgtcaccaacgaggtgcacacctggaccgagcagtacaagttccaggccgacagcccgaagcggctgagcgccgcgatcggccgcgcctgggaggagggggtgtgcggcatccggtccgccacgcgcctcgagaacatcatgtggaagcagatcagcaacgagctgaaccacatcctgctcgagaacgacatcaagttcaccgtcgtggtggggaacgccaacggcatcctggcccaggggaagaagatgatccggccccagcccatggagcacaagtactcctggaagtcctggggcaaggcgaagatcatcggcgccgacatccagaacaccaccttcatcatcgacgggcccgacacgccggagtgccccgacgagcagcgcgcctggaacatctgggaggtcgaggactacggcttcgggatcttcaccaccaacatctggctgaagctccgggactcctacacccagatgtgcgaccaccgcctgatgagcgccgcgatcaaggactccaaggccgtgcacgccgacatgggctactggatcgagagcgagaagaacgagacgtggaagctggcccgggcctccttcatcgaggtgaagacctgcatctggcccaagagccacaccctctggtccaacggcgtcctggagagcgagatgatcatccccaagatgtacgggggcccgatctcccagcacaactaccgccccgggtacttcacccagacggcgggcccctggcacctggggaagctcgagctggacttcgacctgtgcgagggcaccaccgtggtggtcgacgagcactgcggcagccgggggccgtccctccgcaccacgaccgtgaccggcaagatcatccacgagtggtgctgccggagctgcaccctgccgcccctgcgcttccgcggggaggacggctgctggtacgggatggagatccgccccgtgaaggagaaggaggagaacctcgtccggtccatggtgagcgccggcagcggcgaggtggactccttcagcctggggatcctgtgcgtctccatcatgatcgaggaggtgatgcgcagccggtggtcccgcaagatgctcatgacgggcaccctggccgtgttcctgctcctgatcatggggcagctgacctggaacgacctcatccgcctgtgcatcatggtcggcgccaacgccagcgacaagatggggatgggcaccacgtacctggcgctcatggccaccttcaagatgcggccgatgttcgccgtggggctgctgttccgccggctcacctcccgcgaggtgctgctgctcaccatcgggctgagcctggtcgcctccgtggagctccccaacagcctggaggagctgggcgacgggctcgccatgggcatcatgatgctgaagctgctcacggagttccagccccaccagctgtggaccaccctgctctccctgaccttcatcaagacgaccctgagcctcgactacgcgtggaagaccaccgccatggtcctgtccatcgtgagcctgttccccctctgcctgtccacgaccagccagaagaccacctggctgccggtgctcctgggctccttcgggtgcaagcccctgaccatgttcctcatcacggagtacgagatctggggccgcaagagctggcccctgaacgaggggatcatggccatcggcatcgtctccatcctgctcagcagcctgctgaagaacgacgtgcccctcgccgggccgctgatcgcgggcggcatgctgatcgcctgctacgtgatctccgggagctccgccgacctcagcctggagaaggccgccgaggtctcctgggaggaggaggcggagcacagcggcacctcccacaacatcctggtggaggtgcaggacgacgggaccatgaagatcaaggacgaggagcgcgacgacaccctcacgatcctgctgaaggccaccctcctggccgtcagcggcgtgtaccccatgtccatccccgccaccctgttcgtgtggtacttctggcagaagaagaagcagcggagcggggtcctctgggacaccccctccccgcccgaggtggagcgcgccgtgctggacgacggcatctaccggatcctgcagcgcggcctgctcgggcggagccaggtcggcgtgggggtgttccaggacggcgtcttccacacgatgtggcacgtgacccgcggggcggtgctgatgtaccagggcaagcggctggagccctcctgggccagcgtcaagaaggacctcatctcctacggcgggggctggcgcttccaggggagctggaacaccggcgaggaggtccaggtgatcgccgtcgagcccgggaagaacccgaagaacgtgcagaccacgcccggcaccttcaagacccccgagggcgaggtgggggccatcgccctggacttcaagcccggcacctccgggagcccgatcgtcaaccgggagggcaagatcgtgggcctgtacgggaacggcgtggtcacgacctccgggacctacgtgagcgcgatcgcccaggccaaggccagccaggaggagcccctccccgagatcgaggacgaggtgttcaagaagcgcaacctgaccatcatggacctgcacccgggctccgggaagacgcggcgctacctccccgccatcgtccgggaggcgatcaagcgcaagctgcggaccctgatcctcgcccccacccgcgtggtggccagcgagatggccgaggcgctgaagggcatgcccatccgctaccagaccacggccgtcaagtccgagcacaccggccgggagatcgtggacctgatgtgccacgccaccttcaccatgcgcctcctgagcccggtgcgggtccccaactacaacatgatcatcatggacgaggcccacttcacggaccccgcctccatcgcggcccgcgggtacatcagcacccgggtgggcatgggggaggccgccgccatcttcatgaccgcgacgccgcccggctccgtggaggccttcccccagagcaacgccgtcatccaggacgaggagcgcgacatccccgagcggtcctggaacagcgggtacgactggatcacggacttccccggcaagaccgtgtggttcgtgccctccatcaagagcggcaacgacatcgccaactgcctgcgcaagaacgggaagcgggtcatccagctctcccgcaagaccttcgacaccgagtaccagaagacgaagaacaacgactgggactacgtggtgaccaccgacatcagcgagatgggcgccaacttccgggcggaccgcgtcatcgacccccggcgctgcctgaagcccgtgatcctgaaggacgggcccgagcgggtgatcctcgccggcccgatgcccgtcaccgtggcctccgccgcgcagcgccgggggcgcatcggccggaaccagaacaaggagggcgaccagtacgtctacatggggcagcccctgaacaacgacgaggaccacgcccactggacggaggccaagatgctgctcgacaacatcaacacccccgagggcatcatcccggccctgttcgagcccgagcgcgagaagtccgccgcgatcgacggggagtaccgcctgcggggcgaggcccgcaagaccttcgtggagctcatgcggcgcggggacctgcccgtgtggctgtcctacaaggtcgccagcgagggcttccagtactccgaccggcgctggtgcttcgacggcgagcggaacaaccaggtgctcgaggagaacatggacgtggagatctggaccaaggagggggagcgcaagaagctgcggccccgctggctggacgcccggacctacagcgacccgctcgccctgcgcgagttcaaggagttcgcggccggccggcgcagcgtctccggggacctgatcctcgagatcggcaagctgccccagcacctgacgctccgggcccagaacgccctggacaacctggtgatgctccacaacagcgagcagggcgggaaggcctaccgccacgcgatggaggagctgcccgacaccatcgagaccctgatgctcctggccctgatcgccgtgctcaccggcggggtcacgctgttcttcctgtccggcaaggggctcggcaagaccagcatcggcctgctgtgcgtgaccgcctccagcgcgctcctgtggatggcctccgtggagccccactggatcgccgccagcatcatcctggagttcttcctcatggtcctgctgatcccggagcccgaccggcagcgcacgccccaggacaaccagctcgcctacgtggtgatcgggctgctgttcatgatcctcacggtcgcggccaacgagatgggcctgctggagaccaccaagaaggacctcgggatcggccacgtggccgccgagaaccaccagcacgccaccatgctggacgtggacctgcacccggcgtccgcctggacgctctacgccgtcgccaccaccgtgatcacccccatgatgcggcacacgatcgagaacaccaccgccaacatcagcctgaccgcgatcgccaaccaggccgccatcctgatggggctcgacaagggctggcccatctccaagatggacctgggcgtgcccctgctcgccctggggtgctacagccaggtcaacccgctgacgctcaccgcggccgtgctgatgctggtggcccactacgccatcatcggccccgggctccaggcgaaggccacccgcgaggcccagaagcggaccgccgccggcatcatgaagaaccccacggtcgacgggatcgtggcgatcgacctggaccccgtggtctacgacgccaagttcgagaagcagctgggccagatcatgctcctgatcctgtgcacctcccagatcctcctgatgcgcaccacctgggccctgtgcgagagcatcacgctcgccaccggcccgctgaccaccctgtgggaggggtcccccggcaagttctggaacacgaccatcgccgtgagcatggcgaacatcttccgcgggtcctacctcgccggcgccggcctggccttcagcctgatgaagtccctcgggggcgggcggcgcggcaccggggcccagggcgagaccctgggcgagaagtggaagcggcagctgaaccagctcagcaagagcgagttcaacacgtacaagcgctccgggatcatggaggtggaccggagcgaggcgaaggagggcctgaagcgcggggagaccaccaagcacgccgtctcccggggcgccgccaagctgcgctggttcgtggagcggaacctggtgaagcccgaggggaaggtcatcgacctcggctgcggccgcgggggctggagctactactgcgcggggctgaagaaggtgaccgaggtgaagggctacaccaagggcgggcccggccacgaggagccgatccccatggccacgtacgggtggaacctggtcaagctccactccggcaaggacgtgttcttcatgccgcccgagaagtgcgacaccctgctgtgcgacatcggggagagctccccgaaccccaccatcgaggagggccggaccctccgcgtgctgaagatggtcgagccctggctgcgggggaaccagttctgcatcaagatcctcaacccctacatgccgagcgtggtggagacgctggagcagatgcagcgcaagcacggcggcatgctggtccggaaccccctctcccgcaacagcacccacgagatgtactgggtgtcctgcgggaccggcaacatcgtgagcgccgtcaacatgacctcccggatgctgctgaaccgcttcacgatggcccaccggaagcccacctacgagcgcgacgtggacctcggggccggcacccgccacgtggcggtcgagcccgaggtggccaacctggacatcatcggccagcggatcgagaacatcaagaacgagcacaagagcacctggcactacgacgaggacaacccgtacaagacgtgggcctaccacgggtcctacgaggtgaagcccagcggctccgccagctccatggtcaacggggtggtccgcctgctcaccaagccctgggacgtgatccccatggtgacccagatcgccatgaccgacacgaccccgttcggccagcagcgggtcttcaaggagaaggtggacacccgcacgccccgggcgaagcgcgggacggcccagatcatggaggtgaccgccaagtggctgtggggcttcctgagccggaacaagaagccccgcatctgcacccgggaggagttcacccgcaaggtccggagcaacgccgccatcggcgcggtgttcgtggacgagaaccagtggaactccgccaaggaggccgtcgaggacgagcgcttctgggacctcgtgcaccgggagcgcgagctgcacaagcaggggaagtgcgccacgtgcgtgtacaacatgatgggcaagcgggagaagaagctgggggagttcggcaaggcgaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccggcgggaacatgtacgccgacgacaccgcggggtgggacacccgcatcaccgaggacgacctgcagaacgaggccaagatcacggacatcatggagcccgagcacgccctgctcgccacctccatcttcaagctgacctaccagaacaaggtggtgcgggtccagcgccccgccaagaacgggaccgtgatggacgtgatcagccgccgggaccagcgcggctccgggcaggtcggcacgtacggcctgaacaccttcaccaacatggaggtgcagctcatccggcagatggagagcgaggggatcttcttcccctccgagctggagagcccgaacctggcggagcgcgtgctcgactggctggagaagcacggcgccgagcggctgaagcgcatggccatctccggggacgactgcgtcgtgaagcccatcgacgaccggttcgccaccgccctcatcgcgctgaacgacatgggcaaggtgcgcaaggacatcccccagtgggagcccagcaaggggtggaacgactggcagcaggtcccgttctgctcccaccacttccaccagctgatcatgaaggacggccgggagatcgtggtgccctgccgcaaccaggacgagctcgtcggccgggcccgcgtgagccagggggccggctggtccctgcgggagacggcctgcctgggcaagagctacgcccagatgtggcagctcatgtacttccaccgccgggacctgcgcctggcggccaacgccatctgcagcgccgtgcccgtcgactgggtgcccacctcccggaccacctggagcatccacgcgcaccaccagtggatgaccacggaggacatgctctccgtgtggaaccgcgtctggatcgaggagaacccgtggatggaggacaagacccacgtgagctcctgggaggaggtgccctacctgggcaagcgggaggaccagtggtgcgggagcctgatcggcctcaccgcccgcgccacctgggccacgaacatccaggtcgccatcaaccaggtgcgccggctgatcggcaacgagaactacctggactacatgacctccatgaagcgcttcaagaacgagagcgaccccgagggggcgctctggtga

SEQ ID NO: 8991 - RNA, 9879 nt, synthetic construct
  misc_feature 1..9879: note = derived and/or modified CDS sequence (opt1) from DENV-1__AF311957__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtcacctacgggacctgcagccagaccggcgagcaccggcgggacaagcggtccgtggccctggcgccccacgtgggcctggggctcgagacgcggaccgagacctggatgagcagcgagggcgcctggaagcagatccagaaggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccgcaagctgtgcatcgaggccaagatcagcaacaccaccacggactcccggtgcccgacccagggcgaggccaccctggtggaggagcaggacgccaacttcgtctgccgccggaccttcgtggaccgcggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccgccaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtcatgtgcaccgggagcttcaagctggagaaggaggtggcggagacgcagcacggcaccgtgctggtccaggtgaagtacgagggcaccgacgccccctgcaagatccccttctccacccaggacgagaagggggtgacgcagaacggccgcctcatcaccgccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtgttcacctccgtggggaagctggtccaccaggtgttcggcaccgcctacggggtgctgttcagcggcgtctcctggacgatgaagatcgggatcggcatcctcctgacctggctgggcctcaacagccgctccaccagcctgtccatgacctgcatcgccgtggggatggtgacgctgtacctcggcgtcatggtgcaggccgacagcgggtgcgtgatcaactggaagggccgcgagctgaagtgcgggtccggcatcttcgtcaccaacgaggtgcacacctggaccgagcagtacaagttccaggccgacagcccgaagcggctgagcgcggccatcggccgcgcctgggaggagggggtgtgcggcatccggtccgccacccgcctcgagaacatcatgtggaagcagatcagcaacgagctgaaccacatcctgctcgagaacgacatcaagttcacggtcgtggtggggaacgccaacggcatcctggcgcaggggaagaagatgatccggccccagcccatggagcacaagtactcctggaagtcctggggcaaggccaagatcatcggcgccgacatccagaacaccaccttcatcatcgacgggcccgacaccccggagtgccccgacgagcagcgcgcctggaacatctgggaggtcgaggactacggcttcgggatcttcacgaccaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtgaagacgtgcatctggcccaagagccacaccctctggtccaacggcgtcctggagagcgagatgatcatccccaagatgtacgggggcccgatctcccagcacaactaccgccccgggtacttcacccagaccgccggcccctggcacctggggaagctcgagctggacttcgacctgtgcgagggcacgaccgtggtggtcgacgagcactgcggcagccgggggccgtccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtccggtccatggtgagcgccggcagcggcgaggtggactccttcagcctggggatcctgtgcgtctccatcatgatcgaggaggtgatgcgcagccggtggtcccgcaagatgctcatgaccggcacgctggccgtgttcctgctcctgatcatggggcagctgacctggaacgacctcatccgcctgtgcatcatggtcggcgccaacgcgagcgacaagatggggatgggcaccacctacctggccctcatggccacgttcaagatgcggccgatgttcgccgtggggctgctgttccgccggctcacctcccgcgaggtgctgctgctcaccatcgggctgagcctggtcgcctccgtggagctccccaacagcctggaggagctgggcgacgggctcgcgatgggcatcatgatgctgaagctgctcaccgagttccagccccaccagctgtggacgaccctgctctccctgaccttcatcaagaccacgctgagcctcgactacgcctggaagaccaccgccaccgtcctgtccatcgtgagcctgttccccctctgcctgtccacgaccagccagaagaccacctggctgccggtgctcctgggctccttcgggtgcaagcccctgaccatgttcctcatcacggagaacgagatctggggccgcaagagctggcccctgaacgaggggatcatggccatcggcatcgtctccatcctgctcagcagcctgctgaagaacgacgtgcccctcgcggggccgctgatcgccggcggcatgctgatcgcctgctacgtgatctccgggagctccgccgacctcagcctggagaaggccgcggaggtctcctgggaggaggaggccgagcacagcggcacctcccacaacatcctggtggaggtgcaggacgacgggaccatgaagatcaaggacgaggagcgcgacgacaccctcacgatcctgctgaaggccaccctcctggccgtcagcggcgtgtaccccatgtccatccccgccaccctgttcgtgtggtacttctggcagaagaagaagcagcggagcggggtcctctgggacaccccctccccgcccgaggtggagcgcgcggtgctggacgacggcatctaccggatcctgcagcgcggcctgctcgggcggagccaggtcggcgtgggggtgttccaggacggcgtcttccacacgatgtggcacgtgacccgcggggccgtgctgatgtaccagggcaagcggctggagccctcctgggccagcgtcaagaaggacctcatctcctacggcgggggctggcgcttccaggggagctggaacaccggcgaggaggtccaggtgatcgccgtcgagcccgggaagaacccgaagaacgtgcagaccacgcccggcaccttcaagacccccgagggcgaggtgggggccatcgcgctggacttcaagcccggcacctccgggagcccgatcgtcaaccgggagggcaagatcgtgggcctgtacgggaacggcgtggtcacgacctccgggacctacgtgagcgccatcgcccaggccaaggccagccaggagggccccctccccgagatcgaggacgaggtgttcaagaagcgcaacctgaccatcatggacctgcacccggggtccggcaagacgcggcgctacctccccgcgatcgtccgggaggccatcaagcgcaagctgcggaccctgatcctcgcccccacccgcgtggtggccagcgagatggcggaggccctgaagggcatgcccatccgctaccagaccacggccgtcaagtccgagcacaccgggcgggagatcgtggacctgatgtgccacgccaccttcaccatgcgcctcctgagcccggtgcgggtccccaactacaacatgatcatcatggacgaggcccacttcacggaccccgcgtccatcgccgcccgcggctacatcagcacccgggtggggatgggcgaggccgccgcgatcttcatgaccgccacgccgcccgggtccgtggaggccttcccccagagcaacgccgtcatccaggacgaggagcgcgacatccccgagcggtcctggaacagcggctacgactggatcacggacttccccggcaagaccgtgtggttcgtgccctccatcaagagcgggaacgacatcgccaactgcctgcgcaagaacggcaagcgggtcatccagctctcccgcaagaccttcgacaccgagtaccagaagacgaagaacaacgactgggactacgtggtgaccaccgacatcagcgagatgggggcgaacttccgggccgaccgcgtcatcgacccccggcgctgcctgaagcccgtgatcctgaaggacggccccgagcgggtgatcctcgccgggccgatgcccgtcaccgtggcctccgcggcccagcgccggggccgcatcggccggaaccagaacaaggagggggaccagtacgtctacatgggccagcccctgaacaacgacgaggaccacgcccactggacggaggccaagatgctgctcgacaacatcaacacccccgaggggatcatcccggccctgttcgagcccgagcgcgagaagtccgcggccatcgacggcgagtaccgcctgcgcggggaggcccgcaagaccttcgtggagctcatgcggcgcggcgacctgcccgtgtggctgtcctacaaggtcgccagcgagggcttccagtactccgaccggcgctggtgcttcgacggggagcggaacaaccaggtgctcgaggagaacatggacgtggagatctggaccaaggagggcgagcgcaagaagctgcggccccgctggctggacgcccggacctacagcgacccgctcgcgctgcgcgagttcaaggagttcgccgccgggcggcgcagcgtctccagcgacctgatcctcgagatcggcaagctgccccagcacctgacgctccgggcccagaacgccctggacaacctggtgatgctccacaactccgagcagggcgggaaggcgtaccgccacgccatggaggagctgcccgacaccatcgagaccctgatgctcctggccctgatcgccgtgctcaccggcggggtcacgctgttcttcctgagcggcaaggggctcggcaagacctccatcggcctgctgtgcgtgaccgcgagctccgccctcctgtggatggccagcgtggagccccactggatcgccgcctccatcatcctggagttcttcctcatggtcctgctgatcccggagcccgaccggcagcgcacgccccaggacaaccagctcgcgtacgtggtgatcgggctgctgttcatgatcctcacggtcgccgccaacgagatgggcctgctggagaccaccaagaaggacctcgggatcggccacgtggccgccgagaaccaccagcacgcgaccatgctggacgtggacctgcacccggccagcgcctggacgctctacgccgtcgccaccaccgtgatcacccccatgatgcggcacacgatcgagaacaccaccgcgaacatctccctgaccgccatcgccaaccaggccgccatcctgatggggctcgacaagggctggcccatcagcaagatggacctgggcgtgcccctgctcgcgctggggtgctactcccaggtcaacccgctgacgctcaccgccgccgtgctgatgctggtggcccactacgcgatcatcggccccgggctccaggccaaggccacccgcgaggcccagaagcggaccgccgcgggcatcatgaagaaccccacggtcgacgggatcgtggccatcgacctggaccccgtggtctacgacgccaagttcgagaagcagctgggccagatcatgctcctgatcctgtgcaccagccagatcctcctgatgcgcaccacctgggccctgtgcgagtccatcacgctcgccaccggcccgctgaccaccctgtgggaggggagccccggcaagttctggaacacgaccatcgcggtgtccatggccaacatcttccgcgggagctacctcgccggcgccggcctggccttctccctgatgaagtccctcgggggcgggcggcgcggcaccggggcgcagggcgagaccctgggcgagaagtggaagcggcagctgaaccagctcagcaagtccgagttcaacacgtacaagcgcagcgggatcatggaggtggaccggtccgaggccaaggagggcctgaagcgcggggagaccaccaagcacgccgtcagccggggcaccgccaagctgcgctggttcgtggagcggaacctggtgaagcccgaggggaaggtcatcgacctcggctgcggccgcgggggctggtcctactactgcgcggggctgaagaaggtgaccgaggtgaagggctacacgaagggcgggcccggccacgaggagccgatccccatggccacctacgggtggaacctggtcaagctccacagcggcaaggacgtgttcttcatcccgcccgagaagtgcgacaccctgctgtgcgacatcggggagtccagcccgaaccccaccatcgaggagggccggacgctccgcgtgctgaagatggtcgagccctggctgcgggggaaccagttctgcatcaagatcctcaacccctacatgccgtccgtggtggagaccctggagcagatgcagcgcaagcacggcggcatgctggtccggaaccccctcagccgcaactccacccacgagatgtactgggtgagctgcgggaccggcaacatcgtgtccgccgtcaacatgacgagccggatgctgctgaaccgcttcaccatggcccaccggaagcccacctacgagcgcgacgtggacctcggggccggcacccgccacgtggcggtcgagcccgaggtggccaacctggacatcatcggccagcggatcgagaacatcaagaacgagcacaagtccacgtggcactacgacgaggacaacccgtacaagacctgggcctaccacgggagctacgaggtgaagccctccggcagcgcctccagcatggtcaacggggtggtccgcctgctcaccaagccctgggacgtgatccccatggtgacccagatcgccatgacggacaccaccccgttcggccagcagcgggtcttcaaggagaaggtggacacccgcacgccccgggcgaagcgcgggaccgcccagatcatggaggtgaccgccaagtggctgtggggcttcctgagccggaacaagaagccccgcatctgcacccgggaggagttcacgcgcaaggtccggtccaacgccgccatcggcgcggtgttcgtggacgagaaccagtggaacagcgccaaggaggccgtcgaggacgagcgcttctgggacctcgtgcaccgggagcgcgagctgcacaagcaggggaagtgcgcgacctgcgtgtacaacatgatgggcaagcgggagaagaagctgggggagttcggcaaggcgaaggggtcccgcgccatctggtacatgtggctcggcgcccggttcctggagttcgaggccctgggcttcatgaacgaggaccactggttcagccgcgagaactccctcagcggggtcgagggcgaggggctgcacaagctgggctacatcctccgggacatctccaagatcccgggcgggaacatgtacgccgacgacaccgcggggtgggacacccgcatcacggaggacgacctgcagaacgaggccaagatcaccgacatcatggagcccgagcacgccctgctcgccaccagcatcttcaagctgacctaccagaacaaggtggtgcgggtccagcgccccgccaagaacgggacggtgatggacgtgatctcccgccgggaccagcgcggcagcgggcaggtcggcacctacggcctgaacaccttcaccaacatggaggtgcagctcatccggcagatggagtccgaggggatcttcttccccagcgagctggagtccccgaacctggcggagcgcgtgctcgactggctggagaagcacggcgccgagcggctgaagcgcatggccatcagcggggacgactgcgtcgtgaagcccatcgacgaccggttcgccacggccctcatcgcgctgaacgacatgggcaaggtgcgcaaggacatcccccagtgggagccctccaaggggtggaacgactggcagcaggtcccgttctgcagccaccacttccaccagctgatcatgaaggacggccgggagatcgtggtgccctgccgcaaccaggacgagctcgtcggccgggcccgcgtgtcccagggggccggctggagcctgcgggagaccgcctgcctgggcaagagctacgcccagatgtggcagctcatgtacttccaccgccgggacctgcgcctggcggccaacgccatctgctccgccgtgcccgtcgactgggtgcccaccagccggaccacctggtccatccacgcgcaccaccagtggatgacgaccgaggacatgctcagcgtgtggaaccgcgtctggatcgaggagaacccgtggatggaggacaagacccacgtgtccagctgggaggaggtgccctacctgggcaagcgggaggaccagtggtgcgggtccctgatcggcctcaccgcccgcgccacgtgggccaccaacatccaggtcgccatcaaccaggtgcgccggctgatcggcaacgagaactacctggactacatgaccagcatgaagcgcttcaagaacgagtccgaccccgagggggcgctctggtga

SEQ ID NO: 8992 - RNA, 9879 nt, synthetic construct
  misc_feature 1..9879: note = derived and/or modified CDS sequence (opt1) from DENV-1__EU280167__SS-prME
  source 1..9879: mol_type = other RNA
agcgtgaccatgctgctcaccctgatgcccaccgccctggccttccacctcaccacccggggcggggagccccacatgatcgtgagcaagcaggagcggggcaagagcctgctgttcaagacctccgcgggggtgaacatgtgcaccctcatcgccatggacctgggcgagctgtgcgaggacaccgtgacctacaagtgcccccggatcaccgaggccgagcccgacgacgtcgactgctggtgcaacgccaccgacacctgggtgacctacgggacctgcagccagacgggcgagcaccggcgggacatccggtccgtggccctcgcgccccacgtcggcctggggctggagacccggaccgagacctggatgagctccgagggcgcctggaagcagatccagcgggtggacacgtgcgtgctccgccacccggggttcaccgtcatcgccctgttcctggcccacgcgatcggcaccagcatctcccagaaggggatcatcttcatcctcctgatgctggtgacccccagcatgacgatgcggtgcgtgggcatcggctcccgcgacttcgtcgaggggctcagcggcgccacctgggtggacgtggtcctggagcacgggtcctgcgtgaccagcatggccaaggacaagcccaccctggacatcgagctcctgaagacggaggtgcccaaccccgccgtcctgcggaagctctgcatcgaggccaagatctccaacaccaccaccgacagccgctgccccacgcagggcgaggcgaccctggtggaggagcaggacgccaacttcgtgtgccggcgcaccttcgtcgaccggggctgggggaacggctgcgggctgttcggcaaggggtccctcctgacctgcgacaagttcaagtgcgtgacgaagctggagggcaagatcatccagtacgagaacttcaagtacagcgtgatcgtcaccgtgcacaccggcgaccagcaccaggtcgggaacgagtccaccgagcacggcacgaccgccaccatcacgccccaggcccccaccacggagatccagctcaccgactacggggccctgaccctggactgcagcccgcgcaccggcctcgacttcaacgagatggtgctgctgacgatgaaggagaagtcctggctcgtgcacaagcagtggttcctggacctgcccctcccctggacctccggggcgagcacctcccgggagacctggaaccgccaggacctgctggtcacgttcaagaccgcccacgccaagaagcaggaggtggtggtcctcggcagccaggagggcgccatgcacaccgccctgaccggggcgacggagatccagacctccggcaccaccacgatcttcgccgggcacctgaagtgccggctcaagatggacaagctgaccctgaagggcatgagctacgtgatgtgcaccgggtccttcaagctcgagaaggaggtggccgagacccagcacggcacggtcctggtgcagatcaagtacgagggcaccgacgccccctgcaagatcccgttcagcacccaggacgagaagggggtgacccagaacggccgcctgatcacggccaaccccatcgtcaccgacaaggagaagcccgtgaacatcgaggcggagcccccgttcggggagtcctacatcgtgatcggcgtcggcgagaaggccctgaagctcagctggttcaagaaggggtccagcatcggcaagatgttcgaggccaccgcccgcggggcccgccgcatggccatcctgggcgacaccgcctgggacttcgggtccatcggcggcgtgttcacgagcgtggggaagctggtccaccagatcttcggcaccgcctacggggtgctgttctccggcgtgagctggaccatgaagatcgggatcggcgtcctgctgacctggctcggcctgaactcccggagcacgtccctgagcatgacctgcatcgccgtggggctcgtgaccctgtacctgggcgtcatggtgcaggcggacagcgggtgcgtgatcaactggaagggccgcgggctcaagtgcggctccggcatcttcgtcaccaacgaggtgcacacgtggaccgggcagtacaagttccaggccgacagccccaagggcctgtccgccgccatcgggaaggcctgggaggagggcgtgtgcgggatccggagcgcgacccgcctggagaacatcatgtggaagcagatctccaacgagctcaaccacatcctgctggagaacgacatgaagttcaccgtcgtggtgggcgacgtcgccggcatcctcgcccaggggaagaagatgatccggccccagcccatggagcacaagtacagctggaagaactggggcaaggccaagatcatcggggccgacgtgcagaactccaccttcatcatcgacggcccgaacacgcccgagtgcagcgacgaccagcgcgcgtggaacatctgggaggtggaggactacggcttcgggatcttcaccaccaacatctggctgaagctgcgggactcctacacccaggtctgcgaccaccgcctcatgagcgccgccatcaaggactccaaggccgtgcacgcggacatgggctactggatcgagagcgagaagaacgagacgtggaagctggcccgggcctccttcatcgaggtgaagacctgcatctggcccaagagccacaccctgtggtccaacggggtcctcgagagcgagatgatcatccccaagatctacggcgggccgatctcccagcacaactaccgccccggctacttcacccagacggccggcccctggcacctggggaagctggagctcgacttcgacctgtgcgagggcaccaccgtggtggtcgacgagcactgcgggaaccggggcccgagcctggggaccacgaccgtgaccggcaagatcatccacgagtggtgctgccgcagctgcaccctgccgcccctccggttccgcggcgaggacgggtgctggtacggcatggagatccggcccgtgaaggagaaggaggagaacctggtcaagtccatggtgagcgccgggtccggcgaggtggacagcttctccctcgggctgctgtgcatcagcatcatgatcgaggaggtcatgcgctcccggtggagccgcaagatgctcatgacgggcaccctggcggtgttcttcctgctcatcatgggccagctgacctggaacgacctgatccggctctgcatcatggtgggggccaacgcctccgaccgcatgggcatggggaccacgtacctggccctgatggccaccttcaagatgcgcccgatgttcgcggtcggcctcctgttccggcgcctgaccagccgggaggtgctcctgctgaccatcggcctctccctggtcgccagcgtggagctgcccaactccctcgaggagctgggggacggcctggccatggggatcatgatcctcaagctgctgacggacttccgcagccaccagctctgggccaccctgctgtccatgaccttcatcaagaccgccttcagcctccactacgcgtggaagacgatggccatggtgctgtccatcgtcagcctgttccccctctgcctgtacaccacctcccagaagaccacgtggctgcccgtgctcctgggcagcctggggtgcaagccgctcaccatgttcctgatcgccgagaacaagatctggggccgcaagagctggcccctgaacgagggcatcatggccgtggggatcgtctccatcctcctgagctccctgctcaagaacgacgtgcccctggcgggccccctgatcgccgggggcatgctcatcgcctgctacgtgatcagcgggtccagcgccgacctgtccctggagaaggccgcggaggtcagctgggaggaggaggccgagcactccggcgccagccacaacatcctcgtggaggtgcaggacgacggcaccatgaagatcaaggacgaggagcgcgacgacaccctgacgatcctgctcaaggccaccctgctggccgtctccggggtgtacccgctcagcatccccgcgaccctgttcgtgtggtgcttctggcagaagaagaagcagcggtccggcgtcctgtgggacacccccagcccgcccaaggtggagcgcgccgtgctcgacgacgggatctaccggatcatgcagcgcggcctgctggggcggtcccaggtcggcgtgggcgtgttccaggagaacgtcttccacaccatgtggcacgtgacgcgcggggccgtgctgatgtaccagggcaagcggctcgagcccagctgggcctccgtcaagaaggacctgatcagctacgggggcgggtggcgcctgcagggctcctggaacaccggcgaggaggtccaggtgatcgccgtcgagcccgggaagaaccccaagaacgtgcagaccgcgcccggcaccttcaagacgcccgagggggaggtgggcgccatcgccctcgacttcaagcccggcaccagcgggagccccatcgtcaaccgggagggcaagatcgtggggctgtacggcaacggggtggtcaccacctccggcacgtacgtgagcgccatcgcccaggcgaaggcctcccaggagggcccgctgcccgagatcgaggacgaggtgttccgcaagcggaacctcaccatcatggacctgcaccccgggagcggcaagacccgccggtacctgccggccatcgtccgcgaggccatcaagcggaagatgcgcaccctcatcctggcgcccacgcgcgtggtggcctccgagatggccgaggccctgaaggggatgcccatccggtaccagaccaccgccgtcaagagcgagcacaccggcaaggagatcgtggacctcatgtgccacgcgacgttcaccatgcgcctgctgtcccccgtgcgggtcccgaactacaacatgatcatcatggacgaggcccacttcaccgaccccagctccatcgccgcccgcgggtacatcagcacccgggtgggcatgggcgaggccgcggccatcttcatgacggccacgccgcccgggtccgtggaggccttcccgcagagcaacgccgtcatccaggacgaggagcgcgacatccccgagcggtcctggaacagcggctacgagtggatcaccgacttccccgggaagaccgtgtggttcgtgccctccatcaaggcgggcaacgacatcacgaactgcctccgcaagaacgggaagcgggtcatccagctgagccgcaagaccttcgacaccgagtaccagaagaccaagaacaacgactgggactacgtggtgacgaccgacatctccgagatgggcgccaacttccgggccgaccgcgtcatggacccgcggcgctgcctgaagcccgtgatcctcaaggacggccccgagcgggtcatcctggccgggcccatgccggtgaccgtggcgagcgccgcccagcgccggggccgcatcgggcggaaccacaacaaggagggcgaccagtacatctacatggggcagcccctgaccaacgacgaggaccacgcccactggacggaggccaagatgctcctggacaacatcaacacccccgagggcatcatccccgcgctgttcgagccggagcgcgagaagtccgccgccatcgacggcgagtaccgcctccgcggggaggcccgcaagaccttcgtcgagctgatgcggcgcggcgacctgcccgtgtggctcagccacaaggtggccagcgaggggttccagtactccgaccggcgctggtgcttcgacggcgagcggaacaaccaggtcctggaggagaacatggacgtggagatctggaccaaggagggcgagcgcaagaagctgcggccccgctggctcgacgcgcggacgtacagcgaccccctggccctgcgcgagttcaaggagttcgccgccgggcggcgctccgtgagcggcgacctcatcctggagatcgggaagctgccgcagcacctcacccagcgggcccagaacgcgctggacaacctggtcatgctccacaactccgagcagggcgggcgcgcctaccggcacgccatggaggagctgcccgacaccatcgagaccctgatgctcctggccctgatcgcggtgctcacgggcggcgtgaccctgttcttcctgagcgggaagggcctcgggaagacctccatcggcctgctgtgcgtcatggccagctccgtgctcctgtggatggccagcgtggagccccactggatcgccgcctccatcatcctggagttcttcctcatggtcctgctgatccccgagccggaccgccagcggacgccccaggacaaccagctcgcgtacgtggtgatcgggctgctgttcatgatcctcaccgtcgccgccaacgagatgggcctgctggagacgaccaagaaggacctcggcatcgggcacgtggccgtggagaaccaccaccacgccgcgatgctggacgtcgacctgcaccccgccagcgcctggaccctctacgccgtggccaccacgatcatcaccccgatgatgcgccacaccatcgagaacaccacggcgaacatctccctgaccgccatcgccaaccaggccgccatcctgatgggcctcgacaaggggtggcccatcagcaagatggacatcggcgtgcccctgctggcgctcgggtgctactcccaggtcaaccccctgaccctgaccgccgccgtgctcatgctggtggcccactacgcgatcatcggcccgggcctgcaggccaaggccacgcgggaggcccagaagcgcaccgccgcggggatcatgaagaaccccaccatcgacggcatcgtcgccatcgacctcgaccccgtggtgtacgacgccaagttcgagaagcagctggggcagatcatgctgctcatcctgtgcaccagccagatcctgctcatgcgcacgacctgggccctgtgcgagtccatcaccctggccaccggccccctcacgaccctgtgggagggcagcccggggaagttctggaacaccaccatcgcggtctccatggccaacatcttccggggcagctacctggccggggccggcctcgccttcagcctgatgaagtccctcgggggcggccgccgggggacgggcgcgcagggggagaccctcggcgagaagtggaagcgccagctgaaccagctgagcaagtccgagttcaacacctacaagcggagcgggatcatggaggtggaccgctccgaggccaaggagggcctcaagcggggcgagaccacgaagcacgccgtgagccgcgggaccgccaagctgcggtggttcgtcgagcgcaacctggtgaagcccgagggcaaggtgatcgacctcgggtgcggccgcgggggctggtcctactactgcgcgggcctgaagaaggtcaccgaggtgaaggggtacaccaagggcgggcccggccacgaggagcccatcccgatggccacgtacgggtggaacctggtgaagctgcacagcggcaaggacgtcttcttcatcccgcccgagaagtgcgacaccctcctgtgcgacatcggcgagtccagccccaacccgaccatcgaggaggggcgcaccctgcgggtgctcaagatggtggagccctggctgcgcggcaaccagttctgcatcaagatcctgaacccctacatgccctccgtcgtggagacgctcgagcagatgcagcggaagcacgggggcatgctggtgcgcaacccgctgagccggaactccacccacgagatgtactgggtcagctgcggcaccgggaacatcgtgtccgccgtgaacatgaccagccgcatgctcctgaaccggttcaccatggcccaccgcaagcccacgtacgagcgcgacgtcgacctgggcgccgggacccggcacgtggcggtggagcccgaggtcgccaacctcgacatcatcggccagcgcatcgagaacatcaagcacgagcacaagtccacctggcactacgacgaggacaacccctacaagacctgggcctaccacgggagctacgaggtgaagccgtccggcagcgccagctccatggtcaacggcgtggtgaagctgctgacgaagccctgggacgtcatccccatggtgacccagatcgccatgaccgacaccacgcccttcgggcagcagcgggtgttcaaggagaaggtcgacacccgcaccccgaaggcgaagcggggcaccgcccagatcatggtggtgacggcccgctggctctggagcttcctgtcccggaacaagaagccccgcatctgcacccgggaggagttcacccgcaaggtccggagcaacgccgccatcggggcggtgttcgtggacgagaaccagtggaactccgccaaggaggccgtcgaggacgaccgcttctgggacctggtgcaccgggagcgcgagctccacaagcagggcaagtgcgcgacctgcgtgtacaacacgatggggaagcgggagaagaagctgggcgagttcggcaaggcgaaggggagccgcgccatctggtacatgtggctgggcgcccggttcctcgagttcgaggccctggggttcatgaacgaggaccactggttctcccgcgagaacagcctgtccggcgtcgagggggagggcctccacaagctgggctacatcctgcgggacatcagcaagatccccgggggcaacatgtacgccgacgacaccgcggggtgggacacccgcatcaccgagggcgacctccagaacgaggccaagatcacggacatcatggagccggagcacgccctgctggccaagtccatcttcaagctcacctaccagaacaaggtggtgcgggtccagcgccccgccaagaacggcaccgtgatggacgtgatcagccgccgggaccagcgcgggtccggccaggtcgggacctacggcctgaacacgttcaccaacatggaggcgcagctgatccggcagatggagagcgaggggatcttctcccccaacgagctcgagacccccaacctggccgagcgcgtgctggactggctcgagaagtacggcgtggagcggctgaagcgcatggccatcagcggcgacgactgcgtcgtgaagccgatcgacgaccggttcgccaccgccctgacggcgctcaacgacatggggaaggtgcgcaaggacatcccccagtgggagccctccaagggctggaacgactggcagcaggtccccttctgcagccaccacttccaccagctgatcatgaaggacgggcgggagatcgtggtgccgtgccgcaaccaggacgagctggtcggccgggcccgcgtgagccagggggccggctggtccctccgggagaccgcctgcctgggcaagagctacgcccagatgtggcagctgatgtacttccaccgccgggacctccgcctggcggccaacgccatctgctccgccgtgcccgtcgactgggtgcccaccagccggaccacgtggtccatccacgcgcaccaccagtggatgaccaccgaggacatgctgagcgtgtggaaccgcgtctggatcgaggagaacccctggatggaggacaagacccggatctccagctgggaggacgtgccgtacctcggggagcgcgaggaccagtggtgcggctccctgatcgggctgacggcccgcgccacctgggccaccaacgtgcaggtcgccatcaaccaggtgcggcgcctcatcggcaacgagaactacagcgactacatgacctccatgaagcggttcaagaacaagagcgagcccgagggggcgctgtggtga

SEQ ID NO: 8993 - RNA, 9876 nt, synthetic construct
  misc_feature 1..9876: note = derived and/or modified CDS sequence (opt1) from DENV-2__AJ968413__SS-prME
  source 1..9876: mol_type = other RNA
accgccgggatgatcatcatgctgatccccaccgtgatggccttccacctcaccacccggaacggggagccccacatgatcgtcagccggcaggagaagggcaagagcctgctgttcaagaccgaggacggggtgaacatgtgcaccctcatggcgatggacctgggcgagctgtgcgaggacaccatcacctacaagtgccccctcctgcggcagaacgagcccgaggacatcgactgctggtgcaacagcaccagcacctgggtgacctacgggacctgcaccaccaccggcgagcaccggcgcgagaagcggagcgtcgccctggtgccccacgtgggcatggggctcgagacccgcaccgagacctggatgtccagcgagggcgcctggaagcacgcccagcggatcgagacgtggatcctgcgccaccccgggttcaccctgatggccgcgatcctcgcctacaccatcggcaccacgcacttccagcgggccctgatcttcatcctgctcaccgccgtcgcgccctccatgaccatgcgctgcatcgggatcagcaaccgggacttcgtggagggcgtgtccggcgggagctgggtcgacatcgtgctggagcacggctcctgcgtgaccacgatggccaagaacaagcccaccctggacttcgagctcatcaagaccgaggccaagcagctggccaccctgcgcaagtactgcatcgaggccaagctcacgaacaccaccaccgagagccggtgccccacgcagggggagccctccctgaacgaggagcaggacaagcgcttcgtctgcaagcacagcatggtggaccggggctggggcaacgggtgcggcctgttcgggaagggcgggatcgtgacctgcgcgatgttcacgtgcaagaagaacatggagggcaagatcgtccagcccgagaacctcgagtacaccatcgtgatcacgccccactccggcgaggagcacgccgtggggaacgacaccggcaagcacgggaaggagatcaagatcacgccccagagctccatcaccgaggccgagctgaccggctacgggacggtcaccatggagtgcagcccgcgcaccggcctggacttcaacgagatggtgctcctgcagatggagaacaaggcctggctggtgcaccggcagtggttcctcgacctgcccctgccctggctccccggcgccgacacccaggggtccaactggatccagaaggagacgctggtcaccttcaagaacccgcacgcgaagaagcaggacgtggtggtcctgggcagccaggagggggccatgcacaccgccctcaccggcgccacggagatccagatgagctccgggaacctgctgttcaccggccacctcaagtgccgcctgcggatggacaagctgcagctcaagggcatgagctactccatgtgcaccgggaagttcaaggtggtcaaggagatcgccgagacccagcacggcacgatcgtggtgcgcgtccagtacgagggggacggcagcccctgcaagatccccttcgagatcatggacctggagaagcggcacgtgctgggccgcctcatcaccgtgaaccccatcgtcaccgagaaggactccccggtgaacatcgaggcggagccgcccttcggggacagctacgtgatcatcggcgtcgagcccgggcagctgaagctgaactggttcaagaagggctccagcatcgggcagatgttcgagaccacgatgcgcggcgccaagcggatggccatcctcggcgacaccgcctgggacttcgggtccctgggcggggtgttcaccagcatcggcaaggccctgcaccaggtgttcggggcgatctacggcgccgccttctccggcgtcagctggaccatgaagatcctgatcggggtgatcatcacgtggatcggcatgaactcccgcagcacctccctcagcgtgtccctggtcctggtgggggtggtcaccctctacctgggcgtggtggtccaggccgacagcgggtgcgtggtgtcctggaagaacaaggagctgaagtgcggcagcggcatcttcatcaccgacaacgtccacacgtggaccgagcagtacaagttccagccggagagcccctccaagctcgcgagcgccatccagaaggcccaccaggaggggatctgcggcatccggtccgtgacccgcctggagaacctgatgtggaagcagatcacccccgagctcaaccacatcctgagcgagaacgaggtgaagctgacgatcatgaccggggacatcaagggcatcatgcacgccgggaagcggtccctccgcccccagccgaccgagctgcggtacagctggaagacctggggcaaggccaagatcctgtccacggagagccacaaccagaccttcctcatcgacggccccgagaccgcggagtgccccaacaccaaccgcgcctggaactccctggaggtcgaggactacgggttcggcgtgttcacgaccaacatctggctgaagctccgggagaagcaggacgtgttctgcgacagcaagctgatgtccgccgccatcaaggacaaccgcgccgtccacgcggacatggggtactggatcgagagcgccctgaacgacacctggaagatcgagaaggcctccttcatcgaggtcaagagctgccactggccgaagtcccacaccctctggagcaacggcgtgctggagtccgagatgatcatccccaagaacttcgccggccccgtgagccagcacaactaccggcccgggtaccacacccagacggccggcccgtggcacctggggaagctcgagatggacttcgacttctgcgagggcaccaccgtggtggtcaccgaggactgcgggaaccgcggccccagcctgcggacgaccaccgcgtccggcaagctgatcaccgagtggtgctgccgcagctgcacgctgccgcccctccggtaccgcggggaggacggctgctggtacgggatggagatccggccgctgaaggagaaggaggagaacctcgtgaactccctggtgaccgccggccacgggcagatcgacaacttcagcctgggcgtcctcggcatggccctgttcctggaggagatgctccgcacccgggtggggaccaagcacgccacgctgctggtggcggtctccttcgtgaccctcatcaccggcaacatgagcttccgcgacctggggcgcgtgatggtcatggtgggcgccaccatgacggacgacatcgggatgggcgtgacctacctggccctcctggccgccttcaaggtccggcccaccttcgcggccggcctgctcctgcgcaagctgacctccaaggagctcatgatgacgaccatcggggtggtgctgctgagccagtccaccatccccgagaccatcctcgagctgacggacgccctggccctcggcatgatggtcctgaagatcgtgcggaagatggagcgctaccagctggccgtcaccatcaccgcgatcctctgcgtgcccaacgccgtgatcctgcagaacgcctggaaggtcagctgcaccatcctggccgtggtgtccgtcagcccgctcctgctgacgtccagccagcagaaggccgactggatccccctcgcgctgaccatcaaggggctgaaccccaccgccatcttcctcaccacgctgtcccggaccagcaagaagcgctcctggcccctgaacgaggccatcatggccgtgggcatggtgagcatcctcgcgtccagcctgctgaagaacgacatcccgatgaccggccccctcgtcgccgggggcctgctgaccgtgtgctacgtgctcacggggcggagcgccgacctggagctggagaaggccgccgacgtccgctgggaggaccaggcggagatctccggcagctcccccatcctcagcatcaccatctccgaggacgggagcatgtccatcaagaacgaggaggaggagcagaccctgaccatcctgatccggaccggcctcctggtgatcagcggcctgttccccgtgtccatcccgatcacggccgccgcctggtacctctgggaggtcaagaagcagcgcgccggggtgctgtgggacgtgccctccccgccgcccgtcggcaaggcggagctggaggacggggcctaccggatcaagcagaagggcatcctcgggtactcccagatcggcgccggcgtgtacaaggaggggaccttccacaccatgtggcacgtgacccgcggcgccgtcctgatgcacaaggggaagcggatcgagcccagctgggccgacgtgaagaaggacctgatctcctacggcgggggctggaagctcgagggcgagtggaaggagggggaggaggtgcaggtcctggcgctggagcccggcaagaacccccgcgccgtgcagacgaagcccggcctcttcaagaccaacaccggcaccatcggggccgtgagcctggacttctcccccggcacgagcggctcccccatcatcgacaagaaggggaaggtcgtgggcctgtacgggaacggcgtggtcacccggaacggcgcctacgtgagcgccatcgcgcagaccgagaagtccatcgaggacaacccggagatcgaggacgacatcttccgcaagaagcggctgaccatcatggacctccaccccggggccggcaagacgaagcgctacctgcccgccatcgtgcgggaggccatcaagcgcgggctgcggaccctcatcctggcgcccacccgcgtcgtggccgccgagatggaggaggccctgcgcggcctcccgatccggtaccagacccccgccatccgcgcggagcacacggggcgggagatcgtggacctgatgtgccacgccaccttcaccatgcgcctgctcagccccgtccgggtgcccaactacaacctgatcatcatggacgaggcccacttcaccgacccggccagcatcgccgcgcgcggctacatctccacgcgggtggagatgggcgaggccgccgggatcttcatgaccgccacgccgcccggcagccgcgaccccttcccgcagtccaacgcccccatcatggacgaggagcgggagatccccgagcgcagctggaactccgggcacgagtgggtcaccgacttcaagggcaagacggtgtggttcgtgcccagcatcaaggcggggaacgacatcgccgcctgcctgcggaagaacggcaagaaggtcatccagctctcccgcaagaccttcgacagcgagtacgtgaagacccggaccaacgactgggacttcgtggtcacgaccgacatctccgagatgggcgccaacttcaaggcggagcgcgtgatcgacccgcggcgctgcatgaagcccgtgatcctgaccgacggggaggagcgggtcatcctggccggccccatgcccgtgacccacagctccgccgcccagcgccgggggcgcatcggccgcaacccgaagaacgagaacgaccagtacatctacatgggggagcccctcgagaacgacgaggactgcgcccactggaaggaggcgaagatgctgctggacaacatcaacacgcccgagggcatcatccccagcatgttcgagccggagcgggagaaggtggacgccatcgacggcgagtaccgcctccgcggggaggcccgcaagaccttcgtcgacctgatgcggcgcggcgacctgcccgtgtggctcgcctacaaggtcgccgcggaggggatcaactacgccgaccggcgctggtgcttcgacggcatccggaacaaccagatcctggaggagaacgtggaggtggagatctggaccaaggagggggagcgcaagaagctgaagccccggtggctcgacgcccgcatctactccgacccgctggccctgaaggagttcaaggagttcgccgcgggccgcaagagcctcaccctgaacctgatcacggagatgggccgcctccccaccttcatgacccagaaggcccgggacgccctggacaacctggccgtcctccacaccgcggaggccgggggccgcgcctacaaccacgccctgtccgagctgcccgagacgctcgagaccctgctgctcctgaccctgctcgccaccgtgaccgggggcatcttcctgttcctgatgagcggccgggggatcggcaagatgacgctcgggatgtgctgcatcatcaccgcgtccatcctgctgtggtacgcccagatccagccccactggatcgccgccagcatcatcctcgagttcttcctgatcgtgctgctcatcccggagcccgagaagcagcgcacgccccaggacaaccagctgacctacgtcgtgatcgccatcctgacggtggtcgcggccaccatggccaacgagatgggcttcctcgagaagaccaagaaggacctggggctgggctccatcaccacgcagcagcccgagagcaacatcctcgacatcgacctgcggccggccagcgcctggaccctgtacgcggtggccaccaccttcgtgacgcccatgctccgccactccatcgagaacagctccgtcaacgtgagcctgaccgccatcgccaaccaggccaccgtgctgatgggcctcgggaagggctggcccctgtccaagatggacatcggggtccccctgctcgcgatcggctgctacagccaggtgaacccgatcaccctgacggccgccctgctcctgctggtggcccactacgcgatcatcgggcccggcctccaggccaaggccacccgggaggcccagaagcgcgccgcggccggcatcatgaagaaccccaccgtcgacgggatcaccgtgatcgacctggaccccatcccgtacgaccccaagttcgagaagcagctgggccaggtgatgctcctggtcctgtgcgtgacccaggtgctcatgatgcgcaccacctgggccctgtgcgaggccctgaccctcgccacggggcccatctccaccctgtgggagggcaaccccgggcggttctggaacaccaccatcgcggtcagcatggccaacatcttccgcggctcctacctggccggcgccgggctcctgttcagcatcatgaagaacacgaccaacacccggcgcggcaccgggaacatcggcgagacgctgggcgagaagtggaagaaccggctcaacgccctggggaagtccgagttccagatctacaagaagtccggcatccaggaggtggaccgcaccctggcgaaggaggggatcaagcggggcgagaccgaccaccacgccgtgtcccgcgggagcgccaagctccggtggttcgtcgagcgcaacatggtgaccccggagggcaaggtggtcgacctgggctgcgggcggggcgggtggtcctactactgcggcgggctgaagaacgtgcgcgaggtgaagggcctcacgaagggcgggcccggccacgaggagcccatccccatgagcacctacgggtggaacctggtccggctgcagtccggcgtggacgtgttcttcaccccgcccgagaagtgcgacaccctcctgtgcgacatcggggagagctcccccaaccccaccgtcgaggccggccgcacgctgcgggtgctcaacctggtggagaactggctgaacaacaacatccagttctgcatcaaggtcctgaacccgtacatgcccagcgtgatcgagaagatggaggcgctccagcgcaagtacggcggggccctggtgcggaaccccctgagccgcaactccacccacgagatgtactgggtcagcaacgcctccggcaacatcgtgagctccgtgaacatgatcagccggatgctcatcaaccgcttcaccatgaagcacaagaaggccacctacgagccggacgtcgacctggggtccggcacgcgcaacatcgggatcgagagcgaggtgcccaacctggacatcatcggcaagcggatcgagaagatcaagcaggagcacgagacctcctggcactacgaccaggaccacccctacaagacctgggcctaccacggcagctacgagaccaagcagacggggtccgcgagctccatggtgaacggcgtcgtgcgcctcctgaccaagccctgggacgtggtcccgatggtgacccagatggccatgaccgacacgacccccttcgggcagcagcgggtcttcaaggagaaggtggacacccgcacccaggagcccaaggagggcacgaagaagctgatgaagatcaccgccgagtggctctggaaggagctgggcaagaagaagacgccccggatgtgcacccgcgaggagttcacgcggaaggtgcgcagcaacgccgccctgggggcgatcttcaccgacgagaacaagtggaagtccgcccgggaggccgtcgaggacagccgcttctggggcctcgtggacaaggagcggaacctgcacctggaggggaagtgcgagacctgcgtgtacaacatgatgggcaagcgcgagaagaagctcggggagttcggcaaggccaagggctcccgggccatctggtacatgtggctgggggcgcgcttcctggagttcgaggccctcggcttcctgaacgaggaccactggttcagccgggagaactccctgagcggggtcgagggcgaggggctccacaagctgggctacatcctgcgcgacgtgagcaagaaggagggcggggccatgtacgccgacgacaccgcgggctgggacacgcggatcaccctcgaggacctgaagaacgaggagatggtgaccaaccacatggagggggagcacaagaagctggccgaggccatcttcaagctcacctaccagaacaaggtcgtgcgcgtgcagcggccgacgccccgcggcaccgtcatggacatcatctcccggcgcgaccagcgcgggagcggccaggtgggcacctacgggctgaacaccttcacgaacatggaggcccagctgatccggcagatggagggcgagggggtgttcaagtccatccagcacctcaccgtcaccgaggagatcgccgtgcagaactggctggcgcgcgtgggccgggagcgcctgagccggatggccatctccggcgacgactgcgtcgtgaagcccctcgacgaccgcttcgccagcgccctgaccgccctgaacgacatggggaaggtgcggaaggacatccagcagtgggagccctcccgcggctggaacgactggacgcaggtcccgttctgcagccaccacttccacgagctcatcatgaaggacgggcgggtgctggtggtcccctgccgcaaccaggacgagctgatcggccgggcgcgcatctcccagggggccggctggagcctccgggagaccgcctgcctgggcaagtcctacgcccagatgtggagcctgatgtacttccaccgccgggacctccgcctggccgcgaacgccatctgctccgccgtgcccagccactgggtgcccacctcccggaccacctggagcatccacgccaagcacgagtggatgacgaccgaggacatgctgaccgtctggaaccgcgtgtggatccaggagaacccgtggatggaggacaagacccccgtggagtcctgggaggagatcccctacctcgggaagcgggaggaccagtggtgcggcagcctgatcgggctgacgagccgcgccacctgggcgaagaacatccagaccgccatcaaccaggtccgctccctcatcggcaacgaggagtacaccgactacatgcccagcatgaagcggttccgccgggaggaggaggaggccggggtgctgtggtga

SEQ ID NO: 8994 - RNA, 9876 nt, synthetic construct
  misc_feature 1..9876: note = derived and/or modified CDS sequence (opt1) from DENV-2__AB543624__SS-prME
  source 1..9876: mol_type = other RNA
agcgcggggatgatcatcatgctgatccccaccgtgatggccttccacctcaccacccgcaacggggagccgcacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgcccgacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgatcgggtacggcaccgtcaccatggagtgcagcccccggacgggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccccgagggggcgatgcacaccgccctgacgggcgccaccgagatccagatgagctccgggaacctcctgttcaccggccacctgaagtgccggctgcgcatggacaagctccagctgaagggcatgagctactccatgtgcaccgggaagttcaaggtggtcaaggagatcgccgagacgcagcacggcaccatcgtgatccgggtgcagtacgagggggacggcagcccctgcaagatcccgttcgagatcatggacctggagaagcgctacgtcctcggccggctgatcaccgtgaaccccatcgtgaccgagaaggacaaccccgtcaacatcgaggccgagcccccgttcggggactcctacatcatcatcggcgtggagcccgggcagctgaagctcaactggttcaagaagggcagctccatcgggcagatgttcgagacgaccatgcgcggcgcgaagcgcatggccatcctgggcgacaccgcctgggacttcgggagcctgggcggggtgttcacctccatcggcaaggccctccaccaggtcttcggggccatctacggcgcggccttcagcggcgtgtcctggacgatgaagatcctgatcggggtgatcatcacctggatcggcatgaacagccggtccaccagcctgtccgtcagcctggtgctcgtggggatcgtcaccctgtacctgggcgtgatggtgcaggccgactccgggtgcgtcgtgagctggaagaacaaggagctcaagtgcggctccggcatcttcatcacggacaacgtgcacacctggaccgagcagtacaagttccagcccgagagccccagcaagctggcctccgcgatccagaaggcccaggaggaggggatctgcggcatccgcagcgtcacccggctggagaacctcatgtggaagcagatcgccccggagctgaaccacatcctggccgagaacgaggtgaagctcacgatcatgaccggggacatcaagggcatcatgcaggccgggaagcgctccctgcggccccagcccaccgagctgaagtacagctggaagacctggggcaaggcgaagatgctctccacggagagctacaaccagaccttcctgatcgacggcccggagaccgccgagtgccccaacaccaaccgcgcctggaactccctggaggtggaggactacgggttcggcgtcttcacgaccaacatctggctcaagctgaaggagcggcaggacgccttctgcgacagcaagctgatgtccgccgcgatcaaggacaaccgcgccgtgcacgccgacatggggtactggatcgagagcgccctcaacgacacctggaagatcgagaaggcctccttcatcgaggtgaagaactgccactggcccaagagccacaccctgtggtccaacggcgtcctggagagcgagatgatcatccccaagaacctcgcgggcccggtgtcccagcacaactaccggcccgggtaccacacgcagatcgccggcccctggcacctggggaagctggagatggacttcgacttctgcgacggcaccaccgtgatcgtcaccgaggactgcgggaaccgcggccccagcctccggaccacgaccgcctccggcaagctgatcaccgagtggtgctgccgcagctgcaccctgccgcccctccggtaccgcggggaggacggctgctggtacgggatggagatccggcccctgaaggagaaggaggagaacctggtgaacagcctcgtgacggccggccacgggcaggtcgacaacttctccctgggcgtgctgggcatggccctcttcctggaggagatgctgcgcacccgggtggggaccaagcacgccatcctcctggtcgccgtgagcttcgtgaccctgatcacgggcaacatgtccttcaaggacctcgggcgcgtcgtggtgatggtcggcgccaccatggccgacgacatcgggatgggcgtgacctacctggcgctgctcgccgccttcaaggtgcggcccaccttcgccgccggcctgctgctccgcaagctgacgagcaaggagctgatgatgaccaccatcgggatcgtcctcctgtcccagagcaccatcccggagacggtgctggagctcaccgacgcgctggccctgggcatgatggtgctcaagatcgtccgcaacatggagaagtaccagctggccgtgaccatcatggccatcctgtgcgtccccaacgccgtgatcctccagaacgcgtggaaggtgtcctgcaccatcctggccgtcgtgagcgtgagccccctgctcctgacgagctcccagcagaagaccgactggatccccctggccctcaccatcaaggggctgaacccgaccgccatcttcctgacgaccctcagccggaccaacaagaagcgctcctggcccctgaacgaggcgatcatggccgtcggcatggtgagcatcctggcctccagcctcctgaagaacgacatccccatgaccggccccctggtggccgggggcctcctgacggtctgctacgtgctgaccgggcggtccgccgacctcgagctggagcgcgcgaccgacgtgaagtgggaggaccaggccgagatcagcggctccagcccgatcctgagcatcaccatctccgaggacgggagcatgtccatcaagaacgaggaggaggagcagacgctcaccatcctgatccggaccggcctgctcgtcatcagcggcctgttccccatctccatccccatcaccgccgccgcctggtacctgtgggaggtgaagaagcagcgcgcgggggtgctctgggacgtccccagcccgccgcccatgggcaaggccgagctggaggacggggcctaccggatcaagcagaagggcatcctggggtactcccagatcggcgccggcgtgtacaaggaggggacgttccacaccatgtggcacgtgacccgcggcgccgtcctcatgcacaaggggaagcggatcgagccgagctgggcggacgtgaagaaggacctgatctcctacggcgggggctggaagctggagggcgagtggaaggagggggaggaggtgcaggtcctcgccctggagcccggcaagaacccccgcgccgtgcagaccaagcccgggctgttcaagaccaacaacggcacgatcggggccgtgagcctcgacttctccccgggcaccagcggctcccccatcatcgacaagaaggggaaggtcgtgggcctgtacgggaacggcgtggtcacccggagcggcgcctacgtgtccgcgatcgcccagaccgagaagtccatcgaggacaaccccgagatcgaggacgacatcttccgcaagcggcgcctgacgatcatggacctgcaccccggggccggcaagaccaagcggtacctcccggccatcgtgcgcgaggcgatcaagcgggggctgcgcaccctgatcctcgcccccacccgggtcgtggccgccgagatggaggaggccctgcgcggcctgcccatccggtaccagacgcccgcgatccgcgccgagcacaccgggcgcgagatcgtggacctcatgtgccacgccaccttcaccatgcggctgctgtccccggtccgcgtgcccaactacaacctcatcatcatggacgaggcccacttcacggaccccgccagcatcgcggcccggggctacatctccacccgcgtggagatgggcgaggccgccgggatcttcatgaccgccacgccgcccggcagccgggaccccttcccccagagcaacgcgcccatcatcgacgaggagcgcgagatccccgagcggtcctggaacagcgggcacgagtgggtcacggacttcaagggcaagaccgtgtggttcgtgccctccatcaaggccgggaacgacatcgccgcctgcctgcgcaagaacggcaagaaggtcatccagctgagccggaagaccttcgactccgagtacgtgaagacccgcacgaacgactgggacttcgtggtcaccaccgacatcagcgagatgggcgcgaacttcaaggccgagcgggtgatcgacccccgccggtgcatgaagcccgtgatcctcaccgacggggaggagcgcgtcatcctggccggcccgatgcccgtgacgcactccagcgccgcccagcggcgcgggcggatcggccgcaaccccaagaacgagaacgaccagtacatctacatgggggagcccctggagaacgacgaggactgcgcgcactggaaggaggccaagatgctcctggacaacatcaacaccccggagggcatcatcccctccatgttcgagcccgagcgggagaaggtggacgccatcgacggcgagtaccgcctgcgcggggaggcccggaagaccttcgtcgacctcatgcgccggggcgacctgccggtgtggctggcctacaaggtggcggccgaggggatcaactacgccgaccgccggtggtgcttcgacggcatcaagaacaaccagatcctcgaggagaacgtcgaggtggagatctggaccaaggagggggagcgcaagaagctgaagccccggtggctggacgcccgcatctacagcgaccccctcgccctgaaggagttcaaggagttcgcggccggccggaagtccctgacgctcaacctgatcaccgagatgggccgcctgcccaccttcatgacccagaagacgcgggacgccctcgacaacctggccgtcctgcacaccgcggaggccgggggccgcgcctacaaccacgccctcagcgagctgccggagaccctggagaccctcctgctgctcacgctgctggccaccgtgaccgggggcatcttcctcttcctgatgtccggccgggggatcggcaagatgaccctggggatgtgctgcatcatcacggcgagcatcctcctgtggtacgcccagatccagccccactggatcgccgcctccatcatcctggagttcttcctcatcgtgctgctgatccccgagcccgagaagcagcgcaccccgcaggacaaccagctcacctacgtcgtgatcgccatcctgaccgtggtcgcggccaccatggccaacgagatgggcttcctggagaagacgaagaaggacctcgggctgggcagcatcgccacccagcaccccgagtccaacatcctggacatcgacctccggcccgccagcgcgtggaccctgtacgccgtggccaccacgttcatcacccccatgctgcgccactccatcgagaacagcagcgtgaacgtctccctcaccgccatcgccaaccaggcgaccgtgctgatgggcctggggaagggctggccgctcagcaagatggacatcggggtgcccctgctggccatcggctgctactcccaggtcaaccccatcacgctcaccgccgccctgctgctcctggtggcgcactacgccatcatcgggcccggcctgcaggccaaggccacccgggaggcccagaagcgcgcggccgccggcatcatgaagaacccgaccgtggacgggatcacggtcatcgacctcgaccccatcccctacgaccccaagttcgagaagcagctgggccaggtgatgctgctcatcctgtgcgtgacccaggtcctgatgatgcggaccacctgggccctctgcgaggccctgacgctggcgaccgggccgatcagccccctctgggagggcaaccccgggcgcttctggaacaccaccatcgccgtgtccatggccaacatcttccggggcagctacctggccggcgccgggctcctcttctccatcatgaagaacacgaccaacacccgccgcggcaccgggaacatcggcgagacgctgggcgagaagtggaagtcccggctgaacgcgctcgggaagtccgagttccagatctacaagaagtccggcatccaggaggtggaccgcaccctggccaaggaggggatcaagcggggcgagaccgaccaccacgccgtctcccgcgggagcgccaagctgcggtggttcgtggagcgcaacatggtgacccccgagggcaaggtcgtggacctcggctgcgggcggggcgggtggtcctactactgcggcgggctgaagaacgtgcgcgaggtcaagggcctgacgaagggcgggccgggccacgaggagcccatccccatgagcacctacgggtggaacctcgtgcggctgcagtccggcgtggacgtcttcttcatcccgcccgagaagtgcgacaccctgctctgcgacatcggggagagctcccccaaccccaccgtggaggcgggccgcacgctgcgggtgctgaacctcgtcgagaactggctgaacaaccacacccacttctgcatcaaggtgctgaacccgtacatgcccagcgtgctggagaagatggaggccctccagcgcaagtacggcggggccctggtccggaaccccctgtcccgcaacagcacccacgagatgtactgggtgagcaacgcctccggcaacatcgtgagctccgtcaacatgatcagccggatgctcatcaaccgcttcaccatgcggcacaagaaggccacgtacgagcccgacgtggacctggggtccggcacccgcaacatcgggatcgagagcgagatcccgaacctggacatcatcggcaagcggatcgagaagatcaagcaggagcacgagacctcctggcactacgaccaggaccacccctacaagacctgggcgtaccacggcagctacgagaccaagcagacggggtccgccagctccatggtgaacggcgtcgtgcgcctcctgaccaagccctgggacgtgctgcccaccgtcacccagatggccatgacggacaccaccccgttcgggcagcagcgcgtgttcaaggagaaggtggacacccggacgcaggagcccaaggagggcaccaagaagctcatgaagatcaccgccgagtggctgtggaaggagctgggcaagaagaagacgccccgcatgtgcacgcgggaggagttcacccgcaaggtccggagcaacgccgcgctcggggccatcttcaccgacgagaacaagtggaagtccgcccgcgaggccgtggaggacagccggttctgggagctggtggacaaggagcgcaacctgcacctcgagggcaagtgcgagacctgcgtctacaacatgatggggaagcgggagaagaagctgggcgagttcgggaaggccaagggctcccgcgcgatctggtacatgtggctgggcgcccggttcctcgagttcgaggccctggggttcctgaacgaggaccactggttcagccgcgagaactccctcagcggcgtggagggggagggcctgcacaagctggggtacatcctccgggacgtctccaagaaggagggcggcgccatgtacgcggacgacacggccgggtgggacacccgcatcaccctggaggacctgaagaacgaggagatggtgaccaaccacatggagggcgagcacaagaagctcgccgaggccatcttcaagctgacgtaccagaacaaggtggtccgggtgcagcgccccaccccgcgggggaccgtgatggacatcatcagccgccgggaccagcgcggcagcgggcaggtcggcacctacggcctgaacacgttcaccaacatggaggcccagctcatccggcagatggagggggagggcgtgttcaagaacatccagcgcctgaccgtgaccgaggaggtcgcggtgcacaactggctggcccgcgtggggcgggagcgcctctcccggatggccatcagcggcgacgactgcgtcgtgaagcccctggacgaccgcttcgccaacgccctgacggcgctcaacgacatgggcaagatccggaaggacatccagcagtgggagccctccaaggggtggaacgactggacccaggtgcccttctgcagccaccacttccacgagctgatcatgaaggacggccgcgtcctggtggtgccgtgccggaaccaggacgagctcatcgggcgcgcccggatctcccagggcgccgggtggagcctgcgcgagaccgcctgcctgggcaagtcctacgcccagatgtggagcctcatgtacttccaccggcgcgacctgcggctggcggccaacgccatctgctccgccgtccccagccactgggtgcccacctcccgcacgacctggagcatccacgccaagcacgagtggatgaccaccgaggacatgctcacggtgtggaaccgggtctggatccgcgagaacccctggatggaggacaagaccccggtggagtcctgggaggagatcccctacctgggcaagcgggaggaccagtggtgcgggagcctgatcggcctcacctcccgcgcgacctgggccaagaacatccaggccgccatcaaccaggtgcggagcctgatcgggaacgaggagtacaccgactacatgccctccatgaagcgcttccgccgggaggaggaggaggcgggcgtcctgtggtga

SEQ ID NO: 8995 - RNA, 9876 nt, synthetic construct
  misc_feature 1..9876: note = derived and/or modified CDS sequence (opt1) from DENV-2__AB189122__SS-prME
  source 1..9876: mol_type = other RNA
accgccggcgtgatcatcatgatgatccccaccgtgatggccttccacctgaccacccggaacggggagccccacatgatcgtgagccggcaggagaagggcaagtccctcctgttcaagaccgagaacggggtgaacatgtgcaccctgatggccatggacctcggcgagctgtgcgaggacaccatcacctacaactgccccctgctccgccagaacgagcccgaggacatcgactgctggtgcaacagcacctccacctgggtcacctacgggacctgcaccgccaccggcgagcaccggcgcgagaagcggagcgtggccctggcgccccacgtgggcatggggctggagacgcgcaccgagacctggatgtccagcgagggcgcctggaagcacgcgcagcggatcgagacctgggtcctccgccaccccgggttcacgatcatggccgccatcctggcctacaccatcggcaccacctacttccagcgggtgctgatcttcatcctcctgacggcggtggccccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggcgaagctcaccaacacgaccaccgccagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaaggtggtccagcccgagaacctcgagtacaccatcgtgatcacgccccactccggcgaggagaacgccgtggggaacgacaccggcaagcacgggaaggagatcaaggtcaccccgcagagctccatcaccgaggccgagctgaccggctacgggaccgtgacgatggagtgcagcccccgcaccggcctggacttcaacgagatggtgctcctgcagatggagaacaaggcgtggctggtccaccggcagtggttcctcgacctgcccctgccctggctcccgggcgccgacacccaggggtccaactggatccagaaggagaccctggtgacgttcaagaacccccacgccaagaagcaggacgtcgtggtgctgggcagccaggagggggccatgcacaccgccctcaccggcgcgaccgagatccagatgagctccgggaacctgctgttcacgggccacctcaagtgccgcctgcggatggacaagctgcagctcaagggcatgagctactccatgtgcaccgggaagttcaaggtcgtgaaggagatcgccgagacccagcacggcaccatcgtgatccgcgtccagtacgagggggacggcagcccctgcaagatccccttcgagatcatggacctggagaagcggcacgtgctgggccgcctcatcacggtgaacccgatcgtcaccgagaaggactcccccgtgaacatcgaggccgagccgcccttcggggacagctacatcatcatcggcgtggagccggggcagctgaagctgaactggttcaagaagggctccagcatcgggcagatgttcgagaccaccatgcgcggcgccaagcggatggccatcctcggcgacacggcgtgggacttcgggtccctgggcggggtcttcaccagcatcggcaaggccctgcaccaggtgttcggggccatctacggcgccgcgttctccggcgtgagctggaccatgaagatcctcatcggggtcgtgatcacctggatcggcatgaactcccgcagcacgtccctgagcgtgtccctggtcctggtgggggtggtcaccctctacctgggcgtgatggtgcaggccgacagcgggtgcgtcgtgtcctggaagaacaaggagctgaagtgcggcagcggcatcttcatcaccgacaacgtgcacacctggacggagcagtacaagttccagcccgagagcccctccaagctcgccagcgccatccagaaggcccacgaggaggggatctgcggcatccggtccgtcacccgcctggagaacctgatgtggaagcagatcacccccgagctcaaccacatcctgagcgagaacgaggtgaagctgaccatcatgacgggggacatcaagggcatcatgcaggcggggaagcggtccctccgcccgcagcccaccgagctgaagtacagctggaaggcctggggcaaggccaagatgctgtccaccgagctccacaaccacaccttcctgatcgacggccccgagacggccgagtgcccgaacaccaaccgggcctggaacagcctggaggtggaggactacgggttcggcgtcttcaccaccaacatctggctcaagctgaaggagcgccaggacgtgttctgcgactccaagctgatgagcgcggccatcaaggacaaccgggccgtgcacgccgacatggggtactggatcgagtccgccctcaacgacacgtggaagatcgagaaggcgagcttcatcgaggtcaagtcctgccactggcccaagagccacaccctgtggtccaacggcgtgctggagagcgagatgatcatccccaagaacttcgccggccccgtgtcccagcacaactaccgcccggggtaccacacccagaccgccggcccctggcacctcgggaagctggagatggacttcgacttctgcgagggcaccacggtcgtggtgaccgaggactgcgggaaccggggccccagcctgcgcaccaccacggccagcggcaagctcatcaccgagtggtgctgccggtcctgcaccctgcccccgctgcgctaccgcggggaggacggctgctggtacgggatggagatccgccccctcaaggagaaggaggagaacctggtcaacagcctggtgaccgcgggccacgggcagatcgacaacttctccctcggcgtgctgggcatggccctgttcctcgaggagatgctgcggacgcgcgtcgggaccaagcacgccatcctgctcgtggccgtgagcttcgtcaccctgatcaccggcaacatgtccttccgggacctggggcgcgtgatggtgatggtcggcgccacgatgaccgacgacatcgggatgggcgtgacctacctcgcgctgctggccgccttcaaggtgcgccccaccttcgccgccggcctcctgctgcggaagctcacgagcaaggagctgatgatgaccaccatcgggatcgtcctgctctcccagagcaccatccccgagacgatcctggagctgaccgacgcgctcgccctgggcatgatggtgctgaagatcgtccgcaacatggagaagtaccagctcgccgtgaccatcatggccatcctgtgcgtgccgaacgccgtcatcctgcagaacgcgtggaaggtgtcctgcaccacgctcgccgtggtcagcgtgagccccctgctgctcaccagctcccagcagaaggccgactggatccccctggccctgaccatcaaggggctcaaccccaccgcgatcttcctgacgaccctgagccggacctccaagaagcgcagctggccgctcaacgaggccatcatggccgtgggcatggtctccatcctggccagctccctgctcaagaacgacatccccatgaccggccccctggtggccgggggcctgctcacggtgtgctacgtcctgaccgggcggagcgcggacctggagctcgagcgcgccgccgacgtgcggtgggaggagcaggccgagatcagcggctccagccccatcctgtccatcaccatcagcgaggacgggtccatgagcatcaagaacgaggaggaggagcagaccctgacgatcctcatccgcaccggcctgctggtgatctccggcctcttcccggtcagcatccccatcaccgccgcggcctggtacctgtgggaggtgaagaagcagcgggccggggtgctgtgggacgtccccagcccgccgcccgtgggcaaggccgagctcgaggacggggcctaccgcatcaagcagaagggcatcctggggtacagccagatcggcgtgggcgtctacaaggaggggaccttccacaccatgtggcacgtgacgcggggcgcggtgctgatgcacaaggggaagcgcatcgagccctcctgggccgacgtcaagaaggacctcatcagctacggcgggggctggaagctggagggcgagtggaaggagggggaggaggtccaggtgctggccctcgagcccggcaagaacccccgggccgtccagaccaagcccgggctgttcaagaccaacaccggcacgatcggggccgtgtccctggacttcagccccggcacctccggcagccccatcgtggacaagaaggggaaggtcgtgggcctctacgggaacggcgtggtcacccgctccggcacctacgtgagcgcgatcgcccagacggagaagaacatcgaggacaaccccgagatcgaggacgacatcttccggaagaagcgcctgaccatcatggacctgcaccccggggccggcaagaccaagcggtacctgcccgccatcgtgcgcgaggcgatcaagcgggggctccgcaccctgatcctggccccgacgcgggtcgtggccgccgagatggaggaggccctccgcggcctgcccatccgctaccagacccccgcgatccgggccgagcacaccgggcgcgagatcgtggacctgatgtgccacgccaccttcacgatgcggctcctgtcccccatccgcgtcccgaactacaacctgatcatcatggacgaggcccacttcaccgaccccgccagcatcgcggcccggggctacatcagcacccgcgtggagatgggcgaggccgccgggatcttcatgaccgccacgccgcccggctcccgggacccgttcccccagagcaacgcgcccatcatggacgaggagcgcgagatccccgagcggtcctggaacagcgggcacgagtgggtgaccgacttcaagggcaagaccgtctggttcgtgccgtccatcaaggccgggaacgacatcgccgcctgcctccgcaagaacggcaagaaggtgatccagctgagccggaagaccttcgactccgagtacatcaagacgcgcaccaacgactgggacttcgtcgtgaccaccgacatcagcgagatgggcgcgaacttcaaggccgagcgggtgatcgacccccgccggtgcatgaagcccgtcatcctgacggacggggaggagcgcgtgatcctcgccggccccatgccggtgacccactccagcgccgcccagcggcgcgggcgggtcggccgcaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgcgagaaggtggacgccatcgacggcgagtaccggctgcgcggggaggcccggaagaccttcgtcgacctgatgcgccggggcgacctccccgtgtggctggcctaccgcgtggcggccgaggggatcaactacgccgaccggcgctggtgcttcgacggcgtcaagaacaaccagatcctggaggagaacgtggaggtggagatctggacgaaggagggggagcggaagaagctcaagccgcgctggctggacgcccggatctacagcgaccccctggccctcaaggagttcaaggagttcgcggccggccgcaagtccctgaccctgaacctcatcaccgagatgggccggctgcccaccttcatgacgcagaaggcccgcaacgccctggacaacctcgcggtcctgcacaccgccgaggccgggggccgggcctacaaccacgccctgagcgagctccccgagaccctggagaccctgctcctgctgacgctcctggcgaccgtgaccgggggcatcttcctgttcctcatgtccggcaaggggatcggcaagatgaccctggggatgtgctgcatcatcaccgccagcgtgctgctctggtacgcccagatccagccgcactggatcgccgcctccatcatcctggagttcttcctgatcgtcctcctgatccccgagcccgagaagcagcgcacgccccaggacaaccagctgacctacgtggtgatcgcgatcctcaccgtcgtggccgccaccatggccaacgagatgggcttcctggagaagacgaagaaggacttcgggctgggcagcatcgccacccagcagccggagtccaacatcctcgacatcgacctgcggcccgcgagcgcctggaccctgtacgccgtggccaccacgttcatcacccccatgctccgccacagcatcgagaactccagcgtcaacgtgtccctgaccgccatcgcgaaccaggccaccgtgctgatgggcctcgggaagggctggcccctgagcaagatggacatcggggtcccgctgctcgccatcggctgctactcccaggtgaaccccatcacgctgaccgccgcgctgctcctgctggtggcccactacgccatcatcgggcccggcctccaggccaaggccacccgggaggcgcagaagcgcgccgccgccggcatcatgaagaaccccaccgtcgacgggatcacggtgatcgacctggacccgatcccctacgaccccaagttcgagaagcagctgggccaggtgatgctcctggtcctgtgcgtgacccaggtgctcatgatgcggaccacctgggccctgtgcgaggcgctgacgctcgccaccgggcccatcagcaccctgtgggagggcaacccggggcgcttctggaacaccacgatcgccgtctccatggccaacatcttccgcggcagctacctggccggcgcggggctcctgttctccatcatgaagaacaccgccaacacccggcgcggcaccgggaacacgggcgagaccctgggcgagaagtggaagaaccggctcaacgccctggggaagtccgagttccaggtgtacaagaagtccggcatccaggaggtggaccgcaccctggccaaggaggggatcgagcggggcgagaccgaccaccacgcggtcagccgcgggtccgccaagctccggtggttcgtggagcgcaacctggtgacgcccgagggcaaggtcgtggacctgggctgcgggcggggcgggtggagctactactgcggcgggctcaagaacgtgaaggaggtcaagggcctgaccaagggcgggcccggccacgaggagcccatcccgatgtccacctacgggtggaacctggtgcgcctccagagcggcgtggacgtcttcttcacgccgcccgagaagtgcgacacgctgctgtgcgacatcggggagtccagccccaacccgaccgtggaggccggccggaccctccgcgtgctgaacctggtcgagaactggctcaacaacaacacccagttctgcatcaaggtgctgaacccctacatgccctccgtgatcgagaagatggaggccctgcagcggaagtacggcggggccctggtccgcaacccgctcagccggaacagcacccacgagatgtactgggtgtccaacgcgagcggcaacatcgtgtccagcgtcaacatgatctcccgcatgctgatcaaccggttcacgatgcgccacaagaaggccacctacgagcccgacgtggacctggggagcggcacccggaacatcgggatcgagtccgagatccccaacctcgacatcatcggcaagcgcatcgagaagatcaagcaggagcacgagaccagctggcactacgaccaggaccacccctacaagacgtgggcctaccacggctcctacgagaccaagcagaccgggagcgcctccagcatggtgaacggcgtcgtgcgcctgctgaccaagccgtgggacgtcatccccatggtgacgcagatggccatgaccgacaccacccccttcgggcagcagcgggtgttcaaggagaaggtcgacacgcgcacccaggagcccaaggagggcaccaagaagctcatgaagatcaccgcggagtggctgtggaaggagctgggcaagaagaagacgccgcggatgtgcacccgcgaggagttcacccggaaggtgcgctccaacgccgccctcggggccatcttcaccgacgagaacaagtggaagtccgcccgggaggcggtggaggactccggcttctgggagctggtcgacaaggagcgcaacctgcacctcgaggggaagtgcgagacgtgcgtgtacaacatgatgggcaagcgggagaagaagctgggggagttcggcaaggccaagggcagccgcgccatctggtacatgtggctgggggcccggttcctcgagttcgaggcgctgggcttcctgaacgaggaccactggttctcccgcgagaacagcctctccggggtggagggcgaggggctgcacaagctgggctacatcctccgggacgtcagcaagaaggagggcggggccatgtacgccgacgacaccgccggctgggacacccgcatcaccctggaggacctgaagaacgaggagatggtgacgaaccacatggagggggagcacaagaagctcgccgaggcgatcttcaagctgacctaccagaacaaggtggtccgggtgcagcgccccacgccccggggcaccgtgatggacatcatcagccgccgggaccagcgcgggtccggccaggtcgtgacgtacggcctgaacaccttcaccaacatggaggcccagctcatccggcagatggagggggagggcgtgttcaagagcatccagcacctgaccgtcacggaggagatcgccgtgaagaactggctggcccgcgtggggcgcgagcggctctcccgcatggccatcagcggcgacgactgcgtcgtgaagcccctggacgaccggttcgcgtccgccctgaccgccctcaacgacatgggcaaggtgcgcaaggacatccagcagtgggagccgagccgggggtggaacgactggacccaggtccccttctgctcccaccacttccacgagctgatcatgaaggacggccgcgtgctggtggtcccctgccggaaccaggacgagctcatcgggcgcgcccggatcagccagggcgccgggtggtccctgcgcgagaccgcgtgcctgggcaagagctacgcccagatgtggtccctcatgtacttccaccggcgcgacctgcggctggccgccaacgccatctgcagcgcggtgccctcccactgggtgccgacgagccgcaccacctggtccatccacgccacccacgagtggatgaccacggaggacatgctcaccgtctggaaccgggtgtggatccaggagaacccctggatggaggacaagacccccgtggagagctgggaggagatcccctacctgggcaagcgcgaggaccagtggtgcgggtccctgatcggcctcaccagccgggccacgtgggccaagaacatccagaccgcgatcaaccaggtccgcagcctgatcgggaacgaggagtacaccgactacatgccgtccatgaagcggttccgccgcgaggaggaggaggccggcgtgctgtggtga

SEQ ID NO: 8996 - RNA, 9876 nt, synthetic construct
  misc_feature 1..9876: note = derived and/or modified CDS sequence (opt1) from DENV-2__AB189123__SS-prME
  source 1..9876: mol_type = other RNA
accgccggcgtgatcatcatgatgatccccaccgtcatggccttccacctgaccacccggaacggggagccccacatgatcgtgtcccggcaggagaagggcaagtccctcctgttcaagaccgagaacggggtgaacatgtgcaccctgatggccatggacctcggcgagctgtgcgaggacaccatcacctacaactgccccctgctccgccagaacgagcccgaggacatcgactgctggtgcaacagcacctccacctgggtcacctacgggacctgcaccgccaccggcgagcaccggcgcgagaagcggagcgtggccctggcgccccacgtgggcatggggctggagacgcgcaccgagacctggatgtccagcgagggcgcctggaagcacgcgcagcggatcgagacctgggtcctccgccaccccgggttcacgatcatggccgccatcctggcctacaccatcggcaccacctacttccagcgggtgctgatcttcatcctcctgacggcggtggccccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggcgaagctcaccaacacgaccaccgccagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaaggtggtccagcccgagaacctcgagtacaccatcgtgatcacgccccactccggcgaggagaacgccgtggggaacgacaccggcaagcacgggaaggagatcaaggtcaccccgcagagctccatcaccgaggccgagctgaccggctacgggaccgtgacgatggagtgcagcccccgcaccggcctggacttcaacgagatggtgctcctgcagatggagaacaaggcgtggctggtccaccggcagtggttcctcgacctgcccctgccctggctcccgggcgccgacacccaggggtccaactggatccagaaggagaccctggtgacgttcaagaacccccacgccaagaagcaggacgtcgtggtgctgggcagccaggagggggccatgcacaccgccctcaccggcgcgaccgagatccagatgagctccgggaacctgctgttcacgggccacctcaagtgccgcctgcggatggacaagctgcagctcaagggcatgagctactccatgtgcaccgggaagttcaaggtcgtgaaggagatcgccgagacccagcacggcaccatcgtgatccgcgtccagtacgagggggacggcagcccctgcaagatccccttcgagatcatggacctggagaagcggcacgtgctgggccgcctcatcacggtgaacccgatcgtcaccgagaaggactcccccgtgaacatcgaggccgagccgcccttcggggacagctacatcatcatcggcgtggagccggggcagctgaagctgaactggttcaagaagggctccagcatcgggcagatgttcgagaccaccatgcgcggcgccaagcggatggccatcctcggcgacacggcgtgggacttcgggtccctgggcggggtcttcaccagcatcggcaaggccctgcaccaggtgttcggggccatctacggcgccgcgttctccggcgtgagctggaccatgaagatcctcatcggggtcgtgatcacctggatcggcatgaactcccgcagcacgtccctgagcgtgtccctggtcctggtgggggtggtcaccctctacctgggcgtgatggtgcaggccgacagcgggtgcgtcgtgtcctggaagaacaaggagctgaagtgcggcagcggcatcttcatcaccgacaacgtgcacacctggacggagcagtacaagttccagcccgagagcccctccaagctcgccagcgccatccagaaggcccacgaggaggggatctgcggcatccggtccgtcacccgcctggagaacctgatgtggaagcagatcacccccgagctcaaccacatcctgagcgagaacgaggtgaagctgaccatcatgacgggggacatcaagggcatcatgcaggcggggaagcggtccctccgcccgcagcccaccgagctgaagtacagctggaaggcctggggcaaggccaagatgctgtccaccgagctccacaaccacaccttcctgatcgacggccccgagacggccgagtgcccgaacaccaaccgggcctggaacagcctggaggtggaggactacgggttcggcgtcttcaccaccaacatctggctcaagctgaaggagcgccaggacgtgttctgcgactccaagctgatgagcgcggccatcaaggacaaccgggccgtgcacgccgacatggggtactggatcgagtccgccctcaacgacacgtggaagatcgagaaggcgagcttcatcgaggtcaagtcctgccactggcccaagagccacaccctgtggtccaacggcgtgctggagagcgagatgatcatccccaagaacttcgccggccccgtgtcccagcacaactaccgcccggggtaccacacccagaccgccggcccctggcacctcgggaagctggagatggacttcgacttctgcgagggcaccacggtcgtggtgaccgaggactgcgggaaccggggccccagcctgcgcaccaccacggccagcggcaagctcatcaccgagtggtgctgccggtcctgcaccctgcccccgctgcgctaccgcggggaggacggctgctggtacgggatggagatccgccccctcaaggagaaggaggagaacctggtcaacagcctggtgaccgcgggccacgggcagatcgacaacttctccctcggcgtgctgggcatggccctgttcctcgaggagatgctgcggacgcgcgtcgggaccaagcacgccatcctgctcgtggccgtgagcttcgtcaccctgatcaccggcaacatgtccttccgggacctggggcgcgtgatggtgatggtcggcgccacgatgaccgacgacatcgggatgggcgtgacctacctcgcgctgctggccgccttcaaggtgcgccccaccttcgccgccggcctcctgctgcggaagctcacgagcaaggagctgatgatgaccaccatcgggatcgtcctgctctcccagagcaccatccccgagacgatcctggagctgaccgacgcgctcgccctgggcatgatggtgctgaagatcgtccgcaacatggagaagtaccagctcgccgtgaccatcatggccatcctgtgcgtgccgaacgccgtcatcctgcagaacgcgtggaaggtgtcctgcaccacgctcgccgtggtcagcgtgagccccctgctgctcaccagctcccagcagaaggccgactggatccccctggccctgaccatcaaggggctcaaccccaccgcgatcttcctgacgaccctgagccggacctccaagaagcgcagctggccgctcaacgaggccatcatggccgtgggcatggtctccatcctggccagctccctgctcaagaacgacatccccatgaccggccccctggtggccgggggcctgctcacggtgtgctacgtcctgaccgggcggagcgcggacctggagctcgagcgcgccgccgacgtgcggtgggaggagcaggccgagatcagcggctccagccccatcctgtccatcaccatcagcgaggacgggtccatgagcatcaagaacgaggaggaggagcagaccctgacgatcctcatccgcaccggcctgctggtgatctccggcctcttcccggtcagcatccccatcaccgccgcggcctggtacctgtgggaggtgaagaagcagcgggccggggtgctgtgggacgtccccagcccgccgcccgtgggcaaggccgagctcgaggacggggcctaccgcatcaagcagaagggcatcctggggtacagccagatcggcgcgggcgtgtacaaggaggggaccttccacaccatgtggcacgtcacgcggggcgccgtgctgatgcacaaggggaagcgcatcgagccctcctgggccgacgtgaagaaggacctcatcagctacggcgggggctggaagctggagggcgagtggaaggagggggaggaggtccaggtgctggccctcgagcccggcaagaacccccgggccgtgcagaccaagcccgggctgttcaagaccaacaccggcacgatcggggcggtctccctggacttcagccccggcacctccggcagccccatcgtggacaagaaggggaaggtggtcggcctctacgggaacggcgtggtgacccgctccggcacctacgtcagcgccatcgcccagacggagaagaacatcgaggacaaccccgagatcgaggacgacatcttccggaagaagcgcctgaccatcatggacctgcaccccggggccggcaagaccaagcggtacctgcccgcgatcgtgcgcgaggccatcaagcgggggctccgcaccctgatcctggccccgacgcgggtggtcgccgccgagatggaggaggcgctccgcggcctgcccatccgctaccagacccccgccatccgggccgagcacaccgggcgcgagatcgtggacctgatgtgccacgccaccttcacgatgcggctcctgtcccccatccgcgtgccgaactacaacctgatcatcatggacgaggcccacttcaccgaccccgcgagcatcgccgcccggggctacatcagcacccgcgtcgagatgggcgaggccgccgggatcttcatgaccgcgacgccgcccggctcccgggacccgttcccccagagcaacgcccccatcatggacgaggagcgcgagatccccgagcggtcctggaacagcgggcacgagtgggtgaccgacttcaagggcaagaccgtgtggttcgtcccgtccatcaaggccgggaacgacatcgccgcgtgcctccgcaagaacggcaagaaggtgatccagctgagccggaagaccttcgactccgagtacatcaagacgcgcaccaacgactgggacttcgtggtcaccaccgacatcagcgagatgggcgccaacttcaaggccgagcgggtgatcgacccccgccggtgcatgaagcccgtgatcctgacggacggggaggagcgcgtcatcctcgccggccccatgccggtgacccactccatcgccgcgcagcggcgcgggcgggtgggccgcaaccccaagaacgagaacgaccagtacatctacatgggggagcccctggagaacgacgaggactgcgcccactggaaggaggccaagatgctgctcgacaacatcaacacccccgagggcatcatcccgagcatgttcgagcccgagcgcgagaaggtcgacgccatcgacggcgagtaccggctgcgcggggaggcccggaagaccttcgtggacctgatgcgccggggcgacctccccgtctggctggcgtaccgcgtggccgccgaggggatcaactacgccgaccggcgctggtgcttcgacggcgtgaagaacaaccagatcctggaggagaacgtcgaggtggagatctggacgaaggagggggagcggaagaagctcaagccgcgctggctggacgcccggatctactccgaccccctggcgctcaaggagttcaaggagttcgccgccggccgcaagagcctgaccctgaacctcatcaccgagatgggccggctgcccaccttcatgacgcagaaggcccgcaacgcgctggacaacctcgccgtgctgcacaccgccgaggccgggggccgggcctacaaccacgcgctgtccgagctccccgagaccctggagaccctgctcctgctgacgctcctggccaccgtcaccgggggcatcttcctgttcctcatgagcggcaaggggatcggcaagatgaccctggggatgtgctgcatcatcaccgcctccgtgctgctctggtacgcccagatccagccgcactggatcgccgcgagcatcatcctggagttcttcctgatcgtgctcctgatccccgagcccgagaagcagcgcacgccccaggacaaccagctgacctacgtcgtgatcgccatcctcaccgtggtcgccgccaccatggccaacgagatgggcttcctggagaagacgaagaaggacttcgggctgggctccatcgcgacccagcagccggagagcaacatcctcgacatcgacctgcggcccgcctccgcctggaccctgtacgccgtggccaccacgttcatcacccccatgctccgccacagcatcgagaacagctccgtgaacgtcagcctgaccgcgatcgccaaccaggccaccgtgctgatgggcctcgggaagggctggcccctgtccaagatggacatcggggtgccgctgctcgccatcggctgctacagccaggtcaaccccatcacgctgaccgcggccctgctcctgctggtggcccactacgccatcatcgggcccggcctccaggccaaggcgacccgggaggcccagaagcgcgccgccgccggcatcatgaagaaccccaccgtggacgggatcacggtcatcgacctggacccgatcccctacgaccccaagttcgagaagcagctgggccaggtgatgctcctggtgctgtgcgtcacccaggtgctcatgatgcggaccacctgggcgctgtgcgaggccctgacgctcgccaccgggcccatctccaccctgtgggagggcaacccggggcgcttctggaacaccacgatcgccgtgagcatggccaacatcttccgcggctcctacctggcgggcgccgggctcctgttcagcatcatgaagaacaccgccaacacccggcgcggcaccgggaacacgggcgagaccctgggcgagaagtggaagaaccggctcaacgccctggggaagtccgagttccagatctacaagaagtccggcatccaggaggtcgaccgcaccctggcgaaggaggggatcgagcggggcgagaccgaccaccacgccgtgtcccgcgggagcgccaagctccggtgcttcgtggagcgcaacctggtcacgcccgagggcaaggtggtggacctgggctgcgggcggggcgggtggtcctactactgcggcgggctcaagaacgtcaaggaggtgaagggcctgaccaagggcgggcccggccacgaggagcccatcccgatgagcacctacgggtggaacctggtgcgcctccagtccggcgtcgacgtgttcttcacgccgcccgagaagtgcgacacgctgctgtgcgacatcggggagagctcccccaacccgaccgtggaggccggccggaccctccgcgtcctgaacctggtggagaactggctcaagaacaacacccagttctgcatcaaggtgctgaacccctacatgcccagcgtcatcgagaagatggaggccctgcagcggaagtacggcggggcgctggtgcgcaacccgctctcccggaacagcacccacgagatgtactgggtgagcaacgcctccggcaacatcgtcagctccgtgaacatgatcagccgcatgctgatcaaccggttcacgatgcgccacaagaaggccacctacgagcccgacgtggacctggggtccggcacccggaacatcgggatcgagagcgagatccccaacctcgacatcatcggcaagcgcatcgagaagatcaagcaggagcacgagacctcctggcactacgaccaggaccacccctacaagacgtgggcctaccacggcagctacgagaccaagcagaccgggtccgccagctccatggtcaacggcgtggtgcgcctgctgaccaagccgtgggacgtcatccccatggtgacgcagatggcgatgaccgacaccacccccttcgggcagcagcgggtcttcaaggagaaggtggacacgcgcacccaggagcccaaggagggcaccaagaagctcatgaagatcaccgccgagtggctgtggaaggagctgggcaagaagaagacgccgcggatgtgcacccgcgaggagttcacccggaaggtgcgcagcaacgccgccctcggggccatcttcaccgacgagaacaagtggaagtccgcgcgggaggccgtcgaggacagcggcttctgggagctggtggacaaggagcgcaacctgcacctcgaggggaagtgcgagacgtgcgtgtacaacatgatgggcaagcgggagaagaagctgggggagttcggcaaggccaagggctcccgcgccatctggtacatgtggctgggggcgcggttcctcgagttcgaggccctgggcttcctgaacgaggaccactggttcagccgcgagaactccctcagcggggtcgagggcgaggggctgcacaagctgggctacatcctccgggacgtgtccaagaaggagggcggggccatgtacgccgacgacaccgccggctgggacacccgcatcaccctggaggacctgaagaacgaggagatggtgacgaaccacatggagggggagcacaagaagctcgcggaggccatcttcaagctgacctaccagaacaaggtcgtgcgggtgcagcgccccacgccccggggcaccgtcctggacatcatcagccgccgggaccagcgcgggagcggccaggtggtgacgtacggcctcaacaccttcaccaacatggaggcccagctgatccggcagatggagggggagggcgtcttcaagtccatccagcacctgaccgtgacggaggagatcgccgtgaagaactggctcgcccgcgtcgggcgcgagcggctgagccgcatggcgatctccggcgacgactgcgtggtgaagcccctggacgaccggttcgccagcgccctcaccgccctgaacgacatgggcaaggtccgcaaggacatccagcagtgggagccgtcccgggggtggaacgactggacccaggtgcccttctgcagccaccacttccacgagctgatcatgaaggacggccgcgtgctcgtcgtgccctgccggaaccaggacgagctgatcgggcgcgcccggatctcccagggcgcggggtggagcctgcgcgagaccgcctgcctcggcaagtcctacgcccagatgtggagcctgatgtacttccaccggcgcgacctgcggctcgccgccaacgcgatctgctccgccgtgcccagccactgggtcccgacgtcccgcaccacctggagcatccacgccacccacgagtggatgaccacggaggacatgctgaccgtgtggaaccgggtgtggatccaggagaacccctggatggaggacaagacccccgtcgagtcctgggaggagatcccctacctgggcaagcgcgaggaccagtggtgcgggagcctcatcggcctgacctcccgggccacgtgggcgaagaacatccagaccgccatcaaccaggtgcgcagcctgatcgggaacgaggagtacaccgactacatgccgagcatgaagcggttccgccgcgaggaggaggaggccggcgtgctctggtga

SEQ ID NO: 8997 - RNA, 9876 nt, synthetic construct
  misc_feature 1..9876: note = derived and/or modified CDS sequence (opt1) from DENV-2__AB189124__SS-prME
  source 1..9876: mol_type = other RNA
accgccggcgtgatcatcatgatgatccccaccgtcatggccttccacctgaccacccggaacggggagccccacatgatcgtgagccggcaggagaagggcaagtccctcctgttcaagaccgagaacggggtgaacatgtgcaccctgatggccatggacctcggcgagctgtgcgaggacaccatcacctacaactgccccctgctccgccagaacgagcccgaggacatcgactgctggtgcaacagcacctccacctgggtcacctacgggacctgcaccgccaccggcgagcaccggcgcgagaagcggagcgtggccctggcgccccacgtgggcatggggctggagacgcgcaccgagacctggatgtccagcgagggcgcctggaagcacgcgcagcggatcgagacctgggtcctccgccaccccgggttcacgatcatggccgccatcctggcctacaccatcggcaccacctacttccagcgggtgctgatcttcatcctcctgacggcggtggccccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggcgaagctcaccaacacgaccaccgccagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaaggtggtccagcccgagaacctcgagtacaccatcgtgatcacgccccactccggcgaggagaacgccgtggggaacgacaccggcaagcacgggaaggagatcaaggtcaccccgcagagctccatcaccgaggccgagctgaccggctacgggaccgtgacgatggagtgcagcccccgcaccggcctggacttcaacgagatggtgctcctgcagatggagaacaaggcgtggctggtccaccggcagtggttcctcgacctgcccctgccctggctcccgggcgccgacacccaggggtccaactggatccagaaggagaccctggtgacgttcaagaacccccacgccaagaagcaggacgtcgtggtgctgggcagccaggagggggccatgcacaccgccctcaccggcgcgaccgagatccagatgagctccgggaacctgctgttcacgggccacctcaagtgccgcctgcggatggacaagctgcagctcaagggcatgagctactccatgtgcaccgggaagttcaaggtcgtgaaggagatcgccgagacccagcacggcaccatcgtgatccgcgtccagtacgagggggacggcagcccctgcaagatccccttcgagatcatggacctggagaagcggcacgtgctgggccgcctcatcacggtgaacccgatcgtcaccgagaaggactcccccgtgaacatcgaggccgagccgcccttcggggacagctacatcatcatcggcgtggagccggggcagctgaagctgaactggttcaagaagggctccagcatcgggcagatgttcgagaccaccatgcgcggcgccaagcggatggccatcctcggcgacacggcgtgggacttcgggtccctgggcggggtcttcaccagcatcggcaaggccctgcaccaggtgttcggggccatctacggcgccgcgttctccggcgtgagctggaccatgaagatcctcatcggggtcgtgatcacctggatcggcatgaactcccgcagcacgtccctgagcgtgtccctggtcctggtgggggtggtcaccctctacctgggcgtgatggtgcaggccgacagcgggtgcgtcgtgtcctggaagaacaaggagctgaagtgcggcagcggcatcttcatcaccgacaacgtgcacacctggacggagcagtacaagttccagcccgagagcccctccaagctcgccagcgccatccagaaggcccacgaggaggggatctgcggcatccggtccgtcacccgcctggagaacctgatgtggaagcagatcacccccgagctcaaccacatcctgagcgagaacgaggtgaagctgaccatcatgacgggggacatcaagggcatcatgcaggcggggaagcggtccctccgcccgcagcccaccgagctgaagtacagctggaaggcctggggcaaggccaagatgctgtccaccgagctccacaaccacaccttcctgatcgacggccccgagacggccgagtgcccgaacaccaaccgggcctggaacagcctggaggtggaggactacgggttcggcgtcttcaccaccaacatctggctcaagctgaaggagcgccaggacgtgttctgcgactccaagctgatgagcgcggccatcaaggacaaccgggccgtgcacgccgacatggggtactggatcgagtccgccctcaacgacacgtggaagatcgagaaggcgagcttcatcgaggtcaagtcctgccactggcccaagagccacaccctgtggtccaacggcgtgctggagagcgagatgatcatccccaagaacttcgccggccccgtgtcccagcacaactaccgcccggggtaccacacccagaccgccggcccctggcacctcgggaagctggagatggacttcgacttctgcgagggcaccacggtcgtggtgaccgaggactgcgggaaccggggccccagcctgcgcaccaccacggccagcggcaagctcatcaccgagtggtgctgccggtcctgcaccctgcccccgctgcgctaccgcggggaggacggctgctggtacgggatggagatccgccccctcaaggagaaggaggagaacctggtcaacagcctggtgaccgcgggccacgggcagatcgacaacttctccctcggcgtgctgggcatggccctgttcctcgaggagatgctgcggacgcgcgtcgggaccaagcacgccatcctgctcgtggccgtgagcttcgtcaccctgatcaccggcaacatgtccttccgggacctggggcgcgtgatggtgatggtcggcgccacgatgaccgacgacatcgggatgggcgtgacctacctcgcgctgctggccgccttcaaggtgcgccccaccttcgccgccggcctcctgctgcggaagctcacgagcaaggagctgatgatgaccaccatcgggatcgtcctgctctcccagagcaccatccccgagacgatcctggagctgaccgacgcgctcgccctgggcatgatggtgctgaagatcgtccgcaacatggagaagtaccagctcgccgtgaccatcatggccatcctgtgcgtgccgaacgccgtcatcctgcagaacgcgtggaaggtgtcctgcaccacgctcgccgtggtcagcgtgagccccctgctgctcaccagctcccagcagaaggccgactggatccccctggccctgaccatcaaggggctcaaccccaccgcgatcttcctgacgaccctgagccggacctccaagaagcgcagctggccgctcaacgaggccatcatggccgtgggcatggtctccatcctggccagctccctgctcaagaacgacatccccatgaccggccccctggtggccgggggcctgctcacggtgtgctacgtcctgaccgggcggagcgcggacctggagctcgagcgcgccgccgacgtgcggtgggaggagcaggccgagatcagcggctccagccccatcctgtccatcaccatcagcgaggacgggtccatgagcatcaagaacgaggaggaggagcagaccctgacgatcctcatccgcaccggcctgctggtgatctccggcctcttcccggtcagcatccccatcaccgccgcggcctggtacctgtgggaggtgaagaagcagcgggccggggtgctgtgggacgtccccagcccgccgcccgtgggcaaggccgagctcgaggacggggcctaccgcatcaagcagaagggcatcctggggtacagccagatcggcgcgggcgtgtacaaggaggggaccttccacaccatgtggcacgtcacgcggggcgccgtgctgatgcacaaggggaagcgcatcgagccctcctgggccgacgtgaagaaggacctcatcagctacggcgggggctggaagctggagggcgagtggaaggagggggaggaggtccaggtgctggccctcgagcccggcaagaacccccgggccgtgcagaccaagcccgggctgttcaagaccaacaccggcacgatcggggcggtctccctggacttcagccccggcacctccggcagccccatcgtggacaagaaggggaaggtggtcggcctctacgggaacggcgtggtgacccgctccggcacctacgtcagcgccatcgcccagacggagaagaacatcgaggacaaccccgagatcgaggacgacatcttccggaagaagcgcctgaccatcatggacctgcaccccggggccggcaagaccaagcggtacctgcccgcgatcgtgcgcgaggccatcaagcgggggctccgcaccctgatcctggccccgacgcgggtggtcgccgccgagatggaggaggcgctccgcggcctgcccatccgctaccagacccccgccatccgggccgagcacaccgggcgcgagatcgtggacctgatgtgccacgccaccttcacgatgcggctcctgtcccccatccgcgtgccgaactacaacctgatcatcatggacgaggcccacttcaccgaccccgcgagcatcgccgcccggggctacatcagcacccgcgtcgagatgggcgaggccgccgggatcttcatgaccgcgacgccgcccggctcccgggacccgttcccccagagcaacgcccccatcatggacgaggagcgcgagatccccgagcggtcctggaacagcgggcacgagtgggtgaccgacttcaagggcaagaccgtgtggttcgtcccgtccatcaaggccgggaacgacatcgccgcgtgcctccgcaagaacggcaagaaggtgatccagctgagccggaagaccttcgactccgagtacatcaagacgcgcaccaacgactgggacttcgtggtcaccaccgacatcagcgagatgggcgccaacttcaaggccgagcgggtgatcgacccccgccggtgcatgaagcccgtgatcctgacggacggggaggagcgcgtcatcctcgccggccccatgccggtgacccactccagcgccgcgcagcggcgcgggcgggtgggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgcgagaaggtcgacgccatcgacggcgagtaccggctgcgcggggaggcccggaagaccttcgtggacctgatgcgccggggcgacctccccgtctggctggcgtaccgcgtggccgccgaggggatcaactacgccgaccggcgctggtgcttcgacggcgtgaagaacaaccagatcctggaggagaacgtcgaggtggagatctggacgaaggagggggagcggaagaagctcaagccgcgctggctggacgcccggatctacagcgaccccctggcgctcaaggagttcaaggagttcgccgccggccgcaagtccctgaccctgaacctcatcaccgagatgggccggctgcccaccttcatgacgcagaaggcccgcaacgcgctggacaacctcgccgtgctgcacaccgccgaggccgggggccgggcctacaaccacgcgctgagcgagctccccgagaccctggagaccctgctcctgctgacgctcctggccaccgtcaccgggggcatcttcctgttcctcatgtccggcaaggggatcggcaagatgaccctggggatgtgctgcatcatcaccgccagcgtgctgctctggtacgcccagatccagccgcactggatcgccgcgtccatcatcctggagttcttcctgatcgtgctcctgatccccgagcccgagaagcagcgcacgccccaggacaaccagctgacctacgtcgtgatcgccatcctcaccgtggtcgccgccaccatggccaacgagatgggcttcctggagaagacgaagaaggacttcgggctgggcagcatcgcgacccagcagccggagtccaacatcctcgacatcgacctgcggcccgccagcgcctggaccctgtacgccgtggccaccacgttcatcacccccatgctccgccacagcatcgagaactccagcgtgaacgtctccctgaccgcgatcgccaaccaggccaccgtgctgatgggcctcgggaagggctggcccctgagcaagatggacatcggggtgccgctgctcgccatcggctgctactcccaggtcaaccccatcacgctgaccgcggccctgctcctgctggtggcccactacgccatcatcgggcccggcctccaggccaaggcgacccgggaggcccagaagcgcgccgccgccggcatcatgaagaaccccaccgtggacgggatcacggtcatcgacctggacccgatcccctacgaccccaagttcgagaagcagctgggccaggtgatgctcctggtgctgtgcgtcacccaggtgctcatgatgcggaccacctgggcgctgtgcgaggccctgacgctcgccaccgggcccatcagcaccctgtgggagggcaacccggggcgcttctggaacaccacgatcgccgtgtccatggccaacatcttccgcggcagctacctggcgggcgccgggctcctgttctccatcatgaagaacaccgccaacacccggcgcggcaccgggaacacgggcgagaccctgggcgagaagtggaagaaccggctcaacgccctggggaagtccgagttccagatctacaagaagtccggcatccaggaggtcgaccgcaccctggcgaaggaggggatcgagcggggcgagaccgaccaccacgccgtgagccgcgggtccgccaagctccggtggttcgtggagcgcaacctggtcacgcccgagggcaaggtggtggacctgggctgcgggcggggcgggtggagctactactgcggcgggctcaagaacgtcaaggaggtgaagggcctgaccaagggcgggcccggccacgaggagcccatcccgatgtccacctacgggtggaacctggtgcgcctccagagcggcgtcgacgtgttcttcacgccgcccgagaagtgcgacacgctgctgtgcgacatcggggagtccagccccaacccgaccgtggaggccggccggaccctccgcgtcctgaacctggtggagaactggctcaagaacaacacccagttctgcatcaaggtgctgaacccctacatgccctccgtcatcgagaagatggaggccctgcagcggaagtacggcggggcgctggtgcgcaacccgctcagccggaacagcacccacgagatgtactgggtgtccaacgccagcggcaacatcgtctccagcgtgaacatgatctcccgcatgctgatcaaccggttcacgatgcgccacaagaaggccacctacgagcccgacgtggacctggggagcggcacccggaacatcgggatcgagtccgagatccccaacctcgacatcatcggcaagcgcatcgagaagatcaagcaggagcacgagaccagctggcactacgaccaggaccacccctacaagacgtgggcctaccacggctcctacgagaccaagcagaccgggagcgcctccagcatggtcaacggcgtggtgcgcctgctgaccaagccgtgggacgtcatccccatggtgacgcagatggcgatgaccgacaccacccccttcgggcagcagcgggtcttcaaggagaaggtggacacgcgcacccaggagcccaaggagggcaccaagaagctcatgaagatcaccgccgagtggctgtggaaggagctgggcaagaagaagacgccgcggatgtgcacccgcgaggagttcacccggaaggtgcgctccaacgccgccctcggggccatcttcaccgacgagaacaagtggaagtccgcgcgggaggccgtcgaggactccggcttctgggagctggtggacaaggagcgcaacctgcacctcgaggggaagtgcgagacgtgcgtgtacaacatgatgggcaagcgggagaagaagctgggggagttcggcaaggccaagggcagccgcgccatctggtacatgtggctgggggcgcggttcctcgagttcgaggccctgggcttcctgaacgaggaccactggttctcccgcgagaacagcctctccggggtcgagggcgaggggctgcacaagctgggctacatcctccgggacgtgagcaagaaggagggcggggccatgtacgccgacgacaccgccggctgggacacccgcatcaccctggaggacctgaagaacgaggagatggtgacgaaccacatggagggggagcacaagaagctcgcggaggccatcttcaagctgacctaccagaacaaggtcgtgcgggtgcagcgccccacgccccggggcaccgtcatggacatcatcagccgccgggaccagcgcgggtccggccaggtggtgacgtacggcctgaacaccttcaccaacatggaggcccagctcatccggcagatggagggggagggcgtcttcaagagcatccagcacctgaccgtgacggaggagatcgccgtgaagaactggctggcccgcgtcgggcgcgagcggctctcccgcatggcgatcagcggcgacgactgcgtggtgaagcccctggacgaccggttcgcctccgccctgaccgccctcaacgacatgggcaaggtccgcaaggacatccagcagtgggagccgagccgggggtggaacgactggacccaggtgcccttctgctcccaccacttccacgagctgatcatgaaggacggccgcgtgctggtcgtgccctgccggaaccaggacgagctcatcgggcgcgcccggatcagccagggcgcggggtggtccctgcgcgagaccgcctgcctgggcaagagctacgcccagatgtggtccctcatgtacttccaccggcgcgacctgcggctggccgccaacgcgatctgcagcgccgtgccctcccactgggtcccgacgagccgcaccacctggtccatccacgccacccacgagtggatgaccacggaggacatgctcaccgtgtggaaccgggtgtggatccaggagaacccctggatggaggacaagacccccgtcgagagctgggaggagatcccctacctgggcaagcgcgaggaccagtggtgcgggtccctgatcggcctcaccagccgggccacgtgggcgaagaacatccagaccgccatcaaccaggtgcgcagcctgatcgggaacgaggagtacaccgactacatgccgtccatgaagcggttccgccgcgaggaggaggaggccggcgtgctgtggtga

SEQ ID NO: 8998 - RNA, 9876 nt, synthetic construct
  misc_feature 1..9876: note = derived and/or modified CDS sequence (opt1) from DENV-2__AB122020__SS-prME
  source 1..9876: mol_type = other RNA
accgccggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccggaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcggcggggtcttcacgtccatcgggaaggccctccaccaggtgttcggggcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcatcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacacgctgtggtccaacggcgtgctggagagcgagatgatcatccccaagaacttcgccgggcccgtgtcccagcacaactaccgcccgggctaccacacccagaccgcggggccctggcacctcggcaagctggagatggacttcgacttctgcgaggggaccacggtcgtggtgaccgaggactgcggcaaccggggccccagcctgcgcaccaccacggccagcgggaagctcatcaccgagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacgcgcgtcggcaccaagcacgcgatcctgctcgtggccctgagcttcgtgaccctgatcaccgggaacatgtccttccgggacctcggccgcgtcatggtgatggtgggggccacgatgaccgacgacatcggcatgggcgtcacctacctggccctgctcgccgcgttcaaggtgcgccccaccttcgccgccgggctgctgctccggaagctgacgagcaaggagctgatgatggccaccatcggcatcgccctcctgtcccagagcaccctgcccgagaccatcctcgagctgacggacgcgctggccctcgggatgatggtgctgaagatcgtccgcaacatggagaagtaccagctggccgtgaccatcatggccatctcctgcgtgccgaacgccgtcatcctccagaacgcgtggaaggtgagctgcaccatcctggccgccgtgtccgtcagccccctgctcctgacctccagccagcagaaggccgactggatccccctggcgctcacgatcaagggcctgaaccccaccgccatcttcctgaccaccctctcccggacgagcaagaagcgctcctggccgctgaacgaggccatcatggccgtgggcatggtcagcatcctggcctccagcctcctgaagaacgacatccccatgaccgggcccctggtggcgggcgggctcctgaccgtgtgctacgtcctgaccggccggagcgccgacctcgagctggagcgcgccgccgacgtgaagtgggaggaccaggccgagatctccgggagctcccccatcctgagcatcacgatctccgaggacggcagcatgtccatcaagaacgaggaggaggagcagaccctcaccatcctgatccggaccggcctgctcgtgatcagcggggtcttcccggtgtccatccccatcaccgcggccgcctggtacctgtgggaggtgaagaagcagcgcgccggcgtcctgtgggacgtgcccagcccgccgcccgtggggaaggccgagctcgaggacggcgcgtaccggatcaagcagcgcgggatcctgggctactcccagatcggcgccggggtctacaaggagggcacgttccacaccatgtggcacgtgacccgcggggccgtgctgatgcaccgcggcaagcggatcgagcccagctgggccgacgtcaagaaggacctcatctcctacgggggcggctggaagctggagggggagtggaaggagggcgaggaggtccaggtgctggccctcgagcccgggaagaacccccgcgcggtccagaccaagcccggcatcttcaagacgaacaccgggaccatcggcgccgtgagcctggacttctcccccggcaccagcgggtcccccatcgtggaccggaagggcaaggtcgtggggctgtacggcaacggcgtggtcacgcgcagcggggcctacgtgtccgccatcgcgcagaccgagaagtccatcgaggacaaccccgagatcgaggacgacatcttccggaagaagcgcctcaccatcatggacctgcaccccggcgccgggaagaccaagcggtacctgcccgccatcgtgcgcgaggccatcaagcggggcctgcgcacgctcatcctggccccgacccgcgtcgtggcggccgagatggaggaggccctgcgggggctccccatccgctaccagacccccgccatccgggccgagcacaccggccgcgagatcgtggacctgatgtgccacgcgacgttcaccatgcggctgctcagccccgtccgcgtgccgaactacaacctgatcatcatggacgaggcccacttcaccgaccccgcctccatcgccgcccggggctacatcagcacccgcgtggagatgggggaggcggccggcatcttcatgacggccacgccgcccgggtcccgggacccgttcccccagagcaacgcccccatcatggacgaggagcgcgagatccccgagcggtcctggaacagcggccacgagtgggtcaccgacttcaaggggaagaccgtgtggttcgtgccgtccatcaaggcgggcaacgacatcgccgcctgcctgcgcaagaacggcaagaaggtcatccagctcagccggaagacgttcgactccgagtacgtgaagacccgcgccaacgactgggacttcgtggtcaccaccgacatcagcgagatgggggccaacttcaaggcggagcgggtgatcgacccccgccggtgcatgaagcccgtgatcctgacggacggcgaggagcgcgtcatcctggccgggcccatgccggtgacccactccagcgccgcccagcggcgcggccgcatcgggcggaaccccaagaacgagaacgaccagtacatctacatgggcgagcccctcgagaacgacgaggactgcgcccactggaaggaggcgaagatgctgctggacaacatcaacacccccgagggcatcatcccgtccatgttcgagcccgagcgcgagaaggtggacgccatcgacggggagtaccggctccgcggcgaggcccggaagaccttcgtcgacctgatgcgccgcggggacctgcccgtgtggctcgcctacaaggtggccgcggagggcatcaactacgccgaccgcaagtggtgcttcgacgggatcaagaacaaccagatcctggaggagaacgtcgaggtggagatctggacgaaggagggcgagcggaagaagctgaagccgcgctggctcgacgcccggatctacagcgaccccctggccctgaaggagttcaaggagttcgcggccggccgcaagtccctcaccctgaacctgatcaccgagatggggcggctccccaccttcatgacgcagaaggcccgcaacgccctggacaacctggccgtgctccacaccgcggaggtcggcgggcgggcctacaaccacgccctgagcgagctgcccgagaccctcgagaccctgctgctcctgacgctgctcgccaccgtgaccggcggcatcttcctgttcctgatgtccgggaagggcatcgggaagatgaccctcggcatgtgctgcatcatcaccgccagcatcctgctgtggtacgcgcagatccagccgcactggatcgccgcctccatcatcctcgagttcttcctgatcgtcctgctcatccccgagcccgagaagcagcgcacgccccaggacaaccagctgacctacgtggtgatcgccatcctgaccgtcgtggccgcgaccatggccaacgagatggggttcctcgagaagacgaagaaggacctgggcttcggcagcatcaccacccaggagagcgagtccaacatcctggacatcgacctccggccggccagcgcctggaccctgtacgccgtggcgacgaccttcgtcacccccatgctgcgccactccatcgagaacagctccgtgaacgtgagcctcaccgccatcgccaaccaggccacggtcctgatggggctgggcaaggggtggcccctctccaagatggacatcggcgtgcccctgctggcgatcgggtgctacagccaggtgaacccgatcaccctcaccgccgccctgctgctcctggtcgcccactacgccatcatcggccccggcctgcaggcgaaggccacccgggaggcccagaagcgcgccgccgcggggatcatgaagaaccccacggtggacggcatcaccgtgatcgacctcgagcccatcccgtacgaccccaagttcgagaagcagctggggcaggtcatgctgctcatcctgtgcgtgacccaggtgctgatgatgcggaccacgtgggccctctgcgaggccctgaccctggccaccggccccatctccaccctctgggaggggaaccccggccgcttctggaacacgaccatcgccgtcagcatggcgaacatcttccgcggctcctacctggccggggccggcctcctgttcagcatcatgaagaacaccaccaacacgcggcgcgggaccggcaacgtgggcgagaccctgggggagaagtggaagtcccggctgaacgccctcggcaagagcgagttccagatctacaagaagtccgggatccaggaggtggaccgcaccctggcgaaggagggcatcaagcgcggggagacggaccaccacgccgtcagccgcggctccgccaagctgcggtggttcgtggagcgcaacatggtgaccccggagggcaaggtcgtggacctcgggtgcggccgcgggggctggagctactactgcgggggcctgaagaacgtgcgcgaggtcaagggcctgaccaagggcggccccgggcacgaggagcccatccccatgtccacctacggctggaacctcgtgcggctgcagagcggggtggacgtcttcttcacgccgcccgagaagtgcgacaccctgctctgcgacatcggcgagagctcccccaaccccaccatcgaggccggccgcaccctgcgggtgctgaacctcgtggagaactggctgaacaacaacacccagttctgcatcaaggtcctgaacccgtacatgcccagcgtgatcgagaagatggagacgctccagcgcaagtacgggggcgccctggtgcggaaccccctgtcccgcaacagcacccacgagatgtactgggtctccaacgcgaccgggaacatcgtgagctccgtgaacatgatcagccggatgctgatcaaccgcttcaccatgaagcacaagaaggccacgtacgagccggacgtcgacctcggctccgggacccggaacatcggcatcgagagcgagatccccaacctggacatcatcggcaagcgcatcgagaagatcaagcaggagcacgagacctcctggcactacgaccaggaccacccctacaagacctgggcctaccacgggagctacgagacgaagcagaccggctccgccagctccatggtgaacggggtggtccgcctgctcaccaagccctgggacgtggtgccgatggtcacccagatggccatgacggacaccacccccttcggccagcagcgggtgttcaaggagaaggtggacacccgcacgcaggagcccaaggagggcaccaagaagctgatgaagatcaccgcggagtggctgtggaaggagctcgggaaggagaagacgccccggatgtgcacgcgcgaggagttcacccggaaggtccgcagcaacgccgccctgggcgccatcttcaccgacgagaacaagtggaagtccgcccgggaggcggtggaggacgggcgcttctgggagctggtggaccgggagcgcaacctccacctggagggcaagtgcgagacctgcgtctacaacatgatggggaagcgggagaagaagctgggcgagttcggcaaggccaaggggagccgcgccatctggtacatgtggctcggcgcccggttcctggagttcgaggcgctggggttcctcaacgaggaccactggttctcccgcggcaacagcctgagcggggtggagggcgagggcctgcaccggctcgggtacatcctgcgcgaggtcggcaagaaggagggcggcgccatgtacgccgacgacacggccgggtgggacacccggatcaccctggaggacctcaagaacgaggagatggtgaccaaccacatgaagggcgagcacaagaagctggccgaggcgatcttcaagctgacgtaccagaacaaggtggtccgcgtgcagcggccgacgccccggggcaccgtgatggacatcatctcccggaaggaccagcgcgggagcggccaggtcgggacctacggcctcaacacgttcaccaacatggaggcccagctgatccgccagatggagggcgaggggatcttcaagtccatccagcacctgaccgccaccgaggagatcgccgtgcagaactggctcgcccgggtgggccgcgagcggctgagccgcatggcgatctccggggacgactgcgtcgtgaagcccatcgacgaccggttcgccagcgccctgacggccctcaacgacatgggcaaggtgcgcaaggacatccagcagtgggagccctcccgggggtggaacgactggacccaggtcccgttctgcagccaccacttccacgagctggtgatgaaggacggccgcgtgctggtcgtgccctgccggaaccaggacgagctcatcggccgcgcccggatctcccagggggcgggctggagcctgaaggagaccgcctgcctggggaagtcctacgcccagatgtggaccctcatgtacttccaccgccgggacctgcgcctggccgccaacgcgatctgcagcgccgtgccctcccactgggtccccaccagccggacgacctggtccatccacgccaagcacgagtggatgaccaccgaggacatgctcgccgtgtggaaccgcgtgtggatccaggagaacccgtggatggaggacaagacgcccgtcgagagctgggaggaggtgccctacctgggcaagcgggaggaccagtggtgcgggtccctgatcggcctcaccagccgcgcgacctgggccaagaacatccagaccgccatcaaccaggtgcggagcctgatcggcaacgaggagtacacggactacatgccctccatgaagcgcttccgccgggaggaggaggaggccggggtcctgtggtga

SEQ ID NO: 8999 - RNA, 9876 nt, synthetic construct
  misc_feature 1..9876: note = derived and/or modified CDS sequence (opt1) from DENV-2__LC121816__SS-prME
  source 1..9876: mol_type = other RNA
accgtggggatgatcatcatgctgatccccaccgccatggccttccacctcaccacccgcaacggggagccccacatgatcgtgagccggcaggagaagggcaagagcctgctgttcaagaccgaggacggggtgaacatgtgcaccctcatggcgatggacctgggggagctgtgcgaggacaccgtgacctacaactgccccctcctgcgccagaacgagcccgaggacatcgactgctggtgcaacagcaccagcacctgggtcacctacgggacctgcaccgccaccggggagcaccggcgcgagaagcggagcgtggccctggtgccccacgtcggcatggggctcgagacccgcaccgagacctggatgtccagcgagggcgcctggaagcacgcccagcggatcgagacctggatcctgcgccaccccgggttcacgatcatggcggccatcctggcccacaccatcggcaccacctacttccagcgggtgctcatcttcatcctgctgacggccgtggcgccctccatgaccatgcgctgcatcgggatcagcaaccgggacttcgtcgagggcgtgtccggcgggagctgggtggacatcgtcctcgagcacggctcctgcgtgaccaccatggccaagaacaagcccacgctggacttcgagctgatcaagaccgaggccaagcagcccgccaccctccgcaagtactgcatcgaggccaagctgaccaacacgaccaccgcgagccggtgcccgacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaagatcgtgcagcccgagaacctggagtacaccatcgtcatcacgccccactccggcgaggagaacgccgtggggaacgacacgggcaagcacgggaaggaggtgaaggtcaccccgcagagctccatcaccgaggccgagctgaccggctacgggaccgtgacgatggagtgcagcccccgcaccggcctcgacttcaacgagatggtgctgctgcagatggagaacaaggcctggctcgtccaccggcagtggttcctggacctgcccctcccctggctgccgggcgcggacacccaggggtccaactggatccagaaggagaccctggtgacgttcaagaacccccacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaacccgatcgtcaccgagcgcgactcccccgtgaacatcgaggccgagccgcccttcggggacagctacatcatcatcggcgtggagccggggcagctgaagctctcctggttcaagaagggcagctccatcgggcagatgttcgagaccaccatgcggggcgccaagcgcatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccggtccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagcccgagtcccccagcaagctggcctccgccatccagaaggcctacgaggaggggatctgcggcatccgcagcgtcacccggctggagaacctcatgtggaagcagatcacccccgagctgaaccacatcctgtccgagaacgaggtgaagctcaccatcatgacgggggacatcaagggcatcatgcaggccgggaagcgcagcctgcggccgcagcccaccgagctgaagtactcctggaagacctggggcaaggcgaagatgctcagcaccgagcaccacaaccagacgctgctgatcgacggccccgagaccgccgagtgcccgaacaccaaccgcgcctggaactccctcgaggtggaggactacgggttcggcgtcttcaccacgaacatctggctgaagctgaaggagcggcaggacgtgttctgcgacagcaagctcatgtccgccgccatcaaggacaaccgcgcggtgcacgccgacatggggtactggatcgagagcgccctgaacgacacctggaagatcgagaaggcctccttcatcgaggtcaagagctgccactggcccaagtcccacaccctgtggagcaacggcgtgctcgagtccgagatgatcatccccaagaacttcgccggccccgtgagccagcacaactaccggccggggtaccacacccagaccgcgggcccctggcacctggggaagctggagatggacttcgacttctgcgagggcacgaccgtcgtggtgaccgaggactgcgggaaccgcggccccagcctccggaccacgaccgcctccggcaagctgatcaccgagtggtgctgccgcagctgcaccctgcccccgctccggtaccgcggggaggacggctgctggtacgggatggagatccggcccctgaaggagaaggaggagaacctggtcaactccctcgtgacggccggccacgggcagatcgacaacttcagcctgggcgtgctgggcatggccctcttcctggaggagatgctgcgcacccgggtcgggaccaagcacgcgctcctgctggtggccgtgtccttcatgaccctcatcacgggcaacatgagcttccgcgacctggggcgcgtcatggtgatggtgggcgccgccatgaccgacgacatcgggatgggcgtcacctacctggccctcctggcggccttcaaggtgcggcccaccttcgccgccggcctgctcctgcgcaagctgacgtccaaggagctcatgatgaccaccatcgggatcgtgctgctgagccagtccaccatccccgagacgatcctcgagctgaccgacgccctggcgctcggcatgatgatcctgaagatcgtccggaacatggagaagtaccagctggccgtgaccatcatggccatcctctgcgtcccgaacgccgtgatcctgcagaacgcctggaaggtgagctgcaccatcctggcggtcgtgtccgtgacgcccctcctgctgaccagctcccgccagaaggccgactggatccccctcgccctgaccatcaaggggctgaaccccaccgccatcttcctcacgaccctgagccggaccaacaagaagcgctcctggccgctgaacgaggcgatcatggccgtcggcatggtgagcatcctcgcctccagcctgctgaagaacgacatccccatgaccggccccctcgtggccgggggcctgctgacggtctgctacgtgctcaccgggcggtccgccgacctggagctggagcgcgcggccgacgtgcggtgggaggaccaggccgagatcagcggcagctcccccatcctcagcatcaccatctccgaggacgggagcatgtccatcaagaacgaggaggaggagcagaccctgacgatcctgatccgcaccggcctcctggtcatcagcggcctgttcccggtgtccatccccatcaccgccgccgcgtggtacctctgggaggtgaagaagcagcgggccggggtcctgtgggacgtgcccagcccgccgcccgtgggcaaggccgagctggaggacggggcctaccgcatcaagcagaagggcatcctcgggtactcccagatcggcgccggcgtctacaaggaggggaccttccacaccatgtggcacgtgacgcggggcgcggtgctgatgcacaaggggaagcgcatcgagcccagctgggccgacgtccggaaggacctgatctcctacggcgggggctggaagctcgagggcgagtggaaggagggggaggaggtccaggtgctggccctggagcccggcaagaacccccgcgccgtccagaccaagcccggcctgttcaagaccgacaccggcacgatcggggccgtgagcctggacttctcccccggcaccagcggctcccccatcgtggacaagaaggggaaggtcgtgggcctgtacgggaacggcgtggtcacccggagcggcacctacgtgtccgcgatcgcccagacggagaagtccatcgaggacaaccccgagatcgaggacgacatcttccgcaagcggcgcctgaccatcatggacctccaccccggggccggcaagaccaagcggtacctgcccgccatcgtgcgcgaggcgatcaagcgcgggctgcggaccctcatcctggccccgacgcgcgtcgtggccgccgagatggaggaggccctgcggggcctccccatccgctaccagacccccgcgatccgggccgagcacaccgggcgcgagatcgtggacctgatgtgccacgccaccttcacgatgcggctgctctcccccgtccgcgtgccgaactacaacctgatcatcatggacgaggcccacttcaccgaccccgccagcatcgcggcccggggctacatcagcacccgcgtggagatgggcgaggccgccgggatcttcatgaccgccacgccgcccggctcccgggacccgttcccccagagcaacgcgcccatcatggacgaggagcgcgagatccccgagcggtcctggaacagcgggcacgagtgggtcaccgacttcaagggcaagaccgtgtggttcgtgccgtccatcaaggccgggaacgacatcgccgcctgcctgcgcaagaacggcaagaaggtcatccagctcagccggaagaccttcgactccgagtacatcaagacgcgcaccaacgactgggacttcgtggtgaccaccgacatcagcgagatgggcgcgaacttcaaggccgagcgggtcatcgacccccgccggtgcatgaagcccgtgatcctgacggacggggaggagcgcgtgatcctggccggccccatgccggtcacccactccagcgccgcccagcgccgggggcgcatcggccggaaccccaagaacgagaacgaccagtacatctacatgggggagcccctcgagaacgacgaggactgcgcgcactggaaggaggccaagatgctgctggacaacatcaacacccccgagggcatcatcccgtccatgttcgagcccgagcgcgagaaggtggacgccatcgacggcgagtaccggctccgcggggaggcccggaagaccttcgtggacctgatgcgccggggcgacctgcccgtctggctcgcctaccgcgtggcggccgaggggatcaactacgccgaccggcgctggtgcttcgacggcgtcaagaacaaccagatcctggaggagaacgtggaggtggagatctggacgaaggagggggagcggaagaagctgaagccgcgctggctcgacgcccggatctacagcgaccccctggccctgaaggagttcaaggagttcgcggccggccgcaagtccctcaccctgaacctgatcaccgagatgggccggctccccaccttcatgacgcagaaggcccgcaacgccctggacaacctggcggtcctccacaccgccgaggccgggggccgggcctacaaccacgccctgagcgagctgcccgagaccctcgagaccctgctgctcctgacgctgctcgcgaccgtgaccgggggcatcttcctgttcctgatgtccggcaaggggatcggcaagatgaccctcgggatgtgctgcatcatcaccgccagcatcctgctgtggtacgcccagatccagccgcactggatcgccgcctccatcatcctcgagttcttcctgatcgtgctgctcatccccgagcccgagaagcagcgcacgccccaggacaaccagctgacctacgtcgtgatcgcgatcctgaccgtggtcgccgccaccatggccaacgagatgggcttcctcgagaagacgaagaaggacttcgggctgggcagcatcgccacccagcagccggagtccaacatcctggacatcgacctccggcccgcgagcgcctggaccctgtacgccgtggccaccacgttcatcacccccatgctgcgccacagcatcgagaactccagcgtgaacgtctccctcaccgccatcgcgaaccaggccaccgtgctgatgggcctggggaagggctggcccctcagcaagatggacatcggggtgccgctgctggccatcggctgctactcccaggtcaaccccatcacgctcaccgccgcgctgctgctcctggtggcccactacgccatcatcgggcccggcctgcaggccaaggccacccgcgaggcgcagaagcgggccgccgccggcatcatgaagaaccccaccgtggacgggatcacggtcatcgacctcgacccgatcccctacgaccccaagttcgagaagcagctgggccaggtgatgctgctcgtgctgtgcgtcacccaggtgctgatgatgcgcaccacctgggccctctgcgaggcgctgacgctggccaccgggcccatcagcaccctctgggagggcaacccggggcggttctggaacaccacgatcgccgtgtccatggccaacatcttccgcggcagctacctggccggcgcggggctcctcttctccatcatgaagaacaccaccaacacccggcgcggcacggggaacaccggcgagaccctgggcgagaagtggaagaaccggctgaacgccctcggcaagagcgagttccagacctacaagaagtccggcatccaggaggtcgaccgcacgctggccaaggaggggatcaagcggggcgagaccgaccaccacgccgtgagccgcgggtccgcgaagctgcggtggttcgtggagcgcaacctcgtcacccccgagggcaaggtggtggacctgggctgcgggcggggcgggtggagctactactgcggcgggctgaagaacgtccgcgaggtgaagggcctcaccaagggcgggcccggccacgaggagcccatcccgatgtccacgtacgggtggaacctggtgcggctgcagagcggcgtcgacgtgttcttcacgccgcccgagaagtgcgacaccctcctgtgcgacatcggggagtccagccccaacccgaccgtggaggccggccgcaccctgcgggtcctcaacctggtggagaactggctgaacaacaacacgcagttctgcatcaaggtgctgaacccctacatgccctccgtcatcgagaagatggaggccctccagcgcaagtacggcggggccctggtgcggaacccgctgagccgcaacagcacccacgagatgtactgggtgtccaacgccagcggcaacatcgtctccagcgtgaacatgatctcccgcatgctcatcaaccggttcaccatgcgccacaagaaggcgacctacgagcccgacgtggacctggggagcggcacgcggaacatcgggatcgagtccgagacccccaacctggacatcatcggcaagcgcatcgagaagatccggcaggagcacgagaccagctggcactacgaccaggaccacccctacaagacctgggcctaccacggctcctacgagacgaagcagaccgggagcgcctccagcatggtcaacggcgtggtgcgcctcctgaccaagccgtgggacgtcatccccatggtgacccagatggccatgacggacaccacccccttcgggcagcagcgggtgttcaaggagaaggtcgacacccgcacgcaggagcccaaggagggcaccaagaagctgatgaagatcaccgccaagtggctctggaaggagctgggcaagaagaagaccccgcggatgtgcacgcgcgaggagttcacccggaaggtgcgctccaacgcggccctgggggccatcttcaccgacgagaacaagtggaagtccgcccgggaggccgtcgaggactcccgcttctgggagctcgtggacaaggagcggaacctgcacctggagggcaagtgcgagacctgcgtgtacaacatgatggggaagcgcgagaagaagctcggcgagttcgggaaggcgaagggcagccgggccatctggtacatgtggctgggcgcccgcttcctggagttcgaggccctcgggttcctgaacgaggaccactggttctcccgggagaacagcctgtccggcgtcgagggggagggcctccacaagctggggtacatcctgcgcgacgtgagcaagaaggagggcggcgcgatgtacgccgacgacacggccgggtgggacacccggatcaccctcgaggacctgaagaacgaggagatggtgaccaaccacatggagggcgagcacaagaagctggccgaggccatcttcaagctcacgtaccagaacaaggtcgtgcgcgtgcagcgccccacgccccgggggaccgtcatggacatcatcagccgccgggaccagcgcggctccggccaggtgggcacctacggcctgaacacgttcaccaacatgggggcgcagctgatccggcagatggagggcgagggggtgttcaagagcatccagcacctcaccgccaccgaggagatcgccgtccaggactggctggcccgcgtgggccgggagcgcctgtcccggatggccatcagcggcgacgactgcgtggtcaagcccctcgacgaccgcttcgcgtccgccctgacggccctgaacgacatggggaaggtgcggaaggacatccagcagtgggagccgagccgcggctggaacgactggacccaggtgcccttctgctcccaccacttccacgagctcatcatgaaggacgggcgggtcctggtggtgccctgccgcaaccaggacgagctgatcggccgggcccgcatcagccagggggccggctggtccctccgggagaccgcgtgcctgggcaagagctacgcccagatgtggtccctgatgtacttccaccgccgggacctccgcctggccgccaacgccatctgcagcgcggtcccctcccactgggtgccgaccagccgcaccacgtggtccatccacgccaagcacgagtggatgaccaccgaggacatgctgaccgtgtggaaccgggtctggatccaggagaacccctggatggaggacaagacgcccgtggagagctgggaggagatcccctacctcgggaagcgcgaggaccagtggtgcggctccctgatcgggctgaccagccgggccacctgggccaagaacatccagaccgcgatcaaccaggtgcgcagcctcatcggcaacgaggagtacacggactacatgccgtccatgaagcggttccgccgggaggaggaggaggccggggtcctgtggtga

SEQ ID NO: 9000 - RNA, 9876 nt, synthetic construct
  misc_feature 1..9876: note = derived and/or modified CDS sequence (opt1) from DENV-2__LC111438__SS-prME
  source 1..9876: mol_type = other RNA
accgccggcatcatcatcatgatgatccccaccgtgatggccttccacctgaccacccgcaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcaccatcatggcggccatcctggcctacaccatcggcaccacccacttccagcgggtgctgatcttcatcctcctgacggccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgccccacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaaggtggtccagcccgagaacctcgagtacaccatcgtgatcacgccccactccggcgaggagaacgccgtggggaacgacacgggcaagcacgggaaggagatcaaggtcacgccccagagctccatcaccgaggccgagctgaccggctacgggaccgtgaccatggagtgcagcccccgcaccggcctggacttcaacgagatggtgctcctgcagatggagaacaaggcctggctggtccaccggcagtggttcctcgacctgcccctgccctggctcccgggcgcggacacccaggggtccaactggatccagaaggagaccctggtgacgttcaagaacccccacgccaagaagcaggacgtcgtggtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctgggccgcctcatcacggtgaacccgatcgtcaccgagaaggactcccccgtgaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtcttcacctccatcggcaaggcgctgcaccaggtgttcggggccatctacggcgccgccttcagcggcgtgtcctggaccatgaagatcctcatcggggtcgtgatcacctggatcggcatgaacagccgctccacgagcctgtccgtgagcctggtcctggtgggggtggtcaccctctacctgggcgtgatggtgcaggcggactccgggtgcgtcgtgagctggaagaacaaggagctgaagtgcggcagcggcatcttcatcaccgacaacgtgcacacctggacggagcagtacaagttccagcccgagagcccgcccaagctcgccagcgccatccagaaggcccacgaggaggggatctgcggcatccggtccgtcacccgcctggagaacctgatgtggaagcagatcaccccggagctcaaccacatcctgagcgagaacgaggtgaagctgaccatcatgacgggggacatcaagggcatcatgcaggccgggaagcggtccctccgcccccagcccaccgagctgaagtacagctggaaggcgtggggcaaggccaagatgctgtccaccgagctccacaaccacaccttcctgatcgacggcccggagacggccgagtgccccaacaccaaccgggcctggaacagcctggaggtggaggactacgggttcggcgtcttcaccaccaacatctggctcaagctgaaggagaagcaggacgtgttctgcgactccaagctgatgagcgccgcgatcaaggacaaccgcgccgtgcacgccgacatggggtactggatcgagtccgccctcaacgacacgtggaagatcgagaaggccagcttcatcgaggtcaagtcctgccactggcccaagagccacaccctgtggtccaacggcgtgctggagagcgagatgatcatccccaagaacttcgcgggcccggtgtcccagcacaactaccggcccgggtaccacacccagaccgccggcccctggcacctcgggagcctggagatggacttcgacttctgcgagggcaccacggtcgtggtgaccgaggactgcgggaaccgcggccccagcctgcggaccaccacggcctccggcaagctcatcaccgagtggtgctgccgcagctgcaccctgccgcccctgcggtaccgcggggaggacggctgctggtacgggatggagatccggcccctcaaggagaaggaggagaacctggtcaactccctggtgaccgccggccacgggcagatcgacaacttcagcctcggcgtgctgggcatggcgctgttcctcgaggagatgctgcgcacgcgggtcgggaccaagcacgccatcctgctcgtggccgtgtccttcgtcaccctgatcaccggcaacatgagcttccgcgacctggggcgggtgatggtgatggtcggcgccacgatgaccgacgacatcgggatgggcgtgacctacctcgccctgctggcggccttcaagatccgccccaccttcgccgccggcctcctgctgcgcaagctcacgtccaaggagctgatgatgaccaccatcgggatcgtgctgctcagccagtccaccatcccggagacgatcctggagctgaccgacgccctcgcgctgggcatgatggtcctgaagatcgtgcggaacatggagaagtaccagctcgccgtcaccatcatggccatcctgtgcgtgcccaacgccgtgatcctgcagaacgcctggaaggtcagctgcaccacgctcgcggtggtgtccgtcagccccctgctgctcacctccagccagcagaaggccgactggatccccctggccctgaccatcaaggggctcaacccgaccgccatcttcctgacgaccctgtcccgcaccagcaagaagcggtcctggcccctcaacgaggcgatcatggccgtgggcatggtgagcatcctggcctccagcctgctcaagaacgacatccccatgaccggccccctggtcgccgggggcctgctcacggtgtgctacgtgctgaccgggcgcagcgccgacctggagctcgagcgggcggccgacgtccgctgggaggagcaggccgagatctccggcagctccccgatcctgagcatcaccatctccgaggacgggagcatgtccatcaagaacgaggaggaggagcagaccctgacgatcctcatccggaccggcctgctggtgatcagcggcctcttccccgtgtccatccccatcaccgccgccgcgtggtacctgtgggaggtcaagaagcagcgcgccggggtgctgtgggacgtgcccagcccgccgcccgtcggcaaggccgagctcgaggacggggcctaccggatcaagcagaagggcatcctggggtactcccagatcggcgccggcgtgtacaaggaggggaccttccacaccatgtggcacgtgacgcgcggcgcggtcctgatgcacaaggggaagcggatcgagccgagctgggccgacgtgaagaaggacctcatctcctacggcgggggctggaagctggagggcgagtggaaggagggggaggaggtgcaggtcctggccctcgagcccggcaagaacccccgcgccgtgcagaccaagcccgggctgttcaagaccaacaccggcacgatcggggccgtgagcctggacttctccccgggcaccagcggctcccccatcgtcgacaagaaggggaaggtggtgggcctctacgggaacggcgtcgtgacccggagcggcacctacgtgtccgcgatcgcccagacggagaagtccatcgaggacaaccccgagatcgaggacgacatcttccgcaagaagcggctgaccatcatggacctgcaccccggggccggcaagaccaagcgctacctgccggccatcgtccgggaggcgatcaagcgcgggctccggaccctgatcctggcccccacgcgcgtggtggccgccgagatggaggaggccctccggggcctgcccatccgctaccagacccccgcgatccgcgccgagcacaccgggcgggagatcgtcgacctgatgtgccacgccaccttcacgatgcgcctcctgagcccgatccgggtgcccaactacaacctgatcatcatggacgaggcccacttcaccgaccccgccagcatcgcggcccgcggctacatcagcacccgggtggagatgggcgaggccgccgggatcttcatgaccgccacgcccccgggctcccgcgaccccttcccccagagcaacgcgcccatcatggacgaggagcgggagatcccggagcgctcctggaacagcgggcacgagtgggtcaccgacttcaagggcaagaccgtgtggttcgtgccctccatcaaggccgggaacgacatcgccgcctgcctccggaagaacggcaagaaggtcatccagctgagccgcaagaccttcgactccgagtacatcaagacgcggaccaacgactgggacttcgtggtgaccaccgacatcagcgagatgggcgcgaacttcaaggccgagcgcgtcatcgacccccggcgctgcatgaagcccgtgatcctgacggacggggaggagcgggtgatcctcgccggcccgatgcccgtcacccactccagcgccgcccagcgccgggggcgcgtgggccggaaccccaagaacgagaacgaccagtacatctacatgggggagcccctggagaacgacgaggactgcgcgcactggaaggaggccaagatgctgctcgacaacatcaacaccccggagggcatcatcccctccatgttcgagcccgagcgcgagaaggtggacgccatcgacggcgagtaccgcctgcgcggggaggcccgcaagaccttcgtcgacctgatgcggcgcggcgacctcccggtgtggctggcctaccgggtcgcggccgaggggatcaactacgccgaccgccggtggtgcttcgacggcgtgaagaacaaccagatcctggaggagaacgtggaggtcgagatctggacgaaggagggggagcgcaagaagctcaagccccggtggctggacgcccgcatctacagcgaccccctggccctcaaggagttcaaggagttcgcggccggccggaagtccctggccctgaacctcatcaccgagatgggccgcctgcccaccttcatgacccagaaggcccggaacgcgctggacaacctcgccgtgctgcacacggccgaggccgggggccgcgcctacaaccacgcgctgagcgagctcccggagaccctggagaccctgctcctgctgaccctcctggccacggtgaccgggggcatcttcctgttcctcatgtccggcaaggggatcggcaagatgaccatggggatgtgctgcatcatcaccgccagcatcctgctgtggtacgcccagatccagccccactggatcgccgcgtccatcatcctcgagttcttcctgatcgtcctgctcatccccgagcccgagaagcagcggaccccgcaggacaaccagctgacgtacgtggtgatcgccatcctgaccgtcgtggccgccaccatggccaacgagatgggcttcctcgagaagaccaagaaggacttcgggctgggcagcatcgcgacgcagcagcccgagagcaacatcctggacatcgacctccgccccgcctccgcctggaccctgtacgccgtggccaccaccttcatcacgcccatgctgcggcacagcatcgagaactccagcgtcaacgtgtccctcaccgcgatcgccaaccaggccaccgtgctgatgggcctggggaagggctggccgctcagcaagatggacatcggggtccccctgctggccatcggctgctactcccaggtgaaccccatcaccctcatggcggccctgctgctcctggtggcccactacgccatcatcgggcccggcctgcaggccaaggcgacgcgcgaggcccagaagcgggccgccgccggcatcatgaagaacccgaccgtcgacgggatcaccgtgatcgacctcgaccccatcccctacgaccccaagttcgagaagcagctgggccaggtgatgctgctcgtcctgtgcgtgacccaggtgctgatgatgcgcacgacctgggcgctctgcgaggccctgaccctggccaccgggccgatcagcacgctctgggagggcaaccccgggcggttctggaacaccaccatcgccgtctccatggccaacatcttccgcggcagctacctggcgggcgccgggctcctgttctccatcatgaagaacaccgccaacacgcgccggggcaccgggaacaccggcgagaccctgggcgagaagtggaagaaccgcctgaacgccctcgggaagtccgagttccagatctacaagaagtccggcatccaggaggtggaccggacgctggcgaaggaggggatcaagcgcggcgagaccgaccaccacgccgtgagccgggggtccgccaagctgcgctggttcgtcgagcggaacctcgtgacccccgagggcaaggtggtcgacctgggctgcgggcgcggcgggtggagctactactgcggcgggctgaagaacgtgaaggaggtgaagggcctcaccaagggcgggcccggccacgaggagccgatccccatgtccacgtacgggtggaacctggtccggctgcagagcggcgtggacgtgttcttcacgccgcccgagaagtgcgacaccctcctgtgcgacatcggggagtccagcccgaaccccaccgtcgaggccggccgcacgctgcgggtgctcaacctggtggagaactggctgaacaacaacacccagttctgcatcaaggtcctcaacccctacatgccgagcgtgatcgagaagatggaggccctgcagcgcaagtacggcggggcgctggtgcggaaccccctgtcccgcaacagcacccacgagatgtactgggtctccaacgccagcggcaacatcgtgtccagcgtgaacatgatctcccggatgctcatcaaccgcttcaccatgcggcacaagaaggccacctacgagcccgacgtcgacctggggagcggcacgcgcaacatcgggatcgagtccgagacccccaacctggacatcatcggcaagcggatcgagaagatcaagcaggagcacgagaccagctggcactacgaccaggaccacccgtacaagacctgggcctaccacggctcctacgagacgaagcagaccgggagcgcctccagcatggtgaacggcgtggtccgcctcctgaccaagccctgggacgtgatccccatggtgacccagatggcgatgacggacaccacccccttcgggcagcagcgcgtcttcaaggagaaggtggacacccggacgcaggagccgaaggagggcaccaagaagctgatgaagatcaccgccaagtggctctggaaggagctgggcaagaagaagacgccccggatgtgcacgcgggaggagttcacccgcaaggtccggtccaacgccgccctgggggccatcttcaccgacgagaacaagtggaagtccgcgcgcgaggccgtggaggactccggcttctgggagctcgtggacaaggagcggaacctgcacctggaggggaagtgcgagacctgcgtctacaacatgatgggcaagcgcgagaagaagctcggggagttcggcaaggccaagggcagccgggccatctggtacatgtggctgggggcgcgcttcctggagttcgaggccctcggcttcctgaacgaggaccactggttctcccgggagaacagcctgagcggggtggagggcgaggggctccacaagctgggctacatcctgcgcgacgtgtccaagaaggagggcggggccatgtacgccgacgacacggccggctgggacacccggatcaccctcgaggacctgaagaacgaggagatcgtcaccaactacatggagggggagcacaagaagctggcggaggccatcttcaagctcacgtaccagaacaaggtggtgcgcgtccagcggcccacgccccgcggcaccgtgatggacatcatcagccggcgcgaccagcgggggtccggccaggtggtcacctacggcctgaacacgttcaccaacatggaggcccagctgatccgccagatggagggggagggcgtgttcaagagcatccagcacctcaccgtgaccgaggagatcgccgtcgagaactggctggtgcgggtggggcgcgagcgcctgtcccggatggccatcagcggcgacgactgcgtcgtgaagccgctcgacgaccgcttcgcgtccgccctgacggccctgaacgacatgggcaaggtgcggaaggacatccagcagtgggagcccagccgcgggtggaacgactggacccaggtccccttctgctcccaccacttccacgagctcatcatgaaggacggccgggtgctggtggtcccctgccgcaaccaggacgagctgatcgggcgggcccgcatcagccagggcgccgggtggtccctccgggagaccgcgtgcctgggcaagagctacgcccagatgtggtccctgatgtacttccaccgccgggacctccgcctggccgccaacgccatctgcagcgcggtgccgtcccactgggtgcccaccagccggacgacctggtccatccacgccacccacgagtggatgaccaccgaggacatgctgacggtctggaaccgcgtgtggatccaggagaacccctggatggaggacaagacccccgtggagagctgggaggagatcccgtacctcggcaagcgggaggaccagtggtgcgggagcctgatcggcctgacctcccgcgccacctgggccaagaacatccagacggcgatcaaccaggtccggagcctcatcgggaacgaggagtacaccgactacatgccctccatgaagcgcttccggcgcgaggaggaggaggccggcgtgctgtggtga

SEQ ID NO: 9001 - RNA, 9876 nt, synthetic construct
  misc_feature 1..9876: note = derived and/or modified CDS sequence (opt1) from DENV-2__KF744400__SS-prME
  source 1..9876: mol_type = other RNA
accgccggcatgatcatcatgctgatccccaccgtgatggccttccacctcaccacccgcaacggggagccccacatgatcgtcagccggcaggagaagggcaagagcctgctgttcaagaccgagaacggggtgaacatgtgcaccctcatggcgatggacctgggcgagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggagcgtcgccctggtgccccacgtgggcatggggctcgagacccgcaccgagacctggatgagcagcgagggcgcctggaagcacgcccagcggatcgagacgtggatcctgcgccaccccgggttcaccctgatggccgcgatcctcgcctacaccatcggcaccacgcacttccagcgggccctgatcttcatcctgctcaccgccgtcgcgccctccatgaccatgcgctgcatcgggatcagcaaccgggacttcgtggagggcgtgtccggcgggagctgggtcgacatcgtgctggagcacggctcctgcgtgaccacgatggccaagaacaagcccaccctggacttcgagctcatcaagaccgaggccaaggagcccgccaccctgcgcaagtactgcatcgaggccaagctgacgaacaccaccaccgagagccggtgcccgacgcagggggagccctccctcaacgaggagcaggacaagcgcttcgtctgcaagcacagcatggtggaccggggctggggcaacgggtgcggcctgttcgggaagggcgggatcgtgacctgcgcgatgttcacgtgcaagaagaacatggagggcaagatcgtccagcccgagaacctggagtacaccatcgtgatcacgccccactccggcgaggagcacgccgtggggaacgacaccggcaagcacgggaaggagatcaagatcaccccgcagagctccaccaccgaggccgagctcacgggctacgggaccgtcaccatggagtgcagcccccgcaccggcctggacttcaacgagatggtgctgctccagatggagaacaaggcctggctggtgcaccggcagtggttcctggacctccccctgccctggctgccgggcgccgacacgcaggggtccaactggatccagaaggagaccctcgtcaccttcaagaacccccacgcgaagaagcaggacgtggtggtcctgggcagccaggagggggccatgcacaccgccctgacgggcgccaccgacatccagatgagctccgggaacctcctgttcaccggccacctgaagtgccgcctccggatggacaagctgcagctgaagggcatgagctactccatgtgcaccgggaagttcaaggtggtcaaggagatcgccgagacgcagcacggcaccatcgtggtgcgcgtccagtacgagggggacggcagcccctgcaagatccccttcgagatcatggacctcgagaagcggcacgtgctgggccgcctgatcaccgtgaacccgatcgtcaccgagaaggactcccccgtgaacatcgaggcggagccgcccttcggggacagctacgtgatcatcggcgtcgagccggggcagctcaagctgaactggttcaagaagggctccagcatcgggcagatgttcgagacgaccatgcgcggcgccaagcggatggccatcctgggcgacaccgcctgggacttcgggtccctcggcggggtgttcaccagcatcggcaaggccctgcaccaggtgttcggggcgatctacggcgccgccttctccggcgtcagctggacgatgaagatcctgatcggggtgatcatcacctggatcggcatgaactcccgcagcacctccctgagcgtgtccctcgtcctggtgggggtggtcaccctgtacctcggcgtggtggtccaggccgacagcgggtgcgtggtgtcctggaagaacaaggagctgaagtgcggcagcggcatcttcatcacggacaacgtccacacctggaccgagcagtacaagttccagcccgagagcccctccaagctggcgagcgccatccagaaggcccaccaggaggggatctgcggcatccggtccgtgacccgcctcgagaacctgatgtggaagcagatcacgcccgagctgaaccacatcctcagcgagaacgaggtgaagctgaccatcatgaccggggacatcaagggcatcatgcacgccgggaagcggtccctgcgcccgcagcccaccgagctccggtacagctggaagacgtggggcaaggccaagatcctgtccaccgagagccacaaccagaccttcctgatcgacggccccgagaccgcggagtgcccgaacacgaaccgcgcctggaactccctcgaggtcgaggactacgggttcggcgtgttcaccaccaacatctggctgaagctgcgggagaagcaggacgccttctgcgaccccaagctcatgagcgccgccatcaaggacaaccgcgcggtgcacgccgacatggggtactggatcgagtccgccctgaacgacacctggaagatcgagaaggccagcttcatcgaggtcaagaactgccactggcccaagtcccacaccctgtggagcaacggcgtgctcgagtccgagatgatcatccccaagaacttcgccggcccggtgagccagcacaactaccggcccgggtaccacacgcagaccgcgggcccctggcacctggggaagctggagctcgacttcgacttctgcgagggcaccaccgtcgtggtgacggaggactgcgggaaccgcggcccctccctgcggaccaccaccgccagcggcaagctgatcacggagtggtgctgccgcagctgcaccctcccgcccctgcggtacaagggggaggacggctgctggtacgggatggagatccgccccctgaaggagaaggaggagaacctcgtctccagcctggtgaccgccggccacgggcagatcgacaacttctccctgggcgtgctcggcatggccctgttcctggaggagatgctccggacccgcgtcgggatgaagcacgcgatcctgctggtggccgtgagcttcgtcacgctcatcaccggcaacatgtccttccgggacctggggcgcgtgatggtgatggtcggcgccaccatgaccgacgacatcgggatgggcgtgacgtacctggccctcctggccgcgttcaaggtgcgccccaccttcgccgccggcctgctcctgcggaagctgaccagcaaggagctcatgatgaccacgatcgggatcgtcctgctgtcccagagcaccatcccggagaccatcctcgagctgaccgacgccctggccctcggcatgatggtgctgaagatcgtgcgcaagatggagcggtaccagctggcggtcacgatcatggccatcctctgcgtgcccaactccgtcatcctgcagaacgcctggaaggtgagctgcaccatcctggccgtggtctccgtgagccccctcctgctgacctccagccagcagaaggccgactggatccccctcgcgctgaccatcaaggggctgaacccgacggccatcttcctcaccaccctgtcccgcaccagcaagaagcggtcctggcccctgaacgaggccatcatggccgtgggcatggtcagcatcctcgcgtccagcctgctgaagaacgacatccccatgacgggccccctcgtggccgggggcctgctgaccgtgtgctacgtcctcaccgggcgcagcgccgacctggagctggagaaggccgccgacgtgcggtgggaggaccaggcggagatctccggcagctccccgatcctcagcgtgatcgtctccgaggacgggagcatgtccatcaagaacgaggaggaggagcagatcctgaccatcctgatccgcacgggcctcctggtgatcagcggcctgttccccgtgtccatccccatcaccgccgccgcctggtacctctgggaggtcaagaagcagcgggccggggtgctgtgggacgtgcccagcccgccgcccgtcggcaaggcggagctggaggacggggcctaccgcatcaagcagaagggcatcctcgggtactcccagatcggcgccggcgtgtacaaggaggggaccttccacaccatgtggcacgtgacccggggcgccgtcctgatgcacaaggggaagcgcatcgagccgagctgggccgacgtgaagaaggacctgatctcctacggcgggggctggaagctcgagggcgagtggaaggagggggaggaggtgcaggtcctggcgctggagcccggcaagaacccccgggccgtgcagacgaagcccggcctcttcaagaccaacgccggcaccatcggggccgtgagcctggacttctccccgggcaccagcggctcccccatcatcgacaagaaggggaaggtcgtgggcctgtacgggaacggcgtggtcacgcgcaacggcagctacgtgtccgccatcgcgcagaccgagaagtccatcgaggacaaccccgagatcgaggacgacatcttccggaagaagcgcctgaccatcatggacctccaccccggggccggcaagaccaagcggtacctgccggccatcgtgcgcgaggccatcaagcgggggctgcgcacgctcatcctggcgcccacccgggtcgtggccgccgagatggaggaggccctgcgcggcctccccatccgctaccagacccccgccatccgggcggagcacaccgggcgcgagatcgtggacctgatgtgccacgccacgttcaccatgcggctgctcagcccgatccgcgtccccaactacaacctgatcatcatggacgaggcccacttcaccgaccccgcctccatcgccgcgcggggctacatcagcacccgcgtggagatgggcgaggccgccgggatcttcatgacggccacgccgcccggctcccgggaccccttcccccagagcaacgcccccatcatggacgaggagcgcgagatccccgagcggtcctggaacagcgggcacgagtgggtgaccgacttcaagggcaagaccgtctggttcgtgccctccatcaaggcggggaacgacatcgccgcctgcctgcgcaagaacggcaagaaggtgatccagctcagccggaagacgttcgactccgagtacgtcaagacccgcaccaacgactgggacttcgtggtgaccacggacatcagcgagatgggcgccaacttcaaggcggagcgggtcatcgacccccgccggtgcatgaagcccgtgatcctgaccgacggggaggagcgcgtgatcctggccggcccgatgcccgtcacccactccagcgccgcccagcggcgcgggcggatcggccgcaaccccaagaacgagaacgaccagtacatctacatgggggagcccctcgagaacgacgaggactgcgcccactggaaggaggcgaagatgctgctggacaacatcaacaccccggagggcatcatcccctccatgttcgagcccgagcgcgagaaggtggacgccatcgacggcgagtaccggctccgcggggaggcccggaagacgttcgtggacctgatgcgccggggcgacctgccggtctggctcgcctacaaggtggccgcggaggggatcaactacgccgaccgccggtggtgcttcgacggcatccgcaacaaccagatcctggaggagaacgtcgaggtggagatctggaccaaggagggggagcggaagaagctgaagccccgctggctcgacgcccggatctacagcgaccccctggccctgaaggagttcaaggagttcgccgcgggccgcaagtccctcaccctgaacctgatcaccgagatgggccggctccccacgttcatgacccagaaggcccgcgacgccctggacaacctggccgtgctccacaccgcggaggccgggggccgggcctacaaccacgccctgagcgagctgccggagaccctcgagacgctgctgctcctgaccctgctcgccaccgtcaccgggggcatcttcctgttcctgatgtccggccgcgggatcggcaagatgacgctcgggatgtgctgcatcatcaccgcgagcatcctgctgtggtacgcccagatccagccccactggatcgccgcctccatcatcctcgagttcttcctgatcgtgctgctcatccccgagcccgagaagcagcggaccccgcaggacaaccagctgacctacgtggtcatcgccatcctgaccgtggtggcggccacgatggccaacgagatgggcttcctcgagaagaccaagaaggacctggggctgggcagcatcgccacccagcagcccgagagcaacatcctcgacatcgacctgcgccccgcctccgcgtggaccctgtacgccgtcgccacgaccttcatcacccccatgctccggcacagcatcgagaactccagcgtgaacgtgtccctgaccgccatcgccaaccaggcgacggtcctgatgggcctcgggaagggctggccgctgagcaagatggacatcggggtgcccctgctcgccatcggctgctactcccaggtgaaccccatcaccctgaccgccgccctgctcctgctggtcgcgcactacgccatcatcgggcccggcctccaggccaaggccacccgcgaggcccagaagcgggcggccgccggcatcatgaagaacccgacggtggacgggatcaccgccatcgacctggaccccatcccctacgaccccaagttcgagaagcagctgggccaggtgatgctcctggtcctgtgcgtgacccaggtgctcatgatgcgcaccacgtgggccctgtgcgaggcgctgaccctcgccaccgggccgatcagcaccctgtgggagggcaaccccgggcgcttctggaacacgaccatcgccgtctccatggccaacatcttccggggcagctacctggccggcgcggggctcctgttctccatcatgaagaacaccaccaacacgcgccggggcaccgggaacatcggcgagaccctgggcgagaagtggaagtcccgcctcaacgccctggggaagtccgagttccagatctacaagaagtccggcatccaggaggtggaccggaccctggccaaggaggggatcaagcgcggcgagacggaccaccacgccgtgtcccgggggagcgcgaagctccgctggttcgtcgagcggaacatggtgacccccgagggcaaggtggtcgacctgggctgcgggcgcggcgggtggtcctactactgcggcgggctgaagaacgtgcgggaggtgaagggcctcaccaagggcgggcccggccacgaggagccgatccccatgagcacctacgggtggaacctggtccgcctgcagtccggcgtggacgtgttcttcacgccgcccgagaagtgcgacaccctcctgtgcgacatcggggagagcagcccgaaccccaccgtcgaggccggccggaccctgcgcgtgctcaacctggtggagaactggctgaacaacaacacgcagttctgcatcaaggtcctgaacccctacatgccgtccgtgatcgagaagatggaggccctccagcggaagtacggcggggccctggtgcgcaaccccctgagccggaactccacccacgagatgtactgggtcagcaacgcctccggcaacatcgtgagctccgtgaacatgatcagccgcatgctcatcaaccggttcaccatgaagcacaagaaggcgacctacgagcccgacgtcgacctggggtccgggacctgcaacatcgggatcgagagcgaggtgcccaacctggacatcatcggcaagcgcatcgagaagatcaagcaggagcacgagacgtcctggcactacgaccaggaccacccgtacaagacctgggcctaccacggcagctacgaggccaagcagaccgggtccgccagctccatggtgaacggcgtcgtgcgcctcctgaccaagccctgggacgtgatccccatggtcacgcagatggccatgaccgacaccacccccttcgggcagcagcgggtgttcaaggagaaggtggacacgcgcacccaggagccgaaggagggcaccaagaagctgatgaagatcaccgcggagtggctctggaaggagctgggcaagaagaagacgccccggatgtgcacccgcgaggagttcacccggaaggtccgcagcaacgccgccctgggggccatcttcaccgacgagaacaagtggaagtccgcccgggaggcggtggaggacagccgcttctgggagctcgtcgacaaggagcggaacctgcacctggagggcaagtgcgagacgtgcgtgtacaacatgatggggaagcgcgagaagaagctcggcgagttcgggaaggccaagggctcccgggccatctggtacatgtggctgggcgcccgcttcctggagttcgaggcgctcgggttcctgaacgaggaccactggttcagccgggagaacagcctgtccggcgtggagggggagggcctctacaagctggggtacatcctgcgcgacgtcagcaagaaggagggcggcgccatgtacgccgacgacaccgccgggtgggacacccggatcaccctcgaggacctgaagaacgaggagatggtgacgaaccacatggagggcgagcacaagaagctggccgaggcgatcttcaagctcacctaccagaacaaggtggtccgcgtgcagcggcccacgccccgcgggaccgtgatggacatcatctcccggcgcgaccagcggggcagcgggcaggtcggcacgtacggcctgaacaccttcaccaacatggaggcccagctgatccgccagatggagggggagggcatcttcaagtccatccagcacctcaccgccacggaggagatcgccgtgcagaactggctgacccgcgtggggcgggagcgcctgagccggatggccatctccggcgacgactgcgtcgtgaagccgctcgacgaccgcttcgcgagcgccctgaccgccctgaacgacatgggcaaggtgcggaaggacatccagcagtgggagccctcccgcgggtggaacgactggacccaggtccccttctgcagccaccacttccacgagctcatcatgaaggacggccgggtgctggtggtcccctgccgcaaccaggacgagctgatcgggcgggcccgcatctcccagggcgccgggtggagcctccgggagacggcgtgcctgggcaagtcctacgcccagatgtggagcctgatgtacttccaccgccgggacctccgcctggccgccaacgccatctgctccgcggtgccgagccactgggtgcccacctcccggaccacctggagcatccacgccaagcacgagtggatgacgaccgaggacatgctgaccgtctggaaccgcgtgtggatccaggagaacccctggatggaggacaagacccccgtggagagctgggaggagatcccgtacctcggcaagcgggaggaccagtggtgcgggtccctgatcggcctgaccagccgcgccacgtgggccaagaacatccagaccgcgatcaaccaggtccggtccctcatcgggaacgaggagtacaccgactacatgcccagcatgaagcgcttccgccgggaggaggaggaggccggcgtgctgtggtga

SEQ ID NO: 9002 - RNA, 9876 nt, synthetic construct
  misc_feature 1..9876: note = derived and/or modified CDS sequence (opt1) from DENV-2__KF744401__SS-prME
  source 1..9876: mol_type = other RNA
accgccgggatgatcatcatgctgatccccaccgtgatggccttccacctcaccacccgcaacggggagccccacatgatcgtcagccggcaggagaagggcaagagcctgctgttcaagaccgagaacggggtgaacatgtgcaccctcatggcgatggacctgggcgagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggagcgtcgccctggtgccccacgtgggcatggggctcgagacccgcaccgagacctggatgagcagcgagggcgcctggaagcacgcccagcggatcgagacgtggatcctgcgccaccccgggttcaccctgatggccgcgatcctcgcctacaccatcggcaccacgcacttccagcgggccctgatcttcatcctgctcaccgccgtcgcgccctccatgaccatgcgctgcatcgggatcagcaaccgggacttcgtggagggcgtgtccggcgggagctgggtcgacatcgtgctggagcacggctcctgcgtgaccacgatggccaagaacaagcccaccctggacttcgagctcatcaagaccgaggccaaggagcccgccaccctgcgcaagtactgcatcgaggccaagctgacgaacaccaccaccgagagccggtgcccgacgcagggggagccctccctcaacgaggagcaggacaagcgcttcgtctgcaagcacagcatggtggaccggggctggggcaacgggtgcggcctgttcgggaagggcgggatcgtgacctgcgcgatgttcacgtgcaagaagaacatggagggcaagatcgtccagcccgagaacctggagtacaccatcgtgatcacgccccactccggcgaggagcacgccgtggggaacgacaccggcaagcacgggaaggagatcaagatcaccccgcagagctccaccaccgaggccgagctcacgggctacgggaccgtcaccatggagtgcagcccccgcaccggcctggacttcaacgagatggtgctgctccagatggagaacaaggcctggctggtgcaccggcagtggttcctggacctccccctgccctggctgccgggcgccgacacgcaggggtccaactggatccagaaggagaccctcgtcaccttcaagaacccccacgcgaagaagcaggacgtggtggtcctgggcagccaggagggggccatgcacaccgccctgacgggcgccaccgagatccagatgagctccgggaacctcctgttcaccggccacctgaagtgccgcctccggatggacaagctgcagctgaagggcatgagctactccatgtgcaccgggaagttcaaggtggtcaaggagatcgccgagacgcagcacggcaccatcgtggtgcgcgtccagtacgagggggacggcagcccctgcaagatccccttcgagatcatggacctcgagaagcggcacgtgctgggccgcctgatcaccgtgaacccgatcgtcaccgagaaggactcccccgtgaacatcgaggcggagccgcccttcggggacagctacgtgatcatcggcgtcgagccggggcagctcaagctgaactggttcaagaagggctccagcatcgggcagatgttcgagacgaccatgcgcggcgccaagcggatggccatcctgggcgacaccgcctgggacttcgggtccctcggcggggtgttcaccagcatcggcaaggccctgcaccaggtgttcggggcgatctacggcgccgccttctccggcgtcagctggacgatgaagatcctgatcggggtgatcatcacctggatcggcatgaactcccgcagcacctccctgagcgtgtccctcgtcctggtgggggtggtcaccctgtacctcggcgtggtggtccaggccgacagcgggtgcgtggtgtcctggaagaacaaggagctgaagtgcggcagcggcatcttcatcacggacaacgtccacacctggaccgagcagtacaagttccagcccgagagcccctccaagctggcgagcgccatccagaaggcccaccaggaggggatctgcggcatccggtccgtgacccgcctcgagaacctgatgtggaagcagatcacgcccgagctgaaccacatcctcagcgagaacgaggtgaagctgaccatcatgaccggggacatcaagggcatcatgcacgccgggaagcggtccctgcgcccgcagcccaccgagctccggtacagctggaagacgtggggcaaggccaagatcctgtccaccgagagccacaaccagaccttcctgatcgacggccccgagaccgcggagtgcccgaacacgaaccgcgcctggaactccctcgaggtcgaggactacgggttcggcgtgttcaccaccaacatctggctgaagctgcgggagaagcaggacgccttctgcgaccccaagctcatgagcgccgccatcaaggacaaccgcgcggtgcacgccgacatggggtactggatcgagtccgccctgaacgacacctggaagatcgagaaggccagcttcatcgaggtcaagaactgccactggcccaagtcccacaccctgtggagcaacggcgtgctcgagtccgagatgatcatccccaagaacttcgccggcccggtgagccagcacaactaccggcccgggtaccacacgcagaccgcgggcccctggcacctggggaagctggagctcgacttcgacttctgcgagggcaccaccgtcgtggtgacggaggactgcgggaaccgcggcccctccctgcggaccaccaccgccagcggcaagctgatcacggagtggtgctgccgcagctgcaccctcccgcccctgcggtacaagggggaggacggctgctggtacgggatggagatccgccccctgaaggagaaggaggagaacctcgtctccagcctggtgaccgccggccacgggcagatcgacaacttctccctgggcgtgctcggcatggccctgttcctggaggagatgctccggacccgcgtcgggatgaagcacgcgatcctgctggtggccgtgagcttcgtcacgctcatcaccggcaacatgtccttccgggacctggggcgcgtgatggtgatggtcggcgccaccatgaccgacgacatcgggatgggcgtgacgtacctggccctcctggccgcgttcaaggtgcgccccaccttcgccgccggcctgctcctgcggaagctgaccagcaaggagctcatgatgaccacgatcgggatcgtcctgctgtcccagagcaccatcccggagaccatcctcgagctgaccgacgccctggccctcggcatgatggtgctgaagatcgtgcgcaagatggagcggtaccagctggcggtcacgatcatggccatcctctgcgtgcccaactccgtcatcctgcagaacgcctggaaggtgagctgcaccatcctggccgtggtctccgtgagccccctcctgctgacctccagccagcagaaggccgactggatccccctcgcgctgaccatcaaggggctgaacccgacggccatcttcctcaccaccctgtcccgcaccagcaagaagcggtcctggcccctgaacgaggccatcatggccgtgggcatggtcagcatcctcgcgtccagcctgctgaagaacgacatccccatgacgggccccctcgtggccgggggcctgctgaccgtgtgctacgtcctcaccgggcgcagcgccgacctggagctggagaaggccgccgacgtgcggtgggaggaccaggcggagatctccggcagctccccgatcctcagcgtgatcgtctccgaggacgggagcatgtccatcaagaacgaggaggaggagcagaccctgacgatcctgatccgcaccggcctcctggtgatcagcggcctgttccccgtgtccatccccatcaccgccgccgcctggtacctctgggaggtcaagaagcagcgggccggggtgctgtgggacgtgcccagcccgccgcccgtcggcaaggcggagctggaggacggggcctaccgcatcaagcagaagggcatcctcgggtactcccagatcggcgccggcgtgtacaaggaggggaccttccacaccatgtggcacgtgacgcggggcgccgtcctgatgcacaaggggaagcgcatcgagccgagctgggccgacgtgaagaaggacctgatctcctacggcgggggctggaagctcgagggcgagtggaaggagggggaggaggtgcaggtcctggcgctggagcccggcaagaacccccgggccgtgcagaccaagcccggcctcttcaagaccaacgccggcaccatcggggccgtgagcctggacttctccccgggcacgagcggctcccccatcatcgacaagaaggggaaggtcgtgggcctgtacgggaacggcgtggtcacccgcaacggcagctacgtgtccgccatcgcgcagaccgagaagtccatcgaggacaaccccgagatcgaggacgacatcttccggaagaagcgcctgaccatcatggacctccaccccggggccggcaagacgaagcggtacctgccggccatcgtgcgcgaggccatcaagcgggggctgcgcaccctcatcctggcgcccacccgggtcgtggccgccgagatggaggaggccctgcgcggcctccccatccgctaccagacccccgccatccgggcggagcacacggggcgcgagatcgtggacctgatgtgccacgccaccttcaccatgcggctgctcagcccgatccgcgtccccaactacaacctgatcatcatggacgaggcccacttcaccgaccccgcctccatcgccgcgcggggctacatcagcacgcgcgtggagatgggcgaggccgccgggatcttcatgaccgccacgccgcccggctcccgggaccccttcccccagagcaacgcccccatcatggacgaggagcgcgagatccccgagcggtcctggaacagcgggcacgagtgggtgaccgacttcaagggcaagacggtctggttcgtgccctccatcaaggcggggaacgacatcgccgcctgcctgcgcaagaacggcaagaaggtgatccagctcagccggaagaccttcgactccgagtacgtcaagacccgcaccaacgactgggacttcgtggtgacgaccgacatcagcgagatgggcgccaacttcaaggcggagcgggtcatcgacccccgccggtgcatgaagcccgtgatcctgaccgacggggaggagcgcgtgatcctggccggcccgatgcccgtcacccactccagcgccgcccagcggcgcgggcggatcggccgcaaccccaagaacgagaacgaccagtacatctacatgggggagcccctcgagaacgacgaggactgcgcccactggaaggaggcgaagatgctgctggacaacatcaacacgccggagggcatcatcccctccatgttcgagcccgagcgcgagaaggtggacgccatcgacggcgagtaccggctccgcggggaggcccggaagaccttcgtggacctgatgcgccggggcgacctgccggtctggctcgcctacaaggtggccgcggaggggatcaactacgccgaccgccggtggtgcttcgacggcatccgcaacaaccagatcctggaggagaacgtcgaggtggagatctggaccaaggagggggagcggaagaagctgaagccccgctggctcgacgcccggatctacagcgaccccctggccctgaaggagttcaaggagttcgccgcgggccgcaagtccctcaccctgaacctgatcacggagatgggccggctccccaccttcatgacccagaaggcccgcgacgccctggacaacctggccgtgctccacaccgcggaggccgggggccgggcctacaaccacgccctgagcgagctgccggagacgctcgagaccctgctgctcctgaccctgctcgccaccgtcaccggcgggatcttcctgttcctgatgtccgggcgcgggatcggcaagatgaccctcgggatgtgctgcatcatcaccgcgagcatcctgctgtggtacgcccagatccagccccactggatcgccgcctccatcatcctcgagttcttcctgatcgtgctgctcatccccgagcccgagaagcagcggaccccgcaggacaaccagctgacctacgtggtcatcgccatcctgacggtggtggcggccaccatggccaacgagatgggcttcctcgagaagaccaagaaggacctggggctgggcagcatcgccacccagcagcccgagagcaacatcctcgacatcgacctgcgccccgcctccgcgtggacgctgtacgccgtcgccaccaccttcatcacccccatgctccggcacagcatcgagaactccagcgtgaacgtgtccctgacggccatcgccaaccaggcgaccgtcctgatgggcctcgggaagggctggccgctgagcaagatggacatcggggtgcccctgctcgccatcggctgctactcccaggtgaaccccatcaccctgaccgccgccctgctcctgctggtcgcgcactacgccatcatcgggcccggcctccaggccaaggccacgcgcgaggcccagaagcgggcggccgccggcatcatgaagaacccgaccgtggacgggatcaccgccatcgacctggaccccatcccctacgaccccaagttcgagaagcagctgggccaggtgatgctcctggtcctgtgcgtgacccaggtgctcgtcatgcgcacgacctgggccctgtgcgaggcgctgaccctcgccaccgggccgatcagcacgctgtgggagggcaaccccgggcgcttctggaacaccaccatcgccgtgtccatggccaacatcttccggggcagctacctggccggcgcggggctcctgttctccatcatgaagaacaccacgaacacccgccggggcaccgggaacatcggcgagaccctgggcgagaagtggaagtcccgcctcaacgccctggggaagtccgagttccagatctacaagaagtccggcatccaggaggtggaccggacgctggccaaggaggggatcaagcgcggcgagaccgaccaccacgccgtctcccgggggagcgcgaagctccgctggttcgtggagcggaacatggtgacccccgagggcaaggtcgtggacctgggctgcgggcgcggcgggtggtcctactactgcggcgggctgaagaacgtgcgggaggtcaagggcctcaccaagggcgggcccggccacgaggagccgatccccatgagcacgtacgggtggaacctggtgcgcctgcagtccggcgtggacgtcttcttcacgccgcccgagaagtgcgacaccctcctgtgcgacatcggggagagcagcccgaaccccaccgtggaggccggccggacgctgcgcgtgctcaacctggtcgagaactggctgaacaacaacacccagttctgcatcaaggtgctgaacccctacatgccgtccgtgatcgagaagatggaggccctccagcggaagtacggcggggccctggtccgcaaccccctgagccggaactccacccacgagatgtactgggtgagcaacgcctccggcaacatcgtgagctccgtcaacatgatcagccgcatgctcatcaaccggttcaccatgaagcacaagaaggcgacctacgagcccgacgtggacctggggtccggcacgcgcaacatcgggatcgagagcgaggtgcccaacctggacatcatcggcaagcgcatcgagaagatcaagcaggagcacgagacctcctggcactacgaccaggaccacccgtacaagacctgggcctaccacggcagctacgaggccaagcagaccgggtccgccagctccatggtcaacggcgtggtgcggctcctgacgaagccctgggacgtcatccccatggtgacccagatggccatgaccgacaccacgcccttcgggcagcagcgcgtgttcaaggagaaggtcgacacccggacccaggagccgaaggagggcaccaagaagctgatgaagatcacggcggagtggctctggaaggagctgggcaagaagaagacgccccgcatgtgcacccgggaggagttcacccgcaaggtgcggagcaacgccgccctgggggccatcttcacggacgagaacaagtggaagtccgcccgcgaggcggtcgaggacagccggttctgggagctcgtggacaaggagcgcaacctgcacctggagggcaagtgcgagacctgcgtgtacaacatgatggggaagcgggagaagaagctcggcgagttcgggaaggccaagggctcccgcgccatctggtacatgtggctgggcgcccggttcctggagttcgaggcgctcgggttcctgaacgaggaccactggttcagccgcgagaacagcctgtccggcgtcgagggggagggcctctacaagctggggtacatcctgcgggacgtgagcaagaaggagggcggcgccatgtacgccgacgacaccgccgggtgggacacccgcatcacgctcgaggacctgaagaacgaggagatggtgaccaaccacatggagggcgagcacaagaagctggccgaggcgatcttcaagctcacctaccagaacaaggtcgtgcgggtgcagcgccccacgccccgggggacggtcatggacatcatctcccgccgggaccagcgcggcagcggccaggtgggcacctacggcctgaacaccttcaccaacatggaggcccagctgatccgccagatggagggggagggcatcttcaagtccatccagcacctcacggccaccgaggagatcgccgtgcagaactggctgacccgggtcgggcgcgagcggctgagccgcatggccatctccggcgacgactgcgtggtgaagccgctcgacgaccggttcgcgagcgccctgaccgccctgaacgacatgggcaaggtccgcaaggacatccagcagtgggagccctcccgggggtggaacgactggacccaggtgcccttctgcagccaccacttccacgagctcatcatgaaggacggccgcgtgctggtcgtgccctgccggaaccaggacgagctgatcgggcgcgcccggatctcccagggcgccgggtggagcctccgcgagaccgcgtgcctgggcaagtcctacgcccagatgtggagcctgatgtacttccaccggcgcgacctccggctggccgccaacgccatctgctccgcggtgccgagccactgggtccccacctcccgcaccacgtggagcatccacgccaagcacgagtggatgaccaccgaggacatgctgaccgtgtggaaccgggtgtggatccaggagaacccctggatggaggacaagacccccgtcgagagctgggaggagatcccgtacctcggcaagcgcgaggaccagtggtgcgggtccctgatcggcctgacgagccgggccacctgggccaagaacatccagaccgcgatcaaccaggtgcgctccctcatcgggaacgaggagtacaccgactacatgcccagcatgaagcgcttccggcgcgaggaggaggaggccggcgtgctgtggtga

SEQ ID NO: 9003 - RNA, 9876 nt, synthetic construct
  misc_feature 1..9876: note = derived and/or modified CDS sequence (opt1) from DENV-2__KF744402__SS-prME
  source 1..9876: mol_type = other RNA
accgcgggcatgatcatcatgctgatccccaccgtgatggccttccacctcaccacccgcaacggggagccccacatgatcgtgagccggcaggagaagggcaagagcctgctgttcaagaccgaggacggggtgaacatgtgcaccctcatggcgatggacctgggcgagctgtgcgaggacaccatcacctacaagtgccccctcctgcgccagaacgagcccgaggacatcgactgctggtgcaacagcaccagcacctgggtgacctacgggacctgcaccaccaccggcgagcaccggcgcgagaagcggagcgtcgccctggtgccccacgtgggcatggggctcgagacccgcaccgagacctggatgtccagcgagggcgcctggaagcacgcccagcggatcgagacctggatcctgcgccaccccgggttcaccctgatggccgcgatcctcgcctacaccatcggcaccacgaacttccagcgggccctgatcttcatcctgctcaccgccgtcgcgccctccatgaccatgcgctgcatcgggatcagcaaccgggacttcgtggagggcgtgtccggcgggagctgggtcgacatcgtgctggagcacggctcctgcgtgaccacgatggccaagaacaagcccaccctggacttcgagctcatcaagaccgaggccaagcaccccgccaccctgcgcaagtactgcatcgaggccaagctgacgaacaccaccaccgagagccggtgcccgacgcagggggagccctccctcaacgaggagcaggacaagcgcttcgtctgcaagcacagcatggtggaccggggctggggcaacgggtgcggcctgttcgggaagggcgggatcgtgacctgcgcgatgttcacgtgcaagaagaacatggagggcaagatcgtccagcccgagaacctggagtacaccatcgtgatcacgccccactccggcgaggagcacgccgtggggaacgacaccggcaagcacgggaaggagatcaaggtcaccccgcagagctccatcaccgaggccgagctcaccggctacgggacggtgaccatggagtgcagcccccgcaccggcctggacttcaacgagatggtgctgctccagatggagaacaaggcctggctggtccaccggcagtggttcctggacctccccctgccctggctgccgggcgccgacacccaggggtccaactggatccagaaggagacgctcgtgaccttcaagaacccccacgcgaagaagcaggacgtggtcgtgctgggcagccaggagggggccatgcacaccgccctgaccggcgccacggagatccagatgagctccgggaacctcctgttcaccggccacctgaagtgccgcctccggatggacaagctgcagctgaagggcatgagctactccatgtgcaccgggaagttcaaggtcgtgaaggagatcgccgagacccagcacggcacgatcgtggtccgcgtgcagtacgagggggacggcagcccctgcaagatccccttcgagatcatggacctcgagaagcggcacgtgctgggccgcctgatcaccgtcaacccgatcgtgaccgagaaggactcccccgtgaacatcgaggcggagccgcccttcggggacagctacgtcatcatcggcgtggagccggggcagctcaagctgaactggttcaagaagggctccagcatcgggcagatgttcgagaccacgatgcgcggcgccaagcggatggccatcctgggcgacaccgcctgggacttcgggtccctcggcggggtgttcaccagcatcggcaaggccctgcaccaggtcttcggggcgatctacggcgccgccttctccggcgtgagctggaccatgaagatcctgatcggggtgatcatcacgtggatcggcatgaactcccgcagcacctccctgagcgtctccctcatcctggtgggggtggtcaccctgtacctcggcgtggtggtccaggccgacagcgggtgcgtggtgtcctggcggaacaaggagctgaagtgcggcagcggcatcttcatcaccgacaacgtccacacgtggaccgagcagtacaagttccagcccgagagcccctccaagctggcgagcgccatccagaaggcccaccaggaggggatctgcggcatccgctccgtgacccggctcgagaacctgatgtggaagcagatcacccccgagctgaaccacatcctcagcgagaacgaggtgaagctgacgatcatgaccggggacatcaagggcatcatgcacgccgggaagcgctccctgcggccgcagcccaccgagctccgctacagctggaagacctggggccgggccaagatcctgtccacggagagccacaaccagaccttcctgatcgacggccccgagaccgcggagtgcccgaacaccaaccgcgcctggaactccctcgaggtcgaggactacgggttcggcgtgttcacgaccaacatctggctgaagctgaaggagcggcaggacgtgttctgcgacagcaagctcatgtccgccgccatcaaggacaaccgcgccgtccacgcggacatggggtactggatcgagagcgccctgaacgacacctggaagatcgagaaggcctccttcatcgaggtcaagagctgccactggcccaagtcccacaccctgtggagcaacggcgtgctcgagtccgagatgatcatccccaagaacttcgccggccccgtgagccagcacaactaccggccggggtaccacacccagacggccggcccctggcacctggggaagctggagatggacttcgacttctgcgagggcaccaccgtggtggtcaccgaggactgcgggaaccgcggccccagcctccggacgaccaccgcgtccggcaagctgatcaccgagtggtgctgccgcagctgcacgctgcccccgctccggtaccgcggggaggacggctgctggtacgggatggagatccggcccctgaaggagaaggaggagaacctggtgaactccctcgtgaccgccggccacgggcagatcgacaacttcagcctgggcgtcctgggcatggccctcttcctggaggagatgctgcgcacccgcgtggggaccaagcacacgatcctcctggtggccgtctccttcgtgaccctgatcaccggcaacatgagcttccgggacctcgggcgcgtgatggtcatggtgggcgcgaccatgacggacaacatcgggatgggcgtgacctacctggccctgctcgccgccttcaaggtccggcccaccttcgccgcgggcctgctgctccgcaagctgacctccaaggagctgatgatgacgaccatcgggatcgtgctcctgagccagtccaccatccccgagaccatcctggagctcacggacgccctggccctgggcatgatggtgctcaagatcgtccggaacatggagaagtaccagctggccgtgaccatcatggccatcctgtgcgtcccgaacgcggtgatcctccagaacgcctggaaggtgagctgcaccatcctggccgtcgtgtccgtgagccccctgctcctgacctccagccagcagaaggccgactggatccccctggccctcacgatcaaggggctgaaccccaccgcgatcttcctgaccaccctctcccgcacgagcaagaagcggtcctggccgctgaacgaggccatcatggccgtcggcatggtgagcatcctggcctccagcctcctgaagaacgacatccccatcaccggccccctggtggccggcgggctcctgaccgtctgctacgtgctgaccgggcgcagcgccgacctcgagctggagcgggccgccgacgtgcgctgggaggagcaggccgagatctccgggagctcccccatcctgagcatcatcatctccgaggacgggagcatgtccatcaagaacgaggaggaggagcagacgctcaccatcctgatccggaccggcctgctcgtcatcagcggcctgttcccggtgtccatccccatcaccgcggccgcctggtacctgtgggaggtgaagaagcagcgcgccggggtcctctgggacgtgcccagcccgccgcccgtgggcaaggccgagctggaggacggggcgtaccggatcaagcagaagggcatcctggggtactcccagatcggcgccggcgtctacaaggaggggaccttccacacgatgtggcacgtgacccgcggcgccgtgctcatgcacaaggggaagcggatcgagcccagctgggccgacgtcaagaaggacctgatctcctacggcgggggctggaagctggagggcgagtggaaggagggggaggaggtccaggtgctcgccctggagcccggcaagaacccccgcgcggtccagaccaagcccgggctgttcaagaccaacgccggcacgatcggggccgtgagcctcgacttctcccccggcaccagcggctcccccatcatcgacaagaaggggaaggtggtcggcctgtacgggaacggcgtggtgacccggaacggcagctacgtctccgccatcgcccagaccggcaagagcatcgaggacaaccccgagatcgaggacgacatcttccgcaagaagcggctgacgatcatggacctgcaccccggcgcggggaagaccaagcgctacctccccgccatcgtgcgggaggccatcaagcgcggcctgcgcaccctgatcctcgccccgacccgggtggtcgcggccgagatggaggaggccctgcgcgggctgcccatccggtaccagacgcccgccatccgcgccgagcacaccggccgggagatcgtggacctcatgtgccacgcgaccttcaccatgcgcctgctgagccccatccgggtgccgaactacaacctcatcatcatggacgaggcccacttcacggaccccgcctccatcgccgcccgcggctacatcagcacccgggtcgagatgggggaggcggccggcatcttcatgaccgccacgccgcccgggtcccgcgacccgttcccccagagcaacgcccccatcatggacgaggagcgggagatccccgagcgctcctggaacagcggccacgagtgggtgacggacttcaaggggaagaccgtgtggttcgtcccgtccatcaaggccggcaacgacatcgcggcctgcctgcggaagaacggcaagaaggtgatccagctgagccgcaagaccttcgactccgagtacgtgaagacccggacgaacgactgggacttcgtcgtgaccaccgacatcagcgagatgggggccaacttcaaggccgagcgcgtgatcgacccccggcgctgcatgaagcccgtcatcctcaccgacggcgaggagcgggtgatcctggcggggcccatgccggtgacgcactccagcgccgcccagcgccgcggccggatcgggcgcaaccccaagaacgagaacgaccagtacatctacatgggcgagcccctggagaacgacgaggaccacgcccactggaaggaggccaagatgctcctggacaacatcaacacccccgagggcatcatcccgtccatgttcgagcccgagcgggagaaggtcgacgcgatcgacggggagtaccgcctgcggggcgaggcccgcaagaccttcgtggacctcatgcggcgcggggacctgcccgtgtggctggcctacaaggtcgccgccgagggcatcaactacgcggaccggcgctggtgcttcgacgggatccggaacaaccagatcctcgaggagaacgtggaggtcgagatctggaccaaggagggcgagcgcaagaagctgaagccgcggtggctggacgcccgcatctacagcgaccccctcgccctgaaggagttcaaggagttcgccgccggccggaagtccctgacgctcaacctgatcaccgagatggggcgcctgcccaccttcatgacccagaaggcgcgggacgccctcgacaacctggccgtgctgcacacggccgaggcgggcgggcgcgcctacaaccacgccctcagcgagctgcccgagaccctggagaccctcctgctgctcaccctgctggccacggtgaccggcggcatcttcctcttcctgatgtccgggaagggcatcgggaagatgaccctgggcatgtgctgcatcatcaccgccagcgtcctcctgtggtacgcgcagatccagccgcactggatcgccgcctccatcatcctggagttcttcctcatcgtgctgctgatccccgagcccgagaagcagcggacgccccaggacaaccagctcacgtacgtggtcatcgccatcctgaccgtggtggccgcgaccatggccaacgagatggggttcctggagaagaccaagaaggacttcggcctcggcagcatcgccacgcagcagccggagagcaacatcctggacatcgacctgcgccccgcctccgcctggaccctctacgcggtcgccaccaccttcatcacgcccatgctgcggcacagcatcgagaactccagcgtgaacgtgtccctgaccgccatcgccaaccaggccaccgtcctcatggggctgggcaaggggtggcccctgagcaagatggacatcggcgtgccgctcctggcgatcgggtgctactcccaggtgaaccccatcaccctgacggccgccctcctgctgctcgtcgcccactacgcgatcatcggccccggcctgcaggccaaggccacccgcgaggcccagaagcgcgccgcggccgggatcatgaagaaccccaccgtggacggcatcaccgtgatcgacctggacccgatcccctacgaccccaagttcgagaagcagctcgggcaggtcatgctgctggtgctctgcgtgacgcaggtcctgatgatgcggaccacctgggccctgtgcgaggccctcaccctggccacgggccccatcagcaccctgtgggaggggaacccgggccgcttctggaacaccaccatcgcggtgtccatggccaacatcttccggggcagctacctcgccggggccggcctgctgttctccatcatgaagaacacgaccaacacccgccgggggaccggcaacatcggcgagacgctcggggagaagtggaagtcccgcctgaacgccctgggcaagtccgagttccagatctacaagaagtccgggatccaggaggtggaccggaccctcgcgaaggagggcatcaagcgcggggagaccgaccaccacgccgtctcccggggcagcgccaagctgcgctggttcgtggagcggaacatggtgacccccgagggcaaggtcgtggacctggggtgcggccgcgggggctggtcctactactgcgggggcctcaagaacgtgcgggaggtcaagggcctgacgaagggcgggcccgggcacgaggagcccatcccgatgagcacctacggctggaacctggtgcgcctccagtccggggtggacgtcttcttcacgccgcccgagaagtgcgacaccctgctgtgcgacatcggcgagagcagccccaacccgacggtggaggccggccggaccctccgcgtgctgaacctggtcgagaactggctcaacaacaacacccagttctgcatcaaggtgctgaacccctacatgccctccgtgatcgagaagatggaggcgctgcagcggaagtacgggggcgccctggtccgcaacccgctcagccggaactccacccacgagatgtactgggtgagcaacgcctccgggaacatcgtgagctccgtcaacatgatcagccgcatgctgatcaaccgcttcaccatgcggcacaagaaggccacgtacgagcccgacgtggacctgggctccgggacccgcaacatcggcatcgagagcgaggtgcccaacctcgacatcatcggcaagcggatcgagaagatcaagcaggagcacgagacctcctggcactacgaccaggaccacccctacaagacctgggcctaccacgggagctacgagacgaagcagaccggctccgcgagctccatggtcaacggggtggtgcgcctgctgaccaagccgtgggacgtcatccccatggtgacccagatggccatgacggacaccacccccttcggccagcagcgggtgttcaaggagaaggtcgacacccgcacgcaggagcccaaggagggcaccaagaagctcatgaagatcaccgccgagtggctgtggaaggagctggggaagaagaagaccccgcggatgtgcacgcgcgaggagttcacccggaaggtgcgcagcaacgccgccctcggcgcgatcttcaccgacgagaacaagtggaagtccgcccgggaggccgtcgaggacagccgcttctgggagctggtggacaaggagcggaacctgcacctcgaggggaagtgcgagacctgcgtgtacaacatgatgggcaagcgcgagaagaagctgggggagttcggcaaggccaagggctcccgggccatctggtacatgtggctgggggcgcgcttcctcgagttcgaggccctgggcttcctgaacgaggaccactggttcagccgggagaacagcctctccggggtcgagggcgaggggctgcacaagctgggctacatcctccgcgacgtgagcaagaaggagggcggggccatgtacgccgacgacacggcgggctgggacacccggatcaccctggaggacctgaagaacgaggagatggtgaccaaccacatggagggggagcacaagaagctcgccgaggccatcttcaagctgacgtaccagaacaaggtcgtgcgcgtgcagcggcccacgccccgcggcaccgtcatggacatcatctcccgccgggaccagcgcgggagcggccaggtgggcacctacgggctgaacacgttcaccaacatggaggcccagctcatccggcagatggagggcgagggggtgttcaagtccatccagcacctgaccgccaccgaggagatcgcggtccagaactggctggcccgcgtgggccgggagcgcctcagccggatggccatctccggcgacgactgcgtggtcaagcccctggacgaccgcttcgccagcgccctgacggcgctcaacgacatggggaaggtgcggaaggacatccagcagtgggagccgtcccgcggctggaacgactggacccaggtgcccttctgcagccaccacttccacgagctgatcatgaaggacgggcgggtcctggtggtgccctgccgcaaccaggacgagctcatcggccgggcccgcatctcccagggggccggctggagcctgcgggagaccgcctgcctgggcaagtcctacgcccagatgtggagcctcatgtacttccaccgccgggacctgcgcctggcggccaacgccatctgctccgccgtccccagccactgggtgccgacctcccggacgacctggagcatccacgccaagcacgagtggatgaccaccgaggacatgctcaccgtgtggaaccgcgtctggatccaggagaacccctggatggaggacaagacgcccgtggagagctgggaggagatcccctacctggggaagcgcgaggaccagtggtgcggctccctgatcgggctcaccagccgggcgacctgggccaagaacatccagaccgccatcaaccaggtgcgctccctgatcggcaacgaggagtacacggactacatgccgagcatgaagcggttccgccgggaggaggaggaggccggggtcctgtggtga

SEQ ID NO: 9004 - RNA, 9876 nt, synthetic construct
  misc_feature 1..9876: note = derived and/or modified CDS sequence (opt1) from DENV-2__KF744408__SS-prME
  source 1..9876: mol_type = other RNA
accgcgggcatgatcatcatgctgatccccaccgtgatggccttccacctcaccacccggaacggggagccccacatgatcgtcagccggcaggagaagggcaagtccctgctgttcaagaccgaggacggggtgaacatgtgcaccctcatggcgatggacctgggcgagctgtgcgaggacaccatcacctacaagtgccccctcctgcggcagaacgagcccgaggacatcgactgctggtgcaacagcacctccacctgggtgacctacgggacctgcaccaccaccggcgagcaccggcgcgagaagcggagcgtcgccctggtgccccacgtgggcatggggctcgagacccggaccgagacctggatgtccagcgagggcgcctggaagcacgcccagcggatcgagacgtggatcctgcgccaccccgggttcaccctgatggccgcgatcctcgcctacaccatcggcaccacgaacttccagcgggccctgatcttcatcctgctcaccgccgtcgcgccctccatgaccatgcgctgcatcgggatcagcaaccgggacttcgtggagggcgtgtccggcgggagctgggtcgacatcgtgctggagcacggctcctgcgtgaccacgatggccaagaacaagcccaccctggacttcgagctcatcaagaccgaggccaagcaccccgccaccctgcgcaagtactgcatcgaggccaagctgacgaacaccaccaccgcgagccggtgcccgacgcagggggagccctccctcaacgaggagcaggacaagcgcttcgtctgcaagcacagcatggtggaccggggctggggcaacgggtgcggcctgttcgggaagggcgggatcgtgacctgcgccatgttcacgtgcaagaagaacatggagggcaagatcgtccagcccgagaacctggagtacaccatcgtgatcacgccccactccggcgaggagcacgccgtggggaacgacaccggcaagcacgggaaggagatcaagatcaccccgcagagctccatcaccgaggccgagctcaccggctacgggacggtcaccatggagtgcagcccccgcaccggcctgggcttcaacgagatggtgctgctccagatggaggacaaggcctggctggtgcaccggcagtggttcctggacctccccctgccctggctgccgggggcggacacccagggctccaactggatccagaaggagacgctcgtcaccttcaagaacccccacgccaagaagcaggacgtggtggtcctggggagccaggagggcgccatgcacaccgccctgaccggggccacggagatccagatgagctccggcaacctcctgttcaccggccacctgaagtgccgcctccggatggacaagctgcagctgaaggggatgagctactccatgtgcaccggcaagttcaaggtggtcaaggagatcgcggagacccagcacgggacgatcgtggtgcgcgtccagtacgagggcgacggcagcccctgcaagatccccttcgagatcatggacctcgagaagcggcacgtgctggggcgcctgatcaccgtgaacccgatcgtcaccgagaaggactcccccgtgaacatcgaggccgagccgcccttcggcgacagctacgtgatcatcggggtcgagccgggccagctcaagctgtcctggttcaagaaggggagctccatcggccagatgttcgagaccacgatgcgcggcgccaagcggatggccatcctgggggacaccgcctgggacttcggcagcctcgggggcgtgttcacctccatcgggaaggcgctgcaccaggtgttcggcgccatctacggcgccgccttcagcggggtctcctggaccatgaagatcctgatcggcgtgatcatcacgtggatcgggatgaacagccgctccaccagcctgtccgtgagcctcgtcctggtgggcgtggtcaccctgtacctcggggtggtggtccaggcggactccggctgcgtggtgagctggcggaacaaggagctgaagtgcggcagcgggatcttcatcaccgacaacgtccacacgtggaccgagcagtacaagttccagcccgagtcccccagcaagctggcctccgccatccagaaggcccaccaggagggcatctgcgggatccgcagcgtgacccggctcgagaacctgatgtggaagcagatcacccccgagctgaaccacatcctctccgagaacgaggtgaagctgacgatcatgaccggcgacatcaaggggatcatgcaggccggcaagcgcagcctgcggccgcagcccaccgagctccgctactcctggaagacctggggcaaggcgaagatcctgagcacggagtcccacaaccagaccttcctgatcgacgggcccgagaccgccgagtgcccgaacaccaaccgggcctggaacagcctcgaggtcgaggactacggcttcggggtgttcacgaccaacatctggctgcgcctgcgggagaagcaggacgccttctgcgactccaagctcatgagcgccgcgatcaaggacaaccgcgccgtgcacgccgacatgggctactggatcgagtccgccctgaacgacacctggaagatcgagaaggccagcttcatcgaggtcaagtcctgccactggcccaagagccacaccctgtggtccaacggcgtgctcgagagcgagatgatcatccccaagaacttcgcggggcccgtgagccagcacaactaccggccgggctaccacacccagacggccgggccctggcacctgggcaagctggagatggacttcgacttctgcaaggggaccaccgtcgtggtgaccgaggactgcggcaaccgcggcccctccctccggacgaccaccgccagcgggaagctgatcaccgagtggtgctgccgctcctgcacgctgcccccgctccggtaccgcggcgaggacgggtgctggtacggcatggagatccggcccctgaaggagaaggaggagaacctggtcaacagcctcgtgaccgccgggcacggccagatcgacaacttctccctgggcgtgctggggatggccctgttcctggaggagatgctgcgcacccgcgtcggcaccaagcacgccatcctcctggtggccgtgagcttcgtcacgctgatcaccgggaacatgtccttccgggacctcggccgcgtgatggtgatggtcggggccaccatgaccgacgacatcggcatgggcgtgacgtacctggccctgctcgcggccttcaaggtgcggcccaccttcgccgccgggctgctgctccgcaagctgaccagcaaggagctgatgatgaccacgatcggcatcgtcctcctgtcccagagcaccatccccgagaccatcctggagctcaccgacgccctggcgctggggatgatggtgctcaagatcgtgcggaacatggagaagtaccagctggccgtcacgatcatggccatcctgtgcgtgccgaacgccgtcatcctccagaacgcctggaaggtgtcctgcaccatcctggcggtggtcagcgtgagccccctgctcctgaccagctcccagcagaaggccgactggatccccctggccctcaccatcaagggcctgaaccccacggccatcttcctgaccaccctcagccgcacctccaagaagcggagctggccgctgaacgaggcgatcatggccgtgggcatggtctccatcctggccagcagcctcctgaagaacgacatccccatgacggggcccctggtggccggcgggctcctgaccgtgtgctacgtcctgaccggccgctccgccgacctcgagctggagaaggcggccgacgtgcggtgggaggaccaggccgagatcagcgggtccagccccatcctgtccatcatcatcagcgaggacggctccatgagcatcaagaacgaggaggaggagcagaccctcacgatcctgatccgcaccggcctgctcgtgatctccgggctgttcccggtcagcatccccatcaccgccgccgcgtggtacctgtgggaggtgaagaagcagcgggccggcgtgctctgggacgtccccagcccgccgcccgtggggaaggccgagctggaggacggcgcctaccgcatcaagcagaaggggatcctgggctacagccagatcggcgccggggtgtacaaggagggcaccttccacaccatgtggcacgtcacgcgcggggcggtgctcatgcacaagggcaagcgcatcgagccctcctgggccgacgtgaagaaggacctgatcagctacgggggcggctggaagctggagggggagtggaaggagggcgaggaggtccaggtgctcgccctggagcccgggaagaacccccgggccgtgcagaccaagcccggcctgttcaagaccaacgccgggaccatcggcgcggtctccctcgacttcagccccggcacgtccgggagccccatcatcgacaagaagggcaaggtggtggggctgtacggcaacggcgtcgtgacccgcaacgggtcctacgtgagcgccatcgcccagaccgagaagtccatcgaggacaaccccgagatcgaggacgacatcttccggaagaagcgcctgaccatcatggacctgcaccccggcgccgggaagacgaagcggtacctccccgcgatcgtccgcgaggccatcaagcggggcctgcgcaccctgatcctcgccccgacccgcgtggtggccgccgagatggaggaggcgctgcgggggctgcccatccgctaccagacccccgccatccgggccgagcacacgggccgcgagatcgtcgacctcatgtgccacgccaccttcaccatgcggctgctgtcccccatccgcgtgccgaactacaacctcatcatcatggacgaggcccacttcaccgaccccgcgagcatcgccgcccggggctacatctccacgcgcgtggagatgggggaggccgccggcatcttcatgaccgcgacgccgcccgggagccgggacccgttcccccagtccaacgcccccatcatggacgaggagcgcgagatccccgagcggagctggaactccggccacgagtgggtcaccgacttcaaggggaagacggtgtggttcgtgccgagcatcaaggccggcaacgacatcgccgcgtgcctgcgcaagaacggcaagaaggtcatccagctgtcccggaagaccttcgacagcgagtacgtgaagacccgcaccaacgactgggacttcgtggtcacgaccgacatctccgagatgggggccaacttcaaggccgagcgggtgatcgacccccgccggtgcatgaagcccgtgatcctcaccgacggcgaggagcgcgtcatcctggccgggcccatgccggtgacccacagctccgccgcgcagcggcgcggccgcatcgggcggaaccccaagaacgagaacgaccagtacatctacatgggcgagcccctggagaacgacgaggactgcgcccactggaaggaggccaagatgctcctggacaacatcaacacgcccgagggcatcatcccgagcatgttcgagcccgagcgcgagaaggtggacgccatcgacggggagtaccggctgcgcggcgaggcccggaagaccttcgtcgacctcatgcgccgcggggacctgcccgtgtggctggcgtacaaggtggccgccgagggcatcaactacgccgaccgccggtggtgcttcgacgggatccgcaacaaccagatcctcgaggagaacgtcgaggtggagatctggaccaaggagggcgagcggaagaagctgaagccgcgctggctggacgcccggatctactccgaccccctcgcgctgaaggagttcaaggagttcgccgccggccgcaagagcctgaccctcaacctgatcacggagatggggcggctgcccaccttcatgacccagaaggcccgcaacgcgctcgacaacctggccgtcctgcacaccgccgaggccggcgggcgggcctacaaccacgcgctctccgagctgcccgagacgctggagaccctcctgctgctcaccctgctggccaccgtgacgggcggcatcttcctcttcctgatgagcgggaagggcatcgggaagatgaccctgggcatgtgctgcatcatcaccgcctccgtgctcctgtggtacgcccagatccagccgcactggatcgccgcgagcatcatcctggagttcttcctcatcgtcctgctgatccccgagcccgagaagcagcgcacgccccaggacaaccagctcacctacgtggtgatcgccatcctgacggtcgtggccgccaccatggccaacgagatggggttcctggagaagaccaagaaggacctcggcctgggcagcatcaccacgcagcagccggagtccaacatcctggacatcgacctccggcccgcgagcgcctggaccctgtacgccgtggccaccaccttcatcacgcccatgctgcgccactccatcgagaacagctccgtcaacgtgagcctcaccgccatcgcgaaccaggccaccgtgctgatggggctgggcaaggggtggcccctctccaagatggacatcggcgtcccgctgctggccatcgggtgctacagccaggtgaaccccatcaccctcacggccgcgctgctgctcctggtggcccactacgccatcatcggccccggcctgcaggccaaggccacccgggaggcgcagaagcgcgccgccgccgggatcatgaagaaccccaccgtcgacggcatcaccgtgatcgacctcgacccgatcccctacgaccccaagttcgagaagcagctgggccaggtgatgctgctcgtcctgtgcgtgacccaggtgctgatgatgcgcaccacctgggccctctgcgaggcgctgaccctggccacgggccccatctccaccctctgggaggggaacccgggccggttctggaacaccaccatcgccgtcagcatggccaacatcttccgcggctcctacctggccggggcgggcctcctcttcagcatcatgaagaacacgaccaacacccggcgcgggaccggcaacatcggcgagacgctgggggagaagtggaagtcccggctgaacgccctcggcaagagcgagttccagatctacaagaagtccgggatccaggaggtggaccgcaccctggccaaggagggcatcaagcgcggggagaccgaccaccacgccgtgagccgcggctccgcgaagctgcggtggttcgtcgagcgcaacatgatcacccccgagggcaaggtggtggacctcgggtgcggccgcggcgggtggagctactactgcggcgggctgaagaacgtccgcgaggtgaaggggctgacgaagggcgggcccgggcacgaggagcccatcccgatgtccacctacggctggaacctcgtgcggctgcagagcggggtcgacgtgttcttcacgccgcccgagaagtgcgacaccctgctctgcgacatcggcgagagctcccccaacccgacggtggaggccggccgcaccctgcgggtcctgaacctcgtggagaactggctgaacaacaacacccagttctgcatcaaggtgctgaacccctacatgcccagcgtcatcgagaagatggaggccctgcagcgcaagtacgggggcgccctcgtgcggaacccgctgtcccgcaacagcacccacgagatgtactgggtgtccaacgccagcgggaacatcgtctccagcgtgaacatgatctcccggatgctgatcaaccgcttcaccatgaagcacaagaaggcgacgtacgagcccgacgtggacctcggcagcgggacccgcaacatcggcatcgagtccgaggtccccaacctggacatcatcggcaagcggatcgagaagatcaagcaggagcacgagaccagctggcactacgaccaggaccacccctacaagacctgggcctaccacgggtcctacgagacgaagcagaccggcagcgcctccagcatggtgaacggggtggtccgcctgctcaccaagccgtgggacgtgatccccatggtgacccagatggccatgacggacaccacccccttcggccagcagcgggtcttcaaggagaaggtggacacccgcacgcaggagcccaaggagggcaccaagaagctgatgaagatcaccgccgagtggctgtggaaggagctcgggaagaagaagaccccgcggatgtgcacgcgcgaggagttcacccggaaggtgcgctccaacgcggccctgggcgccatcttcaccgacgagaacaagtggaagtccgcccgggaggccgtcgaggactcccgcttctgggagctggtggacaaggagcggaacctccacctggaggggaagtgcgagacctgcgtctacaacatgatgggcaagcgcgagaagaagctgggggagttcggcaaggcgaagggcagccgggccatctggtacatgtggctcggggcccgcttcctggagttcgaggccctgggcttcctcaacgaggaccactggttcagccgggagaactccctgagcggggtggagggcgaggggctgcacaagctcggctacatcctgcgcgacgtgtccaagaaggagggcggggcgatgtacgccgacgacacggccggctgggacacccggatcaccctggaggacctcaagaacgaggagatggtcaccaaccacatggagggggagcacaagaagctggccgaggccatcttcaagctgacgtaccagaacaaggtggtgcgcgtccagcggcccacgccccggggcaccgtgatggacatcatcagccggcgcgaccagcgcgggtccggccaggtgggcacctacgggctcaacacgttcaccaacatggaggcgcagctgatccggcagatggagggcgagggggtcttcaagagcatccagcacctgaccgccaccgaggagatcgccgtgcagaactggctcgcccgcgtgggccgggagcgcctgtcccggatggccatcagcggcgacgactgcgtcgtgaagcccctggacgaccgcttcgcgtccgccctcacggccctgaacgacatggggaaggtgcggaaggacatccagcagtgggagccgagcaagggctggaacgactggacccaggtccccttctgctcccaccacttccacgagctgatcatgaaggacgggcgcgtgctcgtggtcccctgccggaaccaggacgagctgatcggccgcgcccggatcagccagggggccggctggtccctgcgcgagaccgcgtgcctcggcaagagctacgcccagatgtggtccctgatgtacttccaccggcgcgacctgcggctcgccgccaacgccatctgcagcgcggtgccctcccactgggtgccgaccagccgcacgacctggagcatccacgccaagcacgagtggatgaccaccgaggacatgctgaccgtctggaaccgggtgtggatccaggagaacccctggatggaggacaagacgcccgtggagtcctgggaggagatcccctacctggggaagcgcgaggaccagtggtgcggcagcctcatcgggctgacctcccgggccacctgggccaagaacatccagaccgcgatcaaccaggtccgcagcctgatcggcaacgaggagtacacggactacatgccgtccatgaagcgcttccggcgcgaggaggaggaggccggggtgctctggtga

SEQ ID NO: 9005 - RNA, 9876 nt, synthetic construct
  misc_feature 1..9876: note = derived and/or modified CDS sequence (opt1) from DENV-2__JX669476__SS-prME
  source 1..9876: mol_type = other RNA
accgccggcgtgatcgtcatgctgatccccaccgccatggcgttccacctcaccacccgcaacggggagccccacatgatcgtgggccggcaggagaagggcaagagcctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccaccccggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccaccatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagagcgagaacctggagtacaccatcgtgatcacgccccactccggggaggagcacgccgtcggcaacgacaccgggaagcacggcaaggagatcaagatcacgccccagagctccaccaccgaggccgagctgacggggtacggcaccgtgaccatggagtgcagcccgcgcaccggcctcgacttcaacgagatggtgctgctgcagatggaggacaaggcctggctcgtccaccggcagtggttcctggacctgcccctcccctggctgcccggggccgacacgcagggctccaactggatccagaaggagaccctggtgaccttcaagaacccgcacgcgaagaagcaggacgtggtcgtgctcgggagccaggagggcgccatgcacaccgccctgacgggggccaccgagatccagatgagctccggcaacctcctgttcaccggccacctgaagtgccgcctgcggatggacaagctccagctgaaggggatgagctactccatgtgcaccggcaagttcaagatcgtcaaggagatcgccgagacgcagcacgggaccatcgtgatccgcgtgcagtacgagggcgacggcagcccctgcaagatccccttcgagatcaccgacctggagaagcggcacgtcctcgggcgcctgatcaccgtgaaccccatcgtgacggagaaggactccccggtcaacatcgaggcggagccgcccttcggcgacagctacatcatcgtgggggtggagcccggccagctgaagctcaactggttcaagaaggggtccagcatcggccagatgttcgagaccaccatgcgcggcgccaagcggatggccatcctgggggacaccgcctgggacttcggctccctcggcggggtcttcacgagcatcgggaaggccctccaccaggtgttcggggcgatctacggcgccgccttctccggggtgagctggaccatgaagatcctgatcggcgtcatcatcacctggatcgggatgaactcccgcagcacctccctgagcgtgtccctggtgctcgtcggcgtggtgacgctgtacctgggggccatggtccaggcggacagcggctgcatcgtgtcctggaagaacaaggagctcaagtgcggcagcgggatcttcatcaccgacaacgtgcacacctggaccgagcagtacaagttccagccggagttccccagcaagctggcctccgccatccagaaggcccacgaggagggcatctgcgggatccggagcgtcacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccccagccgacggagctgaagtactcctggaagacctggggcaaggcgaagatgctcagcaccgagtcccacaaccagaccttcctgatcgacgggcccgagacggccgagtgccccaacaccaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaaggtcgagaaggccagcttcatcgaggtgaagtcctgccactggcccaagagccacacgctgtggtccaacggcgtgctggagagcgagatgatcatccccaagaacttcgccgggcccgtctcccagcacaactaccgccccggctaccacacccagaccgcggggccgtggcacctcggcaagctggagatggacttcgacttctgcgaggggaccacggtggtggtcaccgaggactgcggcaaccggggccccagcctgcgcaccaccacggccagcgggaagctcatcaccgagtggtgctgccggtcctgcaccctgccgcccctgcgctaccggggcgaggacgggtgctggtacggcatggagatccgcccgctcaaggagaaggaggagaacctggtgaacagcctggtgaccgccgggcacggccagatcgacaacttctccctcggcgtcctggggatggccctgttcctcgaggagatgctgcggacgcgcgtgggcaccaagcacgcgatcctgctcgtggccctgagcttcgtcaccctgatcaccgggaacatgtccttccgggacctcggccgcgtgatggtgatggtcggggccacgatgaccgacgacatcggcatgggcgtgacctacctggccctgctcgccgcgttcaaggtgcgccccaccttcgccgccgggctgctgctccggaagctgacgagcaaggagctgatgatggccaccatcggcatcgccctcctgtcccagagcaccctgcccgagaccatcctcgagctgacggacgcgctggccctcgggatgatggccctgaagatcgtccgcaacatggagaagtaccagctggccgtgaccatcatggccatctcctgcgtgcccaacgcggtcatcctccagaacgcctggaaggtgagctgcaccatcctggccgccgtgtccgtcagcccgctgctcctgacctccagccagcagaagacggactggatccccctggcgctcaccatcaagggcctgaaccccaccgccatcttcctgaccacgctctcccggaccagcaagaagcgctcctggcccctgaacgaggccatcatggccgtgggcatggtcagcatcctggcctccagcctcctgaagaacgacatcccgatgaccgggcccctggtggcgggcgggctcctgaccgtgtgctacgtcctgacgggccggagcgccgacctcgagctggagcgcgccgccgacgtgaagtgggaggaccaggccgagatctccgggagctcccccatcctgagcatcaccatctccgaggacggcagcatgtccatcaagaacgaggaggaggagcagaccctcaccatcctgatccggaccggcctgctcgtgatcagcggggtcttccccgtgtccatcccgatcacggcggccgcctggtacctgtgggaggtgaagaagcagcgcgccggcgtcctgtgggacgtgccctccccgccgcccgtggagaaggccgagctcgaggacggggcgtaccggatcaagcagcgcggcatcctggggtactcccagatcggcgccggcgtctacaaggaggggaccttccacaccatgtggcacgtgacccggggcgccgtgctgatgcaccgcgggaagcggatcgagcccagctgggccgacgtcaagaaggacctcatctcctacggcgggggctggaagctggagggcgagtggaaggagggggaggaggtccaggtgctggccctcgagcccggcaagaacccgcgcgcggtccagacgaagcccgggatcttcaagaccaacaccggcaccatcggggccgtgagcctggacttctcccccggcacgagcggctcccccatcgtggaccggaaggggaaggtcgtgggcctgtacgggaacggcgtggtcacccgcagcggcgcctacgtgtccgccatcgcgcagaccgagaagtccatcgaggacaacccggagatcgaggacgacatcttccggaagaagcgcctcaccatcatggacctgcaccccggggccggcaagacgaagcggtacctgcccgccatcgtgcgcgaggccatcaagcgggggctgcgcaccctcatcctggcccccacccgcgtcgtggcggccgagatggaggaggccctgcggggcctcccgatccgctaccagacccccgccatccgggccgagcacacggggcgcgagatcgtggacctgatgtgccacgcgaccttcaccatgcggctgctcagccccgtccgcgtgcccaactacaacctgatcatcatggacgaggcccacttcaccgacccggcctccatcgccgcccggggctacatcagcacgcgcgtggagatgggcgaggcggccgggatcttcatgaccgccacgccgcccggctcccgggaccccttcccgcagagcaacgcccccatcatggacgaggagcgcgagatccccgagcggtcctggaacagcgggcacgagtgggtcaccgacttcaagggcaagacggtgtggttcgtgccctccatcaaggcggggaacgacatcgccgcctgcctgcgcaagaacggcaagaaggtcatccagctcagccggaagaccttcgactccgagtacgtgaagacccgcgccaacgactgggacttcgtggtcaccacggacatcagcgagatgggcgccaacttcaaggcggagcgggtgatcgacccgcgccggtgcatgaagcccgtgatcctgaccgacggggaggagcgcgtcatcctggccggccccatgcccgtgacccactccagcgccgcccagcggcgcgggcgcatcggccggaacccgaagaacgagaacgaccagtacatctacatgggggagcccctcgagaacgacgaggactgcgcccactggaaggaggcgaagatgctgctggacaacatcaacacccccgagggcatcatcccctccatgttcgagccggagcgcgagaaggtggacgccatcgacggcgagtaccggctccgcggggaggcccggaagacgttcgtcgacctgatgcgccggggcgacctgcccgtgtggctcgcctacaaggtggccgcggaggggatcaactacgccgaccgcaagtggtgcttcgacggcatcaagaacaaccagatcctggaggagaacgtcgaggtggagatctggaccaaggagggggagcggaagaagctgaagccccgctggctcgacgcccggatctacagcgacccgctggccctgaaggagttcaaggagttcgcggccggccgcaagtccctcaccctgaacctgatcaccgagatgggccggctccccacgttcatgacccagaaggcccgcaacgccctggacaacctggccgtgctccacaccgcggaggtcgggggccgggcctacacccacgccctgagcgagctgcccgagacgctcgagaccctgctgctcctgaccctgctcgccgccgtgaccgggggcatcttcctgttcctgatgtccggcaaggggatcggcaagatgaccctcgggatgtgctgcatcatcacggcgagcatcctgctgtggtacgcccagatccagccccactggatcgccgcctccatcatcctcgagttcttcctgatcgtcctgctcatcccggagcccgagaagcagcgcacgccccaggacaaccagctgacctacgtggtgatcgccatcctgaccgtcgtggcggccacgatggccaacgagatgggcttcctcgagaagaccaagaaggacctggggttcggcagcatcaccacccaggagagcgagtccaacatcctggacatcgacctccggcccgccagcgcctggacgctgtacgcggtggccaccaccttcgtcaccccgatgctgcgccactccatcgagaacagctccgtgaacgtgagcctcacggccatcgccaaccaggcgaccgtcctgatgggcctggggaagggctggcccctctccaagatggacatcggggtgcccctgctggccatcggctgctacagccaggtgaaccccatcaccctcaccgccgccctgctgctcctggtcgcccactacgcgatcatcgggccgggcctgcaggccaaggccacgcgggaggcccagaagcgcgccgcggccggcatcatgaagaaccccaccgtggacgggatcaccgtgatcgacctcgagcccatcccctacgacccgaagttcgagaagcagctgggccaggtcatgctgctcatcctgtgcgtgacccaggtgctgatgatgcggacgacctgggccctctgcgaggccctgaccctggccaccgggcccatctccacgctctgggagggcaaccccgggcgcttctggaacaccaccatcgcggtcagcatggccaacatcttccgcggctcctacctggccggcgccgggctcctgttcagcatcatgaagaacaccacgaacacccggcgcggcaccgggaacgtgggcgagaccctgggcgagaagtggaagtcccggctgaacgcgctcggcaagagcgagttccagatctacaagaagtccggcatccaggaggtggaccgcacgctggccaaggaggggatcaagcggggcgagaccgaccaccacgccgtcagccgcgggtccgccaagctgcggtggttcgtggagcgcaacatggtgacccccgagggcaaggtcgtggacctcggctgcgggcggggcgggtggagctactactgcggcgggctgaagaacgtgcgcgaggtcaagggcctgaccaagggcgggccgggccacgaggagcccatccccatgtccacgtacgggtggaacctcgtgcggctgcagagcggcgtggacgtcttcttcacgccgcccgagaagtgcgacaccctgctctgcgacatcggggagagctcccccaaccccaccatcgaggccggccgcaccctgcgggtgctgaacctcgtggagaactggctgaacaacaacacgcagttctgcatcaaggtcctgaacccctacatgcccagcgtgatcgagaagatggagaccctccagcgcaagtacggcggggcgctggtgcggaaccccctgtcccgcaacagcacccacgagatgtactgggtctccaacgccaccggcaacatcgtgagctccgtgaacatgatcagccggatgctgatcaaccgcttcacgatgaagcacaagaaggccacctacgagcccgacgtcgacctcgggtccggcacccggaacatcgggatcgagagcgagatcccgaacctggacatcatcggcaagcgcatcgagaagatcaagcaggagcacgagatctcctggcactacgaccaggaccacccctacaagacctgggcctaccacggcagctacgagacgaagcagaccgggtccgccagctccatggtgaacggcgtggtccgcctgctcaccaagccctgggacgtggtgcccatggtcacccagatggcgatgacggacaccaccccgttcgggcagcagcgggtgttcaaggagaaggtggacacccgcacgcaggagcccaaggagggcaccaagaagctgatgaagatcaccgccgagtggctgtggaaggagctcggcaaggagaagacgccccggatgtgcacgcgcgaggagttcacccggaaggtccgcagcaacgccgccctgggggccgtgttcaccgacgagaacaagtggaagtccgcgcgggaggccgtggaggacgaccgcttctgggagctggtcgaccgggagcgcaacctccacctggagggcaagtgcgagacctgcgtgtacaacatgatggggaagcgggagaagaagctgggcgagttcgggaaggccaagggcagccgcgccatctggtacatgtggctcggcgcgcggttcctggagttcgaggccctggggttcctcaacgaggaccactggttctcccgcggcaacagcctgagcggggtcgagggcgaggggctgcaccggctcggctacatcctgcgcgaggtgggcaagaaggagggcggggccatgtacgccgacgacacggccgggtgggacacccggatcaccctggaggacctcaagaacgaggagatggtgaccaaccacatgaagggcgagcacaagaagctggcggaggccatcttcaagctgacgtaccagaacaaggtcgtgcgcgtgcagcggcccaccccgcgcgggaccgtcatggacatcatctcccggaaggaccagcgcggcagcggccaggtggggacctacggcctcaacacgttcaccaacatggaggcccagctgatccgccagatggagggggagggcatcttcaagtccatccagcacctgaccgccaccgaggagatcgccgtgcagaactggctcgcgcgggtcggccgcgagcggctgagccgcatggccatctccggggacgactgcgtggtgaagcccatcgacgaccggttcgccagcgccctgacggccctcaacgacatgggcaaggtccgcaaggacatccagcagtgggagccctcccgggggtggaacgactggacccaggtgcccttctgcagccaccacttccacgagctggtgatgaaggacggccgcgtcctggtggtgccgtgccggaaccaggacgagctcatcgggcgcgcgcggatctcccagggcgccggctggagcctgaaggagaccgcctgcctggggaagtcctacgcccagatgtggaccctcatgtacttccaccgccgggacctgcgcctggccgcgaacgccatctgcagcgccgtcccctcccactgggtgcccaccagccggacgacctggtccatccacgccaagcacgagtggatgaccaccgaggacatgctcacggtgtggaaccgcgtctggatccaggagaacccctggatggaggacaagaccccggtggagagctgggaggaggtgccctacctgggcaagcgggaggaccagtggtgcgggtccctgatcggcctcaccagccgcgcgacctgggccaagaacatccagacggccatcaaccaggtccggagcctgatcgggaacgagggctacaccgactacatgccctccatgaagcgcttccgccgggaggaggaggaggccggcgtgctgtggtga

SEQ ID NO: 9006 - RNA, 9876 nt, synthetic construct
  misc_feature 1..9876: note = derived and/or modified CDS sequence (opt1) from DENV-2__JX475906__SS-prME
  source 1..9876: mol_type = other RNA
accgtgggcatgatcatcatgctgatccccaccgccatggccttccacctcaccacccggaacggggagccccacatgatcgtgagccggcaggagaagggcaagagcctgctgttcaagaccgaggacggggtgaacatgtgcaccctcatggcgatggacctgggcgagctgtgcgaggacaccgtgacctacaactgccccctcctgcggcagaacgagcccgaggacatcgactgctggtgcaacagcacctccacctgggtcacctacgggacctgcaccgccaccggcgagcaccggcgcgagaagcggagcgtggccctggtgccccacgtcggcatggggctcgagacccgcaccgagacctggatgtccagcgagggcgcctggaagcacgcccagcggatcgagacctggatcctgcgccaccccgggttcacgatcatggcggccatcctggcctacaccatcggcaccacctacttccagcgggtgctcatcttcatcctgctgacggccgtggcgccctccatgaccatgcgctgcatcgggatcagcaaccgggacttcgtcgagggcgtgtccggcgggagctgggtggacatcgtcctcgagcacggctcctgcgtgaccaccatggccaagaacaagcccacgctggacttcgagctgatcaagaccgaggccaagcagcccgccaccctccgcaagtactgcatcgaggccaagctgaccaacacgaccaccgcgagccggtgcccgacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaagatcgtgcagcccgagaacctggagtacaccatcgtcatcacgccccactccggcgaggagaacgccgtggggaacgacacgggcaagcacgggaaggaggtgaaggtcaccccgcagagctccatcaccgaggccgagctgaccggctacgggaccgtgacgatggagtgcagcccccgcaccggcctcgacttcaacgagatggtgctgctgcagatggagaacaaggcctggctcgtccaccggcagtggttcctggacctgcccctcccctggctgccgggcgcggacacccaggggtccaactggatccagaaggagaccctggtgacgttcaagaacccccacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaacccgatcgtcaccgagaaggactcccccgtgaacatcgaggccgagccgcccttcggggacagctacatcatcatcggcgtggagccggggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagcccgagtcccccagcaagctggcctccgccatccagaaggcccacgaggaggggatctgcggcatccggagcgtcacccgcctggagaacctcatgtggaagcagatcacccccgagctgaaccacatcctgtccgagaacgaggtgaagctcaccatcatgacgggggacatcaagggcatcatgcaggccgggaagcggagcctgcgcccgcagcccaccgagctgaagtactcctggaagacctggggcaaggcgaagatgctcagcaccgagccccacaaccagacgttcctgatcgacggcccggagaccgccgagtgccccaacaccaaccgggcctggaactccctggaggtggaggactacgggttcggcgtcttcaccacgaacatctggctcaagctgaaggagcgccaggacgtgttctgcgacagcaagctgatgtccgccgccatcaaggacaaccgggcggtgcacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgccggcccggtgagccagcacaactaccgccccgggtaccacacccagaccgcgggcccctggcacctcgggaagctggagatggacttcgacttctgcgagggcacgaccgtcgtggtgaccgaggactgcgggaaccggggccccagcctgcgcaccacgaccgcctccggcaagctcatcaccgagtggtgctgccggagctgcaccctgccgcccctgcgctaccgcggggaggacggctgctggtacgggatggagatccgccccctcaaggagaaggaggagaacctggtcaactccctggtgacggccggccacgggcagatcgacaacttcagcctcggcgtgctgggcatggccctgttcctcgaggagatgctgcggacccgcgtcgggaccaagcacgcgctgctcctggtggccgtgtccttcatgaccctgatcacgggcaacatgagcttccgggacctcgggcgcgtcatggtgatggtgggcgccgccatgaccgacgacatcgggatgggcgtcacctacctggccctgctcgcggccttcaaggtgcgccccaccttcgccgccggcctgctgctccggaagctgacgtccaaggagctgatgatgaccaccatcgggatcgtgctcctgagccagtccaccatcccggagacgatcctggagctcaccgacgccctggcgctgggcatgatgatcctcaagatcgtccgcaacatggagaagtaccagctggccgtgaccatcatggccatcctgtgcgtccccaacgccgtgatcctccagaacgcctggaaggtgagctgcaccatcctggcggtcgtgtccgtgagccccctgctcctgacgtccagccggcagaaggccgactggatccccctggccctcaccatcaaggggctgaacccgaccgccatcttcctgaccacgctctcccgcaccaacaagaagcggagctggcccctgaacgaggcgatcatggccgtcggcatggtgtccatcctggccagctccctcctgaagaacgacatccccatgaccggccccctggtggccgggggcctcctgaccgtctgctacgtgctgacggggcgcagcgccgacctcgagctggagcgggcggccgacgtgcgctgggaggaccaggccgagatcagcggctccagcccgatcctgtccatcaccatcagcgaggacgggtccatgagcatcaagaacgaggaggaggagcagaccctcaccatcctgatccggacgggcctgctcgtcatctccggcctgttccccgtgagcatccccatcaccgccgccgcgtggtacctgtgggaggtgaagaagcagcgcgccggggtcctctgggacgtgccctccccgccgcccgtgggcaaggccgagctggaggacggggcctaccggatcaagcagaagggcatcctggggtacagccagatcggcgccggcgtctacaaggaggggaccttccacaccatgtggcacgtgacccgcggcgcggtgctcatgcacaaggggaagcggatcgagccgtcctgggccgacgtccgcaaggacctgatcagctacggcgggggctggaagctggagggcgagtggaaggagggggaggaggtccaggtgctcgccctggagcccggcaagaacccccgggccgtccagacgaagcccgggctgttcaagaccaacaccggcaccatcggggccgtgtccctcgacttcagcccgggcacgtccggcagccccatcgtggacaagaaggggaaggtcgtgggcctgtacgggaacggcgtggtcacccgctccggcacctacgtgagcgcgatcgcccaggccgagaagtccatcgaggacaaccccgagatcgaggacgacatcttccggaagcgccggctgaccatcatggacctgcaccccggggccggcaagacgaagcgctacctcccggcgatcgtgcgggaggccatcaagcgcgggctgcgcaccctgatcctcgcccccacccgggtcgtggccgccgagatggaggaggcgctgcgcggcctgcccatccggtaccagacccccgccatccgcgccgagcacacggggcgggagatcgtggacctcatgtgccacgccaccttcaccatgcgcctgctgagcccggtccgggtgcccaactacaacctcatcatcatggacgaggcccacttcaccgaccccgcgagcatcgccgcccgcggctacatctccacgcgggtggagatgggcgaggccgccgggatcttcatgaccgcgacgccgcccggcagccgcgaccccttcccccagtccaacgcccccatcatggacgaggagcgggagatccccgagcgcagctggaactccgggcacgagtgggtcaccgacttcaagggcaagacggtgtggttcgtgcccagcatcaaggccgggaacgacatcgccgcgtgcctgcggaagaacggcaagaaggtcatccagctgtcccgcaagaccttcgacagcgagtacatcaagacccggaccaacgactgggacttcgtggtgacgaccgacatctccgagatgggcgccaacttcaaggccgagcgcgtcatcgacccccggcgctgcatgaagcccgtgatcctcaccgacggggaggagcgggtgatcctggccggcccgatgcccgtcacccacagctccgccgcgcagcgccgcgggcggatcggccgcaaccccaagaacgagaacgaccagtacatctacatgggggagcccctggagaacgacgaggactgcgcccactggaaggaggccaagatgctcctggacaacatcaacacgccggagggcatcatccccagcatgttcgagcccgagcgggagaaggtggacgccatcgacggcgagtaccgcctgcgcggggaggcccgcaagaccttcgtggacctcatgcggcgcggcgacctgccggtctggctggcgtaccgggtggccgccgaggggatcaactacgccgaccgccggtggtgcttcgacggcgtcaagaacaaccagatcctcgaggagaacgtggaggtggagatctggaccaaggagggggagcgcaagaagctgaagccccggtggctggacgcccgcatctactccgaccccctcgcgctgaaggagttcaaggagttcgccgccggccgcaagagcctgaccctcaacctgatcacggagatgggccgcctgcccaccttcatgacccagaaggcccggaacgcgctcgacaacctggccgtcctgcacaccgccgaggccgggggccgcgcctacaaccacgcgctctccgagctgccggagacgctggagaccctcctgctgctcaccctgctggccaccgtgaccgggggcatcttcctcttcctgatgagcggcaaggggatcggcaagatgaccctggggatgtgctgcatcatcaccgcctccatcctcctgtggtacgcccagatccagccccactggatcgccgcgagcatcatcctggagttcttcctcatcgtgctgctgatccccgagcccgagaagcagcggaccccgcaggacaaccagctcacctacgtcgtgatcgccatcctgacggtggtcgccgccaccatggccaacgagatgggcttcctggagaagaccaagaaggacttcgggctcggctccatcgcgacccagcagcccgagagcaacatcctggacatcgacctgcgccccgccagcgcctggacgctctacgccgtggccaccaccttcatcacccccatgctgcggcactccatcgagaacagctccgtgaacgtcagcctgacggcgatcgccaaccaggccaccgtgctcatgggcctggggaagggctggccgctgtccaagatggacatcggggtgcccctcctggccatcggctgctacagccaggtcaaccccatcaccctgaccgcggccctcctgctgctcgtggcccactacgccatcatcgggcccggcctgcaggccaaggcgacgcgcgaggcccagaagcgcgccgccgccggcatcatgaagaacccgaccgtggacgggatcaccgtcatcgacctggaccccatcccctacgaccccaagttcgagaagcagctcggccaggtgatgctgctggtgctctgcgtcacccaggtgctgatgatgcggacgacctgggcgctgtgcgaggccctcaccctggccaccgggccgatctccacgctgtgggagggcaaccccgggcgcttctggaacaccaccatcgccgtgagcatggccaacatcttccggggctcctacctcgcgggcgccgggctgctgttcagcatcatgaagaacaccacgaacacccgccggggcaccgggaacaccggcgagacgctcggcgagaagtggaagaaccgcctgaacgccctggggaagtccgagttccagatctacaagaagtccggcatccaggaggtcgaccggaccctcgccaaggaggggatcaagcgcggcgagaccgaccaccacgcggtgtcccgggggagcgccaagctgcgctggttcgtggagcggaacctggtcacccccgagggcaaggtggtggacctcggctgcgggcgcggcgggtggtcctactactgcggcgggctgaagaacgtccgggaggtgaagggcctgacgaagggcgggcccggccacgaggagccgatccccatgagcacctacgggtggaacctcgtgcgcctgcagtccggcgtcgacgtgttcttcacgccgcccgagaagtgcgacaccctgctctgcgacatcggggagagctccccgaaccccacggtggaggccggccggaccctgcgcgtcctgaacctcgtggagaactggctgaacaacaacacccagttctgcatcaaggtgctgaacccctacatgccgagcgtcatcgagaagatggaggccctgcagcggaagtacggcggggccctcgtgcgcaaccccctgagccggaactccacccacgagatgtactgggtgagcaacgcgtccggcaacatcgtcagctccgtgaacatgatcagccgcatgctgatcaaccgcttcaccatgcggcacaagaaggccacgtacgagcccgacgtggacctcgggtccggcacccgcaacatcgggatcgagagcgagacccccaacctggacatcatcggcaagcggatcgagaagatcaagcaggagcacgagacctcctggcactacgaccaggaccacccgtacaagacgtgggcctaccacggcagctacgagaccaagcagaccgggtccgccagctccatggtcaacggcgtggtgcgcctgctcaccaagccctgggacgtcatccccatggtgacgcagatggccatgaccgacaccacccccttcgggcagcagcgggtgttcaaggagaaggtcgacacgcgcacccaggagccgaaggagggcaccaagaagctgatgaagatcaccgcggagtggctgtggaaggagctcggcaagaagaagacgccccggatgtgcacccgcgaggagttcacccggaaggtgcgcagcaacgccgccctgggggccatcttcaccgacgagaacaagtggaagtccgcccgggaggcggtcgaggacagccgcttctgggagctggtggacaaggagcggaacctccacctggagggcaagtgcgagacgtgcgtgtacaacatgatggggaagcgcgagaagaagctgggcgagttcgggaaggccaagggctcccgggccatctggtacatgtggctcggcgcccgcttcctggagttcgaggcgctggggttcctcaacgaggaccactggttcagccgggagaactccctgagcggcgtcgagggggagggcctgcacaagctcgggtacatcctgcgcgacgtgagcaagaaggagggcggcgccatgtacgccgacgacaccgccgggtgggacacccggatcaccctggaggacctcaagaacgaggagatggtgacgaaccacatggagggcgagcacaagaagctggccgaggcgatcttcaagctgacctaccagaacaaggtcgtgcgcgtgcagcggcccacgccccgggggaccgtcatggacatcatctcccgccgggaccagcgcggcagcggccaggtggggacgtacggcctcaacaccttcaccaacatgggggcccagctgatccggcagatggagggcgagggggtgttcaagtccatccagcacctgaccgccacggaggagatcgccgtccaggactggctcgcccgcgtgggccgggagcgcctgagccggatggcgatctccggcgacgactgcgtggtcaagccgctggacgaccgcttcgccagcgccctcaccgccctgaacgacatggggaaggtgcggaaggacatccagcagtgggagccctcccgcggctggaacgactggacccaggtgcccttctgcagccaccacttccacgagctgatcatgaaggacgggcgggtcctcgtggtgccctgccgcaaccaggacgagctgatcggccgggcccgcatctcccagggggcgggctggagcctgcgggagaccgcctgcctcggcaagtcctacgcccagatgtggagcctgatgtacttccaccgccgggacctgcgcctcgccgccaacgcgatctgctccgccgtcccgagccactgggtgcccacgtcccggaccacctggagcatccacgccaagcacgagtggatgaccaccgaggacatgctgacggtgtggaaccgcgtctggatccaggagaacccctggatggaggacaagacccccgtggagtcctgggaggagatcccgtacctggggaagcgcgaggaccagtggtgcggcagcctcatcgggctgaccagccgggccacctgggcgaagaacatccagacggccatcaaccaggtgcgctccctgatcggcaacgaggagtacaccgactacatgcccagcatgaagcggttccgccgggaggaggaggaggccggggtcctctggtga

SEQ ID NO: 9007 - RNA, 9876 nt, synthetic construct
  misc_feature 1..9876: note = derived and/or modified CDS sequence (opt1) from DENV-2__JX669477__SS-prME
  source 1..9876: mol_type = other RNA
accgccggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcggcggggtcttcacgtccatcgggaaggccctccaccaggtgttcggggcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcatcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacacgctgtggtccaacggcgtgctggagagcgagatgatcatccccaagaacttcgccgggcccgtgtcccagcacaactaccgcccgggctaccacacccagaccgcggggccctggcacctcggcaagctggagatggacttcgacttctgcgaggggaccacggtcgtggtgaccgaggactgcggcaaccggggccccagcctgcgcaccaccacggccagcgggaagctcatcaccgagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacgcgcgtcggcaccaagcacgcgatcctgctcgtggccctgagcttcgtgaccctgatcaccgggaacatgtccttccgggacctcggccgcgtcatggtgatggtgggggccacgatgaccgacgacatcggcatgggcgtcacctacctggccctgctcgccgcgttcaaggtgcgccccaccttcgccgccgggctgctgctccggaagctgacgagcaaggagctgatgatggccaccatcggcatcgccctcctgtcccagagcaccctgcccgagaccatcctcgagctgacggacgcgctggccctcgggatgatggccctgaagatcgtgcgcaacatggagaagtaccagctggccgtcaccatcatggccatctcctgcgtgccgaacaccgtgatcctccagaacgcgtggaaggtcagctgcaccatcctggccgccgtgtccgtgagccccctgctcctgacgtccagccagcagaaggccgactggatccccctggcgctcaccatcaagggcctgaaccccaccgccatcttcctgaccacgctctcccggaccagcaagaagcgctcctggccgctgaacgaggccatcatggccgtcggcatggtgagcatcctggcctccagcctcctgaagaacgacatccccatgaccgggcccctggtcgcgggcgggctcctgaccgtgtgctacgtgctgacgggccggagcgccgacctcgagctggagcgcgccgccgacgtcaagtgggaggaccaggccgagatctccgggagctcccccatcctgagcatcaccatctccgaggacggcagcatgtccatcaagaacgaggaggaggagcagaccctcaccatcctgatccggaccggcctgctcgtgatcagcggggtgttcccggtctccatccccatcacggcggccgcctggtacctgtgggaggtgaagaagcagcgcgccggcgtgctgtgggacgtccccagcccgccgcccgtggggaaggccgagctcgaggacggcgcgtaccggatcaagcagcgcgggatcctgggctactcccagatcggcgccggggtgtacaaggagggcaccttccacaccatgtggcacgtcacccgcggggccgtgctgatgcaccgcggcaagcggatcgagcccagctgggccgacgtgaagaaggacctcatctcctacgggggcggctggaagctggagggggagtggaaggagggcgaggaggtccaggtgctggccctcgagcccgggaagaacccccgcgcggtgcagacgaagcccggcatcttcaagaccaacaccgggaccatcggcgccgtcagcctggacttctcccccggcacgagcgggtcccccatcgtggaccggaagggcaaggtggtcgggctgtacggcaacggcgtggtgacccgcagcggggcctacgtctccgccatcgcgcagaccgagaagtccatcgaggacaaccccgagatcgaggacgacatcttccggaagaagcgcctcaccatcatggacctgcaccccggcgccgggaagacgaagcggtacctgcccgccatcgtgcgcgaggccatcaagcggggcctgcgcaccctcatcctggccccgacccgcgtggtcgcggccgagatggaggaggccctgcgggggctccccatccgctaccagacccccgccatccgggccgagcacacgggccgcgagatcgtggacctgatgtgccacgcgaccttcaccatgcggctgctcagccccgtgcgcgtcccgaactacaacctgatcatcatggacgaggcccacttcaccgaccccgcctccatcgccgcccggggctacatcagcacgcgcgtggagatgggggaggcggccggcatcttcatgaccgccacgccgcccgggtcccgggacccgttcccccagagcaacgcccccatcatggacgaggagcgcgagatccccgagcggtcctggaacagcggccacgagtgggtgaccgacttcaaggggaagacggtctggttcgtgccgtccatcaaggcgggcaacgacatcgccgcctgcctgcgcaagaacggcaagaaggtgatccagctcagccggaagaccttcgactccgagtacgtcaagacccgcgccaacgactgggacttcgtggtgaccacggacatcagcgagatgggggccaacttcaaggcggagcgggtcatcgacccccgccggtgcatgaagcccgtgatcctgaccgacggcgaggagcgcgtgatcctggccgggcccatgccggtcacccactccagcgccgcccagcggcgcggccgcatcgggcggaaccccaagaacgagaacgaccagtacatctacatgggcgagcccctcgagaacgacgaggactgcgcccactggaaggaggcgaagatgctgctggacaacatcaacacccccgagggcatcatcccgtccatgttcgagcccgagcgcgagaaggtggacgccatcgacggggagtaccggctccgcggcgaggcccggaagacgttcgtggacctgatgcgccgcggggacctgcccgtctggctcgcctacaaggtggccgcggagggcatcaactacgccgaccgcaagtggtgcttcgacgggatcaagaacaaccagatcctggaggagaacgtggaggtcgagatctggaccaaggagggcgagcggaagaagctgaagccgcgctggctcgacgcccggatctacagcgaccccctggccctgaaggagttcaaggagttcgcggccggccgcaagtccctcaccctgaacctgatcaccgagatggggcggctccccacgttcatgacccagaaggcccgcaacgccctggacaacctggccgtgctccacaccgcggaggtgggcgggaaggcccacacccacgccctgagcgagctgcccgagacgctcgagaccctgctgctcctgaccctgctcgccgccgtcaccggcggcatcttcctgttcctgatgtccgggaagggcatcgggaagatgaccctcggcatgtgctgcatcatcacggcgagcatcctgctgtggtacgcccagatccagccgcactggatcgccgcctccatcatcctcgagttcttcctgatcgtgctgctcatccccgagcccgagaagcagcggacgccccaggacaaccagctgacctacgtcgtgatcgccatcctgaccgtggtcgcggccacgatggccaacgagatggggttcctcgagaagaccaagaaggacctgggcttcggcagcatcaccacccaggagagcgagtccaacatcctggacatcgacctccgcccggccagcgcctggacgctgtacgcggtggccaccaccttcgtgacccccatgctgcggcactccatcgagaacagctccgtcaacgtgagcctcacggccatcgccaaccaggcgaccgtgctgatggggctgggcaaggggtggcccctctccaagatggacatcggcgtccccctgctggccatcgggtgctacagccaggtgaacccgatcaccctcaccgccgccctgctgctcctggtggcccactacgcgatcatcggccccggcctgcaggccaaggccacgcgcgaggcccagaagcgggccgcggccgggatcatgaagaaccccaccgtcgacggcatcaccgtgatcgacctcgagcccatcccgtacgaccccaagttcgagaagcagctggggcaggtcatgctgctcatcctgtgcgtcacccaggtgctgatgatgcgcacgacctgggccctctgcgaggccctgaccctggccaccggccccatctccacgctctgggaggggaaccccggccggttctggaacaccaccatcgcggtgagcatggccaacatcttccgcggctcctacctggccggggccggcctcctgttcagcatcatgaagaacaccacgaacacccgccgggggaccggcaacgtcggcgagaccctgggggagaagtggaagtcccgcctgaacgcgctcggcaagagcgagttccagatctacaagaagtccgggatccaggaggtggaccggacgctggccaaggagggcatcaagcgcggggagaccgaccaccacgccgtgagccggggctccgccaagctgcgctggttcgtcgagcggaacatggtgaccccggagggcaaggtggtcgacctcgggtgcggccgcgggggctggagctactactgcgggggcctgaagaacgtgcgggaggtgaagggcctgaccaagggcgggcccgggcacgaggagcccatccccatgtccacgtacggctggaacctcgtccgcctgcagagcggggtggacgtgttcttcaccccgcccgagaagtgcgacaccctgctctgcgacatcggcgagagctcccccaaccccaccatcgaggccggccggaccctgcgcgtcctgaacctcgtggagaactggctgaacaacaacacgcagttctgcatcaaggtgctgaacccgtacatgcccagcgtcatcgagaagatggagaccctccagcggaagtacgggggcgcgctggtgcgcaaccccctgtcccggaacagcacccacgagatgtactgggtgtccaacgccaccgggaacatcgtcagctccgtgaacatgatcagccgcatgctgatcaaccggttcacgatgaagcacaagaaggccacctacgagccggacgtggacctcggctccgggacccgcaacatcggcatcgagagcgagatccccaacctggacatcatcggcaagcggatcgagaagatcaagcaggagcacgagacctcctggcactacgaccaggaccacccctacaagacgtgggcctaccacgggagctacgagaccaagcagaccggctccgccagctccatggtcaacggggtggtgcgcctgctcaccaagccctgggacgtcgtgccgatggtgacgcagatggcgatgaccgacaccacccccttcggccagcagcgcgtcttcaaggagaaggtggacacgcggacccaggagcccaaggagggcaccaagaagctgatgaagatcaccgccgagtggctgtggaaggagctcgggaaggagaagacgccccgcatgtgcacccgggaggagttcacccgcaaggtgcggagcaacgccgccctgggcgccgtcttcaccgacgagaacaagtggaagtccgcgcgcgaggccgtggaggacgggcggttctgggagctggtggaccgcgagcggaacctccacctggagggcaagtgcgagacgtgcgtctacaacatgatggggaagcgcgagaagaagctgggcgagttcggcaaggccaaggggagccgggccatctggtacatgtggctcggcgcgcgcttcctggagttcgaggccctggggttcctcaacgaggaccactggttctcccgggagaacagcctgagcggcgtggagggggagggcctgcaccgcctcggctacatcctgcgggacgtctccaagaaggagggcggcgccatgtacgccgacgacaccgccgggtgggacacccgcatcaccctggaggacctcaagaacgaggagatggtgacgaaccacatgaagggcgagcacaagaagctggcggaggccatcttcaagctgacctaccagaacaaggtggtccgggtgcagcgcccgacgccccgggggaccgtgatggacatcatcagccgcaaggaccagcggggctccggccaggtcgggacgtacggcctcaacaccttcaccaacatggaggcccagctgatccgccagatggagggggagggcatcttccgcagcatccagcacctgaccgccacggaggagatcgccgtgcagaactggctcgcgcgggtgggccgcgagcggctgtcccgcatggccatcagcggggacgactgcgtcgtgaagcccatcgacgaccggttcgcctccgccctgaccgccctcaacgacatgggcaaggtgcgcaaggacatccagcagtgggagcccagccgggggtggaacgactggacccaggtcccgttctgctcccaccacttccacgagctggtgatgaaggacggccgcgtgctggtcgtgccctgccggaaccaggacgagctcatcgggcgcgcgcggatcagccagggcgccggctggtccctgaaggagaccgcctgcctgggcaagagctacgcccagatgtggaccctcatgtacttccaccgccgggacctgcgcctggccgcgaacgccatctgctccgccgtgcccagccactgggtccccacgtcccggaccacctggagcatccacgccaagcacgagtggatgaccacggaggacatgctcgcggtgtggaaccgcgtgtggatccaggagaacccgtggatggaggacaagacccccgtcgagtcctgggaggaggtgccctacctgggcaagcgggaggaccagtggtgcgggagcctgatcggcctcaccagccgcgccacctgggccaagaacatccagacggccatcaaccaggtgcggtccctgatcgggaacgagggctacaccgactacatgcccagcatgaagcgcttccgccgggaggaggaggaggccggcgtcctgtggtga

SEQ ID NO: 9008 - RNA, 9876 nt, synthetic construct
  misc_feature 1..9876: note = derived and/or modified CDS sequence (opt1) from DENV-2__JX669478__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcggcggggtcttcacgtccatcgggaaggccctccaccaggtgttcggggcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcatcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacacgctgtggtccaacggcgtgctggagagcgagatgatcatccccaagaacttcgccgggcccgtgtcccagcacaactaccgcccgggctaccacacccagaccgcggggccctggcacctcggcaagctggagatggacttcgacttctgcgaggggaccacggtcgtggtgaccgaggactgcggcaaccggggccccagcctgcgcaccaccacggccagcgggaagctcatcaccgagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacgcgcgtcggcaccaagcacgcgatcctgctcgtggccctgagcttcgtgaccctgatcaccgggaacatgtccttccgggacctcggccgcgtcatggtgatggtgggggccacgatgaccgacgacatcggcatgggcgtcacctacctggccctgctcgccgcgttcaaggtgcgccccaccttcgccgccgggctgctgctccggaagctgacgagcaaggagctgatgatggccaccatcggcatcgccctcctgtcccagagcaccctgcccgagaccatcctcgagctgacggacgcgctggccctcgggatgatggccctgaagatcgtgcgcaacatggagaagtaccagctggccgtcaccatcatggccatctcctgcgtgccgaacgcggtgatcctccagaacgcctggaaggtcagctgcaccatcctggccgccgtgtccgtgagccccctgctcctgacctccagccagcagaaggcggactggatccccctggccctcacgatcaagggcctgaaccccaccgccatcttcctgaccaccctctcccggacgagcaagaagcgctcctggccgctgaacgaggccatcatggccgtcggcatggtgagcatcctggcgtccagcctcctgaagaacgacatccccatgaccgggcccctggtcgccggcgggctcctgaccgtgtgctacgtgctgaccggccggagcgccgacctcgagctggagcgcgccgccgacgtcaagtgggaggaccaggcggagatctccgggagctcccccatcctgagcatcacgatctccgaggacggcagcatgtccatcaagaacgaggaggaggagcagaccctcaccatcctgatccggaccggcctgctcgtgatcagcggggtgttcccggtctccatccccatcaccgccgccgcctggtacctgtgggaggtgaagaagcagcgcgccggcgtgctgtgggacgtccccagcccgccgcccgtggggaaggcggagctcgaggacggcgcctaccggatcaagcagcgcgggatcttcggctactcccagatcggcgccggggtgtacaaggagggcacgttccacaccatgtggcacgtcacccgcggggccgtgctgatgcaccgcggcaagcggatcgagcccagctgggccgacgtgaagaaggacctgatctcctacgggggcggctggaagctcgagggggagtggaaggagggcgaggaggtccaggtgctggcgctggagcccgggaagaacccccgcgccgtgcagaccaagcccggcatcttcaagacgaacaccgggaccatcggcgccgtcagcctcgacttctcccccggcaccagcgggtcccccatcgtggaccggaagggcaaggtggtcgggctgtacggcaacggcgtggtgacgcgcagcggggcctacgtctccgcgatcgcccagaccgagaagtccatcgaggacaaccccgagatcgaggacgacatcttccggaagaagcgcctgaccatcatggacctccaccccggcgccgggaagaccaagcggtacctgcccgccatcgtgcgcgaggccatcaagcggggcctgcgcacgctgatcctcgcgccgacccgcgtggtcgccgccgagatggaggaggccctgcgggggctgcccatccgctaccagacccccgccatccgggcggagcacaccggccgcgagatcgtggacctcatgtgccacgccacgttcaccatgcggctgctgagccccgtgcgcgtcccgaactacaacctcatcatcatggacgaggcccacttcaccgaccccgcctccatcgccgcgcggggctacatcagcacccgcgtggagatgggggaggccgccggcatcttcatgacggccacgccgcccgggtcccgggacccgttcccccagagcaacgcgcccatcatggacgaggagcgcgagatccccgagcggtcctggaacagcggccacgagtgggtgaccgacttcaaggggaagaccgtctggttcgtgccgtccatcaaggccggcaacgacatcgccgcctgcctgcgcaagaacggcaagaaggtgatccagctgagccggaagacgttcgactccgagtacgtcaagacccgcgccaacgactgggacttcgtggtgaccaccgacatcagcgagatgggggcgaacttcaaggccgagcgggtcatcgacccccgccggtgcatgaagcccgtgatcctcacggacggcgaggagcgcgtgatcctggccgggcccatgccggtcacccactccagcgccgcccagcggcgcggccgcatcgggcggaaccccaagaacgagaacgaccagtacatctacatgggcgagcccctggagaacgacgaggactgcgcgcactggaaggaggccaagatgctcctggacaacatcaacacccccgagggcatcatcccgtccatgttcgagcccgagcgcgagaaggtggacgccatcgacggggagtaccggctgcgcggcgaggcccggaagaccttcgtggacctcatgcgccgcggggacctgcccgtctggctggcctacaaggtggcggccgagggcatcaactacgccgaccgcaagtggtgcttcgacgggatcaagaacaaccagatcctcgaggagaacgtggaggtcgagatctggacgaaggagggcgagcggaagaagctgaagccgcgctggctggacgcccggatctacagcgaccccctcgcgctgaaggagttcaaggagttcgccgccggccgcaagtccctgaccctcaacctgatcaccgagatggggcggctgcccaccttcatgacgcagaaggcccgcaacgccctcgacaacctggcggtgctgcacaccgccgaggtgggcgggaaggcctacacccacgccctcagcgagctgcccgagaccctggagacgctcctgctgctcaccctgctggccgcggtcaccggcggcatcttcctcttcctgatgtccgggaagggcatcgggaagatgaccctgggcatgtgctgcatcatcaccgccagcatcctcctgtggtacgcccagatccagccgcactggatcgccgcctccatcatcctggagttcttcctcatcgtgctgctgatccccgagcccgagaagcagcggacgccccaggacaaccagctcacctacgtcgtgatcgcgatcctgaccgtggtcgccgccaccatggccaacgagatggggttcctggagaagacgaagaaggacctcggcttcggcagcatcaccacccaggagagcgagtccaacatcctggacatcgacctgcgcccggccagcgcgtggaccctctacgccgtggccacgaccttcgtgacccccatgctgcggcactccatcgagaacagctccgtcaacgtgagcctgaccgccatcgcgaaccaggccacggtgctcatggggctgggcaaggggtggcccctgtccaagatggacatcggcgtccccctcctggccatcgggtgctacagccaggtgaacccgatcaccctgaccgccgccctcctgctgctcgtggcgcactacgccatcatcggccccggcctgcaggccaaggccacccgcgaggcccagaagcgggcggccgccgggatcatgaagaaccccacggtcgacggcatcaccgtgatcgacctggagcccatcccgtacgaccccaagttcgagaagcagctcgggcaggtcatgctgctgatcctctgcgtcacccaggtgctgatgatgcgcaccacgtgggccctgtgcgaggccctcaccctggcgaccggccccatctccaccctgtgggaggggaaccccggccggttctggaacacgaccatcgccgtgagcatggccaacatcttccgcggctcctacctcgccggggcgggcctgctgttcagcatcatgaagaacaccaccaacacgcgccgggggaccggcaacgtcggcgagaccctcggggagaagtggaagtcccgcctgaacgccctgggcaagagcgagttccagatctacaagaagtccgggatccaggaggtggaccggaccctcgccaaggagggcatcaagcgcggggagacggaccaccacgccgtgagccggggctccgccaagctgcgctggttcgtcgagcggaacatggtgaccccggagggcaaggtggtcgacctggggtgcggccgcgggggctggagctactactgcgggggcctcaagaacgtgcgggaggtgaagggcctgaccaagggcggccccgggcacgaggagcccatccccatgtccacctacggctggaacctggtccgcctccagagcggggtggacgtgttcttcacgccgcccgagaagtgcgacaccctgctgtgcgacatcggcgagagctcccccaaccccaccatcgaggcgggccggaccctccgcgtcctgaacctggtggagaactggctcaacaacaacacccagttctgcatcaaggtgctgaacccgtacatgcccagcgtcatcgagaagatggagacgctgcagcggaagtacgggggcgccctcgtgcgcaaccccctgtcccggaacagcacccacgagatgtactgggtgtccaacgccaccgggaacatcgtcagctccgtgaacatgatcagccgcatgctgatcaaccggttcaccatgaagcacaagaaggccacgtacgagccggacgtggacctgggctccgggacccgcaacatcggcatcgagagcgagatccccaacctcgacatcatcggcaagcggatcgagaagatcaagcaggagcacgagacctcctggcactacgaccaggaccacccctacaagacctgggcctaccacgggagctacgagacgaagcagaccggctccgcgagctccatggtcaacggggtggtgcgcctgctgaccaagccctgggacgtcatcccgatggtgacccagatggccatgacggacaccacccccttcggccagcagcgcgtgttcaaggagaaggtcgacacccggacgcaggagcccaaggagggcaccaagaagctcatgaagatcaccgccgagtggctgtggaaggagctggggaaggagaagacgccccggatgtgcacgcgggaggagttcacccgcaaggtgcggagcaacgccgccctcggcgcggtgttcaccgacgagaacaagtggaagtccgcccgcgaggccgtcgaggacgggcggttctgggagctggtggaccgcgagcggaacctgcacctcgagggcaagtgcgagacctgcgtgtacaacatgatggggaagcgcgagaagaagctgggcgagttcggcaaggccaaggggagccgggcgatctggtacatgtggctgggcgcccgcttcctcgagttcgaggccctggggttcctgaacgaggaccactggttctcccggggcaacagcctcagcggggtcgagggcgagggcctgcaccgcctggggtacatcctccgggaggtgggcaagaaggagggcggcgccatgtacgccgacgacacggcggggtgggacacccgcatcaccctggaggacctgaagaacgaggagatggtcaccaaccacatgaagggcgagcacaagaagctcgccgaggccatcttcaagctgacgtaccagaacaaggtggtgcgggtccagcgcccgacgccccggggcaccgtgatggacatcatctcccgcaaggaccagcgggggagcggccaggtggggacctacggcctgaacacgttcaccaacatggaggcccagctcatccgccagatggagggcgaggggatcttcaagtccatccagcacctgaccgccaccgaggagatcgcggtccagaactggctggcccgcgtgggccgggagcgcctcagccggatggccatctccggggacgactgcgtggtcaagcccatcgacgaccgcttcgccagcgccctgacggcgctgaacgacatgggcaaggtgcggaaggacatccagcagtgggagccctcccgcgggtggaacgactggacccaggtgccgttctgcagccaccacttccacgagctcgtcatgaaggacggccgggtgctggtggtcccctgccgcaaccaggacgagctgatcggccgggcccgcatctcccagggggccggctggagcctcaaggagaccgcctgcctggggaagtcctacgcccagatgtggaccctgatgtacttccaccggcgcgacctccggctggcggccaacgccatctgcagcgccgtgccctcccactgggtgcccaccagccgcacgacctggtccatccacgcgaagcacgagtggatgaccaccgaggacatgctggccgtctggaaccgggtgtggatccaggagaacccgtggatggaggacaagacgcccgtggagagctgggaggaggtcccctacctcggcaagcgcgaggaccagtggtgcgggtccctgatcggcctgaccagccgggccacctgggccaagaacatccagaccgccatcaaccaggtgcgcagcctcatcggcaacgaggggtacatcgactacatgccctccatgaagcggttccgccgcgaggaggaggaggcgggcgtgctgtggtga

SEQ ID NO: 9009 - RNA, 9876 nt, synthetic construct
  misc_feature 1..9876: note = derived and/or modified CDS sequence (opt1) from DENV-2__JX669480__SS-prME
  source 1..9876: mol_type = other RNA
accgcgggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacgtggatcctgcgccacccgggcttcgccatcatggcggccatcctggcctacaccatcgggaccacccacttccagcgggccctcatcttcatcctgctgacggcggtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgccaccctccgcaagtactgcatcgaggcgaagctgaccaacacgaccaccgagtcccggtgcccgacccagggcgagcccagcctgaacgaggagcaggacaagcgcttcatctgcaagcactccatggtggaccggggctgggggaacggctgcggcctcttcggcaagggcgggatcgtgacgtgcgccatgttcacgtgcaagaagaacatggagggcaaggtcgtgctgcccgagaacctggagtacaccatcgtgatcacgccccacagcggggaggagcacgccgtcggcaacgacacggggaagcacggcgaggagatcaagatcaccccgcagtccagcatcaccgaggccgagctcaccgggtacggcaccgtgacgatggagtgcagcccccggaccggcctggacttcaacgagatggtgctgctccagatggaggagaaggcctggctggtccaccggcagtggttcctggacctccccctgccctggctgccgggggcggacacccagggcagcaactggatccagaaggagaccctcgtgacgttcaagaacccccacgccaagaagcaggacgtggtcgtgctggggtcccaggagggcgccatgcacaccgccctgaccggggccaccgagatccagatgagcagcggcaacctcctgttcacgggccacctgaagtgccgcctccggatggacaagctgcagctgaaggggatgtcctacagcatgtgcaccggcaagttcaagatcgtcaaggagatcgcggagacccagcacgggaccatcgtgatccgcgtgcagtacgagggcgacggctccccctgcaagatccccttcgagatcatggacctcgagaagcggcacgtcctggggcgcctgatcacggtgaacccgatcgtgaccgagaaggacagccccgtcaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtgttcacctccatcgggaaggcgctgcaccaggtcttcggcgccatctacggcgccgccttcagcggggtgtcctggaccatgaagatcctgatcggcgtgatcatcacctggatcgggatgaacagccgctccacgagcctgtccgtcagcctcgtgctggtgggcgtcgtgaccctgtacctcggggcgatggtgcaggccgactccggctgcgtcgtgagctggaagaacaaggagctgaagtgcggctccgggatcttcatcaccgacaacgtgcacacctggacggagcagtacaagttccagcccgagagccccagcaagctggcctccgccatccagaaggcccacgaggagggcatctgcgggatccggagcgtcacccgcctcgagaacctgatgtggaagcagatcacccccgagctgaaccacatcctctccgagaacgaggtgaagctgaccatcatgacgggcgacatcaaggggatcatgcaggcgggcaagcggagcctgcgcccgcagcccaccgagctcaagtactcctggaagacctggggcaaggccaagatgctgagcaccgagtcccacaaccagacgttcctgatcgacgggcccgagaccgccgagtgcccgaacaccaaccgggcctggaacagcctcgaggtggaggactacggcttcggggtcttcaccacgaacatctggctgaagctgcgcgagaagcaggacgtgttctgcgactccaagctcatgagcgccgcgatcaaggacaaccgggccgtgcacgccgacatgggctactggatcgagtccgccctgaacgacacctggaagatggagaaggccagcttcatcgaggtcaagtcctgccactggcccaagagccacaccctgtggtccaacggcgtgctcgagagcgagatgatcatccccaagaacttcgcggggcccgtgtcccagcacaactaccgcccgggctaccacacccagaccgccgggccctggcacctgggcaagctggagatggacttcgacttctgcgaggggacgaccgtcgtggtgaccgaggactgcggcaaccggggccccagcctccgcaccacgaccgccagcgggaagctgatcaccgagtggtgctgccggtcctgcaccctgcccccgctccgctaccggggcgaggacgggtgctggtacggcatggagatccgccccctgaaggagaaggaggagaacctggtcaacagcctcgtgacggccgggcacggccagatcgacaacttctccctgggcgtgctggggatggccctcttcctggaggagatgctgcggacccgcgtcggcaccaagcacgccatcctcctggtggccgtgagcttcgtcaccctgatcacggggaacatgtccttccgggacctcggccgcgtgatggtgatggtcggggtgaccatgaccgacgacatcggcatgggcgtgacctacctggccctgctcgccgcgttcaaggtccgccccacgttcgccgccgggctgctgctccggaagctgaccagcaaggagctgatgatggccaccatcggcatcaccctcctgtcccagagcacgatccccgagaccatcctggagctcaccgacgccctggcgctggggatgatggtgctcaagatcgtgcgcaacatggagaagtaccagctggccgtcaccatcatggccatctcctgcgtgccgaacgccgtgatcctgctcaacgcctggaaggtcagctgcacgatcctggcggccgtgtccgtcagccccctgctcctgacctccagccagcagaagaccgactggatccccctggccctcaccatcaagggcctgaaccccacggccatcttcctgaccaccctctcccggaccagcaagaagcgctcctggccgctgaacgaggcggtgatggccgtgggcatggtcagcatcctggcctccagcctcctgaagaacgacatccccatgacggggcccctggtggccggcgggctcctgaccgtgtgctacgtcctgaccggccggagcgccgacctcgagctggagcgcgcggccgacgtgaagtgggaggaccaggccgagatctccgggagctcccccatcctgagcatcaccatctccgaggacggcagcatgtccatcaagaacgaggaggaggagcagacgctcaccatcctgatccggaccggcctgctcgtgatcagcggggtcttcccggtgtccatccccatcaccgccgccgcgtggtacctgtgggaggtgaagaagcagcgcgccggcgtcctgtgggacgtgcccagcccgccgcccgtggggaaggccgagctcgaggacggcgcctaccggatcaagcagcgcgggatcctgggctactcccagatcggcgccggggtctacaaggagggcaccttccacacgatgtggcacgtgacccgcggggcggtgctgatgcaccgcggcaagcggatcgagcccagctgggccgacgtcaagaaggacctcatctcctacgggggcggctggaagctggagggggagtggaaggagggcgaggaggtccaggtgctggccctcgagcccgggaagaacccccgcgccgtccagaccaagcccggcctgttcaagaccaacacggggaccatcggcgccgtgagcctggacttctcccccggcaccagcgggtcccccatcgtggaccggaagggcaaggtcgtggggctctacggcaacggcgtggtcacccgcagcggggcgtacgtgtccgccatcgcccagacggagaagtccatcgaggacaaccccgagatcgaggacgacatcttccggaagaagcgcctgaccatcatggacctgcaccccggcgccgggaagaccaagcggtacctgcccgcgatcgtgcgcgaggccatcaagcggggcctccgcaccctgatcctggccccgacgcgcgtcgtggccgccgagatggaggaggcgctccgggggctgcccatccgctaccagacccccgccatccgggccgagcacaccggccgcgagatcgtggacctgatgtgccacgccaccttcacgatgcggctcctgagccccgtccgcgtgccgaactacaacctgatcatcatggacgaggcccacttcaccgaccccgcgtccatcgccgcccggggctacatcagcacccgcgtggagatgggggaggccgccggcatcttcatgaccgcgacgccgcccgggtcccgggacccgttcccccagagcaacgcccccatcatggacgaggagcgcgagatccccgagcggtcctggaacagcggccacgagtgggtcaccgacttcaaggggaagaccgtgtggttcgtgccgtccatcaaggccggcaacgacatcgccgcgtgcctccgcaagaacggcaagaaggtcatccagctgagccggaagaccttcgactccgagtacgtgaagacgcgcgccaacgactgggacttcgtggtcaccaccgacatcagcgagatgggggccaacttccgggccgagcgcgtgatcgacccccggcgctgcatgaagcccgtgatcctgaccgacggcgaggagcgggtcatcctcgccgggcccatgccggtgacgcactccagcgcggcccagcgccgcggccgggtggggcgcaaccccaagaacgagaacgaccagtacatctacatgggcgagcccctggagaacgacgaggactgcgcccactggaaggaggccaagatgctgctcgacaacatcaacacccccgagggcatcatcccgtccatgttcgagcccgagcgggagaaggtcgacgccatcgacggggagtaccgcctgcggggcgaggcgcgcaagaccttcgtggacctgatgcggcgcggggacctccccgtgtggctggcctaccgggtcgccgccgagggcatcaactacgccgaccgccggtggtgcttcgacgggatcaagaacaaccagatcctggaggagaacgtggaggtcgagatctggaccaaggagggcgagcgcaagaagctcaagccgcggtggctggacgcgcgcatctacagcgaccccctggccctcaaggagttcaaggagttcgccgccggccggaagtccctgacgctgaacctcatcaccgagatggggcgcctgcccaccttcatgacccagaagacgcgggacgcgctggacaacctcgccgtgctgcacaccgccgaggccggcgggcgcgcctacaaccacgcgctgagcgagctccccgagaccctggagaccctgctcctgctgacgctcctggccaccgtgaccggcggcatcttcctgttcctcatgtccgggaagggcatcgggaagatgaccctgggcatgtgctgcatcatcaccgccagcatcctgctctggtacgcccagatccagccgcactggatcgccgcgtccatcatcctggagttcttcctgatcgtcctcctgatccccgagcccgagaagcagcggacgccccaggacaaccagctgacctacgtggtgatcgccatcctcaccgtcgtggccgccaccatggccaacgagatggggttcctggagaagacgaagaaggacctgggcctcggcagcatcaccacccaggagagcgagtccaacatcctggacatcgacctgcgcccggcgagcgcctggaccctctacgccgtggccacgaccttcgtcacccccatgctgcggcactccatcgagaacagctccgtgaacgtgagcctgaccgccatcgcgaaccaggccacggtcctcatggggctgggcaaggggtggcccctgtccaagatggacatcggcgtgcccctcctggccatcgggtgctacagccaggtgaacccgatcaccctgaccgccgcgctcctgctgctcgtcgcccactacaccatcatcggccccggcctgcaggccaaggccacgcgcgaggcccagaagcgcgcggccgccgggatcatgaagaaccccaccgtggacggcatcaccgtgatcgacctggagcccatcccgtacgaccccaagttcgagaagcagctcgggcaggtcatgctgctgatcctctgcgtgacccaggtgctgatgatgcggacgacctgggccctgtgcgaggccctcaccctggcgaccggccccatctccacgctgtgggaggggaaccccggccgcttctggaacaccaccatcgccgtcagcatggccaacatcttccggggctcctacctcgccggggccggcctgctgttcagcatcatgaagaacaccacgaacacccgccgggggaccggcaacatcggcgagaccctcggggagaagtggaagtcccgcctgaacgcgctgggcaagagcgagttccagatctacaagaagtccgggatccaggaggtggaccggacgctcgccaaggagggcatcaagcgcggggagaccgaccaccacgccgtgagccggggctccgccaagctgcgctggttcgtcgagcggaacatggtgaccccggagggcaaggtggtcgacctggggtgcggccgcgggggctggagctactactgcgggggcctcaagaacgtgcgggaggtgaagggcctgaccaagggcgggcccgggcacgaggagcccatccccatgtccacgtacggctggaacctggtccgcctccagagcggggtggacgtgttcttcaccccgcccgagaagtgcgacaccctgctgtgcgacatcggcgagagctcccccaaccccaccatcgaggcgggccggaccctccgcgtcctgaacctggtggagaactggctcaacaacaacacgcagttctgcatcaaggtgctgaacccgtacatgcccagcgtcatcgagaagatggagaccctgcagcggaagtacgggggcgccctggtgcgcaaccccctctcccggaacagcacccacgagatgtactgggtgtccaacgccaccgggaacatcgtcagctccgtgaacatgatcagccgcatgctgatcaaccgcttcacgatgaagcacaagaaggccacctacgagccggacgtggacctgggctccgggacccggaacatcggcatcgagagcgagatccccaacctcgacatcatcggcaagcgcatcgagaagatcaagcaggagcacgagacctcctggcactacgaccaggaccacccctacaagacgtgggcctaccacgggagctacgagaccaagcagaccggctccgcgagctccatggtcaacggggtggtgcggctgctgaccaagccctgggacgtcgtgccgatggtgacgcagatggccatgaccgacaccacccccttcggccagcagcgcgtcttcaaggagaaggtggacacgcggacccaggagcccaaggagggcaccaagaagctcatgcgcatcaccgccgagtggctgtggaaggagctggggaagaagaagacgccccggatgtgcacccgcgaggagttcacccggaaggtgcgcagcaacgccgccctcggcgcgatcttcaccgacgagaacaagtggaagtccgcccgggaggccgtcgaggacagccgcttctgggagctggtggaccgggagcgcaacctgcacctcgaggggaagtgcgagacgtgcgtctacaacatgatgggcaagcgggagaagaagctgggggagttcggcaaggccaagggctcccgcgccatctggtacatgtggctgggggcgcggttcctcgagttcgaggccctgggcttcctgaacgaggaccactggttcagccgcgggaacagcctctccggcgtggagggggagggcctgcaccggctgggctacatcctccgcgacgtgagcaagaaggagggcggggccatgtacgccgacgacaccgcggggtgggacacccggatcaccctggaggacctgaagaacgaggagatggtcacgaaccacatgaagggcgagcacaagaagctcgccgaggccatcttcaagctgacctaccagaacaaggtggtgcgcgtccagcgcccgacgccccgggggaccgtgatggacatcatctcccgccgggaccagcgcggcagcggccaggtggggacgtacggcctgaacaccttcaccaacatggaggcccagctcatccggcagatggagggggagggcatcttcaagtccatccagcacctgaccgtcacggaggagatcgccgtgcagaactggctggcgcgcgtgggccgggagcgcctcagccggatggccatctccggggacgactgcgtcgtgaagcccctggacgaccgcttcgccagcgccctgaccgccctcaacgacatgggcaaggtgcggaaggacatccagcagtgggagccctcccgcgggtggaacgactggacccaggtcccgttctgcagccaccacttccacgagctggtgatgaaggacggccgggtgctggtcgtgccctgccgcaaccaggacgagctcatcgggcgggcgcgcatctcccagggcgccggctggagcctgaaggagaccgcctgcctggggaagtcctacgcccagatgtggaccctcatgtacttccaccggcgcgacctgcggctggccgcgaacgccatctgcagcgccgtgccctcccactgggtccccacgagccgcaccacctggtccatccacgccaagcacgagtggatgaccacggaggacatgctcgccgtgtggaaccgcgtgtggatccaggagaacccgtggatggaggacaagacccccgtcgagagctgggaggaggtgccctacctgggcaagcgggaggaccagtggtgcgggagcctgatcggcctcacctcccgcgcgacctgggccaagaacatccagacggccatcaaccaggtgcggagcctgatcgggaacgaggagtacaccgactacatgccctccatgaagcgcttccggcgcgaggaggaggaggccggcgtcctgtggtga

SEQ ID NO: 9010 - RNA, 9876 nt, synthetic construct
  misc_feature 1..9876: note = derived and/or modified CDS sequence (opt1) from DENV-2__JX669483__SS-prME
  source 1..9876: mol_type = other RNA
accgcgggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacgtggatcctgcgccacccgggcttcgccatcatggcggccatcctggcctacaccatcgggaccacccacttccagcgggccctcatcttcatcctgctgacggcggtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgccaccctccgcaagtactgcatcgaggcgaagctgaccaacacgaccaccgagtcccggtgcccgacccagggcgagcccagcctgaacgaggagcaggacaagcgcttcatctgcaagcactccatggtggaccggggctgggggaacggctgcggcctcttcggcaagggcgggatcgtgacgtgcgccatgttcacgtgcaagaagaacatggagggcaaggtcgtgctgcccgagaacctggagtacaccatcgtgatcacgccccacagcggggaggagcacgccgtcggcaacgacacggggaagcacggcgaggagatcaagatcaccccgcagtccagcatcaccgaggccgagctcaccgggtacggcaccgtgacgatggagtgcagcccccggaccggcctggacttcaacgagatggtgctgctccagatggaggagaaggcctggctggtccaccggcagtggttcctggacctccccctgccctggctgccgggggcggacacccagggcagcaactggatccagaaggagaccctcgtgacgttcaagaacccccacgccaagaagcaggacgtggtcgtgctggggtcccaggagggcgccatgcacaccgccctgaccggggccaccgagatccagatgagcagcggcaacctcctgttcacgggccacctgaagtgccgcctccggatggacaagctgcagctgaaggggatgtcctacagcatgtgcaccggcaagttcaagatcgtcaaggagatcgcggagacccagcacgggaccatcgtgatcaaggtgcagtacgagggcgacggctccccctgcaagatccccttcgagatcatggacctcgagaagcgccacgtcctggggcggctgatcacggtgaacccgatcgtgaccgagaaggacagccccgtcaacatcgaggccgagccgcccttcggcgactcctacatcatcatcggggtggagccgggccagctcaagctgaactggttcaagaaggggagctccatcggccagatgttcgagaccaccatgcgcggcgccaagcgcatggccatcctgggggacacggcctgggacttcggcagcctcgggggcgtgttcacctccatcgggaaggcgctgcaccaggtcttcggcgccatctacggcgccgccttcagcggggtgtcctggaccatgaagatcctgatcggcgtgatcatcacctggatcgggatgaacagccggtccacgagcctgtccgtcagcctcgtgctggtgggcgtcgtgaccctgtacctcggggcgatggtgcaggccgactccggctgcgtcgtgagctggaagaacaaggagctgaagtgcggctccgggatcttcatcaccgacaacgtgcacacctggacggagcagtacaagttccagcccgagagccccagcaagctggcctccgccatccagaaggcccacgaggagggcatctgcgggatccgcagcgtcacccggctcgagaacctgatgtggaagcagatcacccccgagctgaaccacatcctctccgagaacgaggtgaagctgaccatcatgacgggcgacatcaaggggatcatgcaggcgggcaagcgcagcctgcggccgcagcccaccgagctcaagtactcctggaagacctggggcaaggccaagatgctgagcaccgagtcccacaaccagacgttcctgatcgacgggcccgagaccgccgagtgcccgaacaccaaccgcgcctggaacagcctcgaggtggaggactacggcttcggggtcttcaccacgaacatctggctgaagctgcgggagaagcaggacgtgttctgcgactccaagctcatgagcgccgcgatcaaggacaaccgcgccgtgcacgccgacatgggctactggatcgagtccgccctgaacgacacctggaagatggagaaggccagcttcatcgaggtcaagtcctgccactggcccaagagccacaccctgtggtccaacggcgtgctcgagagcgagatgatcatccccaagaacttcgcggggcccgtgtcccagcacaactaccggccgggctaccacacccagaccgccgggccctggcacctgggcaagctggagatggacttcgacttctgcgaggggacgaccgtcgtggtgaccgaggactgcggcaaccgcggccccagcctccggaccacgaccgccagcgggaagctgatcaccgagtggtgctgccgctcctgcaccctgcccccgctccggtaccgcggcgaggacgggtgctggtacggcatggagatccggcccctgaaggagaaggaggagaacctggtcaacagcctcgtgacggccgggcacggccagatcgacaacttctccctgggcgtgctggggatggccctcttcctggaggagatgctgcgcacccgggtcggcaccaagcacgccatcctcctggtggccgtgagcttcgtcaccctgatcacggggaacatgtccttccgcgacctcggccgggtgatggtgatggtcggggtgaccatgaccgacgacatcggcatgggcgtgacctacctggccctgctcgccgcgttcaaggtccgccccacgttcgccgccgggctgctgctccgcaagctgaccagcaaggagctgatgatggccaccatcggcatcaccctcctgtcccagagcacgatccccgagaccatcctggagctcaccgacgccctggcgctggggatgatggtgctcaagatcgtgcggaacatggagaagtaccagctggccgtcaccatcatggccatctcctgcgtgccgaacgccgtgatcctgctcaacgcctggaaggtcagctgcacgatcctggcggccgtgtccgtcagccccctgctcctgacctccagccagcagaagaccgactggatccccctggccctcaccatcaagggcctgaaccccacggccatcttcctgaccaccctctcccgcaccagcaagaagcggtcctggccgctgaacgaggcggtgatggccgtgggcatggtcagcatcctggcctccagcctcctgaagaacgacatccccatgacggggcccctggtggccggcgggctcctgaccgtgtgctacgtcctgaccggccgcagcgccgacctcgagctggagcgggcggccgacgtgaagtgggaggaccaggccgagatctccgggagctcccccatcctgagcatcaccatctccgaggacggcagcatgtccatcaagaacgaggaggaggagcagacgctcaccatcctgatccgcaccggcctgctcgtgatcagcggggtcttcccggtgtccatccccatcaccgccgccgcgtggtacctgtgggaggtgaagaagcagcgggccggcgtcctgtgggacgtgcccagcccgccgcccgtggggaaggccgagctcgaggacggcgcctaccgcatcaagcagcgggggatcctgggctactcccagatcggcgccggggtctacaaggagggcaccttccacacgatgtggcacgtgacccgcggggcggtgctgatgcaccggggcaagcgcatcgagcccagctgggccgacgtcaagaaggacctcatctcctacgggggcggctggaagctggagggggagtggaaggagggcgaggaggtccaggtgctggccctcgagcccgggaagaacccccgggccgtccagaccaagcccggcctgttcaagaccaacacggggaccatcggcgccgtgagcctggacttctcccccggcaccagcgggtcccccatcgtggaccgcaagggcaaggtcgtggggctctacggcaacggcgtggtcacccggagcggggcgtacgtgtccgccatcgcccagacggagaagtccatcgaggacaaccccgagatcgaggacgacatcttccgcaagaagcggctgaccatcatggacctgcaccccggcgccgggaagaccaagcgctacctgcccgcgatcgtgcgggaggccatcaagcgcggcctccggaccctgatcctggccccgacgcgcgtcgtggccgccgagatggaggaggcgctccgcgggctgcccatccggtaccagacccccgccatccgcgccgagcacaccggccgggagatcgtggacctgatgtgccacgccaccttcacgatgcgcctcctgagccccgtccgggtgccgaactacaacctgatcatcatggacgaggcccacttcaccgaccccgcgtccatcgccgcccgcggctacatcagcacccgggtggagatgggggaggccgccggcatcttcatgaccgcgacgccgcccgggtcccgcgacccgttcccccagagcaacgcccccatcatggacgaggagcgggagatccccgagcgctcctggaacagcggccacgagtgggtcaccgacttcaaggggaagaccgtgtggttcgtgccgtccatcaaggccggcaacgacatcgccgcgtgcctccggaagaacggcaagaaggtcatccagctgagccgcaagaccttcgactccgagtacgtgaagacgcgggccaacgactgggacttcgtggtcaccaccgacatcagcgagatgggggccaacttccgcgccgagcgggtgatcgacccccgccggtgcatgaagcccgtgatcctgaccgacggcgaggagcgcgtcatcctcgccgggcccatgccggtgacgcactccagcgcggcccagcggcgcggccgcgtggggcggaaccccaagaacgagaacgaccagtacatctacatgggcgagcccctggagaacgacgaggactgcgcccactggaaggaggccaagatgctgctcgacaacatcaacacccccgagggcatcatcccgtccatgttcgagcccgagcgcgagaaggtcgacgccatcgacggggagtaccggctgcgcggcgaggcgcggaagaccttcgtggacctgatgcgccgcggggacctccccgtgtggctggcctaccgcgtcgccgccgagggcatcaactacgccgaccggcgctggtgcttcgacgggatcaagaacaaccagatcctggaggagaacgtggaggtcgagatctggaccaaggagggcgagcggaagaagctcaagccgcgctggctggacgcgcggatctacagcgaccccctggccctcaaggagttcaaggagttcgccgccggccgcaagtccctgacgctgaacctcatcaccgagatggggcggctgcccaccttcatgacccagaagacgcgcgacgcgctggacaacctcgccgtgctgcacaccgccgaggccggcgggcgggcctacaaccacgcgctgagcgagctccccgagaccctggagaccctgctcctgctgacgctcctggccaccgtgaccggcggcatcttcctgttcctcatgtccgggaagggcatcgggaagatgaccctgggcatgtgctgcatcatcaccgccagcatcctgctctggtacgcccagatccagccgcactggatcgccgcgtccatcatcctggagttcttcctgatcgtcctcctgatccccgagcccgagaagcagcgcacgccccaggacaaccagctgacctacgtggtgatcgccatcctcaccgtcgtggccgccaccatggccaacgagatggggttcctggagaagacgaagaaggacctgggcctcggcagcatcaccacccaggagagcgagtccaacatcctggacatcgacctgcggccggcgagcgcctggaccctctacgccgtggccacgaccttcgtcacccccatgctgcgccactccatcgagaacagctccgtgaacgtgagcctgaccgccatcgcgaaccaggccacggtcctcatggggctgggcaaggggtggcccctgtccaagatggacatcggcgtgcccctcctggccatcgggtgctacagccaggtgaacccgatcaccctgaccgccgcgctcctgctgctcgtcgcccactacaccatcatcggccccggcctgcaggccaaggccacgcgggaggcccagaagcgcgcggccgccgggatcatgaagaaccccaccgtggacggcatcaccgtgatcgacctggagcccatcccgtacgaccccaagttcgagaagcagctcgggcaggtcatgctgctgatcctctgcgtgacccaggtgctgatgatgcgcacgacctgggccctgtgcgaggccctcaccctggcgaccggccccatctccacgctgtgggaggggaaccccggccggttctggaacaccaccatcgccgtcagcatggccaacatcttccgcggctcctacctcgccggggccggcctgctgttcagcatcatgaagaacaccacgaacacccggcgcgggaccggcaacatcggcgagaccctcggggagaagtggaagtcccggctgaacgcgctgggcaagagcgagttccagatctacaagaagtccgggatccaggaggtggaccgcacgctcgccaaggagggcatcaagcgcggggagaccgaccaccacgccgtgagccgcggctccgccaagctgcggtggttcgtcgagcgcaacatggtgaccccggagggcaaggtggtcgacctggggtgcggccgcggcgggtggagctactactgcggcgggctcaagaacgtgcgcgaggtgaaggggctgaccaagggcgggcccgggcacgaggagcccatccccatgtccacgtacggctggaacctggtccggctccagagcggggtggacgtgttcttcaccccgcccgagaagtgcgacaccctgctgtgcgacatcggcgagagctcccccaaccccaccatcgaggcgggccgcaccctccgggtcctgaacctggtggagaactggctcaacaacaacacgcagttctgcatcaaggtgctgaacccgtacatgcccagcgtcatcgagaagatggagaccctgcagcgcaagtacgggggcgccctggtgcggaaccccctctcccgcaacagcacccacgagatgtactgggtgtccaacgccaccgggaacatcgtcagctccgtgaacatgatcagccggatgctgatcaaccgcttcacgatgaagcacaagaaggccacctacgagccggacgtggacctgggctccgggacccgcaacatcggcatcgagagcgagatccccaacctcgacatcatcggcaagcggatcgagaagatcaagcaggagcacgagacctcctggcactacgaccaggaccacccctacaagacgtgggcctaccacgggagctacgagaccaagcagaccggctccgcgagctccatggtcaacggggtggtgcgcctgctgaccaagccctgggacgtcgtgccgatggtgacgcagatggccatgaccgacaccacccccttcggccagcagcgggtcttcaaggagaaggtggacacgcgcacccaggagcccaaggagggcaccaagaagctcatgcggatcaccgccgagtggctgtggaaggagctggggaagaagaagacgccccgcatgtgcacccgggaggagttcacccgcaaggtgcggagcaacgccgccctcggcgcgatcttcaccgacgagaacaagtggaagtccgcccgcgaggccgtcgaggacagccggttctgggagctggtggaccgcgagcggaacctgcacctcgaggggaagtgcgagacgtgcgtctacaacatgatgggcaagcgcgagaagaagctgggggagttcggcaaggccaagggctcccgggccatctggtacatgtggctgggggcgcgctacctcgagttcgaggccctgggcttcctgaacgaggaccactggttcagccgggggaacagcctctccggcgtggagggggagggcctgcaccgcctgggctacatcctccgggacgtgagcaagaaggagggcggcgccatgtacgccgacgacaccgcggggtgggacacccgcatcaccctggaggacctgaagaacgaggagatggtcacgaaccacatgaagggcgagcacaagaagctcgccgaggccatcttcaagctgacctaccagaacaaggtggtgcgggtccagcgcccgacgccccgggggaccgtgatggacatcatctcccggcgcgaccagcggggcagcggccaggtggggacgtacggcctgaacaccttcaccaacatggaggcccagctcatccgccagatggagggggagggcatcttcaagtccatccagcacctgaccgtcacggaggagatcgccgtgcagaactggctggcgcgggtgggccgcgagcggctcagccgcatggccatctccggggacgactgcgtcgtgaagcccctggacgaccggttcgccagcgccctgaccgccctcaacgacatgggcaaggtgcgcaaggacatccagcagtgggagccctcccgggggtggaacgactggacccaggtcccgttctgcagccaccacttccacgagctggtgatgaaggacggccgcgtgctggtcgtgccctgccggaaccaggacgagctcatcgggcgcgcgcggatctcccagggcgccggctggagcctgaaggagaccgcctgcctggggaagtcctacgcccagatgtggaccctcatgtacttccaccgccgggacctgcgcctggccgcgaacgccatctgcagcgccgtgccctcccactgggtccccacgagccggaccacctggtccatccacgccaagcacgagtggatgaccacggaggacatgctcgccgtgtggaaccgcgtgtggatccaggagaacccgtggatggaggacaagacccccgtcgagagctgggaggaggtgccctacctgggcaagcgcgaggaccagtggtgcgggagcctgatcggcctcacctcccgggcgacctgggccaagaacatccagacggccatcaaccaggtgcgcagcctgatcgggaacgaggagtacaccgactacatgccctccatgaagcggttccgccgggaggaggaggaggccggcgtcctgtggtga

SEQ ID NO: 9011 - RNA, 9876 nt, synthetic construct
  misc_feature 1..9876: note = derived and/or modified CDS sequence (opt1) from DENV-2__JX669484__SS-prME
  source 1..9876: mol_type = other RNA
accgcgggggtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcgccatcatggcggccatcctggcctacaccatcgggaccacccacttccagcgggccctcatcttcatcctgctgaccgcggtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgccaccctccgcaagtactgcatcgaggcgaagctgaccaacacgaccaccgagtcccggtgcccgacccagggcgagcccagcctgaacgaggagcaggacaagcgcttcatctgcaagcactccatggtggaccggggctgggggaacggctgcggcctcttcggcaagggcgggatcgtgacgtgcgccatgttcacgtgcaagaagaacatggagggcaaggtcgtgctgcccgagaacctggagtacaccatcgtgatcacgccccacagcggggaggagcacgccgtcggcaacgacacggggaagcacggcaaggagatcaagatcaccccgcagtccagcatcaccgaggccgagctcaccgggtacggcaccgtgacgatggagtgcagcccccggaccggcctggacttcaacgagatggtgctgctccagatggaggagaaggcctggctggtccaccggcagtggttcctggacctccccctgccctggctgccgggggcggacacccagggcagcaactggatccagaaggagaccctcgtgacgttcaagaacccccacgccaagaagcaggacgtggtcgtgctggggtcccaggagggcgccatgcacaccgccctgaccggggccaccgagatccagatgagcagcggcaacctcctgttcacgggccacctgaagtgccgcctccggatggacaagctgcagctgaaggggatgtcctacagcatgtgcaccggcaagttcaagatcgtcaaggagatcgcggagacccagcacgggaccatcgtgatccgcgtgcagtacgagggcgacggctccccctgcaagatccccttcgagatcatggacctcgagaagcggcacgtcctggggcgcctgatcacggtgaacccgatcgtgaccgagaaggacagccccgtcaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtgttcacctccatcgggaaggcgctgcaccaggtcttcggcgccatctacggcgccgccttcagcggggtgtcctggaccatgaagatcctgatcggcgtgatcatcacctggatcgggatgaacagccgctccacgagcctgtccgtcagcctcgtgctggtgggcgtcgtgaccctgtacctcggggcgatggtgcaggccgactccggctgcgtcgtgagctggaagaacaaggagctgaagtgcggctccgggatcttcatcaccgacaacgtgcacacctggacggagcagtacaagttccagcccgagagccccagcaagctggcctccgccatccagaaggcccacgaggagggcatctgcgggatccggagcgtcacccgcctcgagaacctgatgtggaagcagatcacccccgagctgaaccacatcctctccgagaacgaggtgaagctgaccatcatgacgggcgacatcaaggggatcatgcaggcgggcaagcggagcctgcgcccgcagcccaccgagctcaagtactcctggaagacctggggcaaggccaagatgctgagcaccgagtcccacaaccagacgttcctgatcgacgggcccgagaccgccgagtgcccgaacaccaaccgggcctggaacagcctcgaggtggaggactacggcttcggggtcttcaccacgaacatctggctgaagctgcgcgagaagcaggacgtgttctgcgactccaagctcatgagcgccgcgatcaaggacaaccgggccgtgcacgccgacatgggctactggatcgagtccgccctgaacggcacctggaagatggagaaggccagcttcatcgaggtcaagtcctgccactggcccaagagccacaccctgtggtccaacggggtgctcgagagcgagatgatcatccccaagaacttcgcgggccccgtgtcccagcacaactaccgcccggggtaccacacccagaccgccggcccctggcacctggggaagctggagatggacttcgacttctgcgagggcacgaccgtcgtggtgaccgaggactgcggcaaccgggggcccagcctccgcaccacgaccgccagcggcaagctgatcaccgagtggtgctgccggtcctgcaccctgcccccgctccgctaccgcggggaggacggctgctggtacgggatggagatccgccccctgaaggagaaggaggagaacctggtcaacagcctcgtgacggccggccacggccagatcgacaacttctccctgggggtgctgggcatggccctcttcctggaggagatgctgcggacccgcgtcgggaccaagcacgccatcctcctggtggccgtgagcttcgtcaccctgatcacgggcaacatgtccttcaaggacctcgggcgggtgatggtgatggtcggcgtggccatgaccgacgacatcggcatgggggtgacctacctggccctgctcgcggccttcaaggtccgccccaccttcgccgccggcctgctgctccgcaagctgacgagcaaggagctgatgatggccaccatcgggatcaccctcctgtcccagagcaccatccccgagacgatcctggagctcaccgacgcgctggccctgggcatgatggtgctcaagatcgtgcggaacatggagaagtaccagctggccgtcaccatcatgaccatctcctgcgtgccgaacgccgtgatcctgctcaacgcctggaaggtcagctgcacgatcctggcggccgtgtccgtcagccccctgctcctgacctccagccagcagaagaccgactggatccccctggccctcaccatcaagggcctgaaccccacggccatcttcctgaccaccctctcccgcaccagcaagaagcggtcctggccgctgaacgaggcggtgatggccgtggggatggtcagcatcctggcctccagcctcctgaagaacgacatccccatgacgggccccctggtggccgggggcctcctgaccgtgtgctacgtcctgaccgggcgcagcgccgacctcgagctggagcgggcggccgacgtgaagtgggaggaccaggccgagatctccggcagctcccccatcctgagcatcaccatctccgaggacggcagcatgtccatcaagaacgaggaggaggagcagacgctcaccatcctgatccgcaccgggctgctcgtgatcagcggcgtcttcccggtgtccatccccatcaccgccgccgcgtggtacctgtgggaggtgaagaagcagcgggccggggtcctgtgggacgtgcccagcccgccgcccgtgggcaaggccgagctcgaggacggggcctaccgcatcaagcagcggggcatcctgggctactcccagatcggggccggcgtctacaaggaggggaccttccacacgatgtggcacgtgacccgcggcgcggtgctgatgcaccgggggaagcgcatcgagcccagctgggccgacgtcaagaaggacctcatctcctacggcggcgggtggaagctggagggcgagtggaaggagggggaggaggtccaggtgctggccctcgagcccggcaagaacccccgggccgtccagaccaagcccgggctgttcaagaccaacacgggcaccatcggcgccgtgagcctggacttctcccccgggaccagcggctcccccatcgtggaccgcaaggggaaggtcgtgggcctctacggcaacggggtggtcacccggagcggcgcgtacgtgtccgccatcgcccagacggagaagtccatcgaggacaaccccgagatcgaggacgacatcttccgcaagaagcggctgaccatcatggacctgcaccccggggccggcaagaccaagcgctacctgcccgcgatcgtgcgggaggccatcaagcgcgggctccggaccctgatcctggccccgacgcgcgtcgtggccgccgagatggaggaggcgctccgcggcctgcccatccggtaccagacccccgccatccgcgccgagcacaccggccgggagatcgtggacctgatgtgccacgccaccttcacgatgcgcctcctgagccccgtccgggtgccgaactacaacctgatcatcatggacgaggcccacttcaccgaccccgcgtccatcgccgcccgcgggtacatcagcacccgggtggagatgggcgaggccgccgggatcttcatgaccgcgacgccgcccggctcccgcgacccgttcccccagagcaacgcccccatcatggacgaggagcgggagatccccgagcgctcctggaacagcgggcacgagtgggtcaccgacttcaagggcaagaccgtgtggttcgtgccgtccatcaaggccggcaacgacatcgccgcgtgcctccggaagaacgggaagaaggtcatccagctgagccgcaagaccttcgactccgagtacgtgaagacgcgggccaacgactgggacttcgtggtcaccaccgacatcagcgagatgggcgccaacttccgcgccgagcgggtgatcgacccccgccggtgcatgaagcccgtgatcctgaccgacggggaggagcgcgtcatcctcgccggccccatgccggtgacgcactccagcgcggcccagcggcgcgggcgcgtgggccggaaccccaagaacgagaacgaccagtacatctacatgggcgagcccctggagaacgacgaggactgcgcccactggaaggaggccaagatgctgctcgacaacatcaacacccccgaggggatcatcccgtccatgttcgagcccgagcgcgagaaggtcgacgccatcgacggcgagtaccggctgcgcggggaggcgcggaagaccttcgtggacctgatgcgccggggcgacctccccgtgtggctggcctaccgcgtcgccgccgaggggatcaactacgccgaccggcgctggtgcttcgacggcatcaagaacaaccagatcctggaggagaacgtggaggtcgagatctggaccaaggagggcgagcggaagaagctcaagccgcgctggctggacgcgcggatctacagcgaccccctggccctcaaggagttcaaggagttcgccgccgggcgcaagtccctgacgctgaacctcatcaccgagatgggccggctgcccaccttcatgacccagaaggcgcgcgacgccctggacaacctcgccgtgctgcacacggccgaggccgggggccgggcgtacaaccacgccctgagcgagctccccgagaccctggagaccctgctcctgctgaccctcctggccacggtgaccggcgggatcttcctgttcctcatgtccggcaagggggtcggcaagatgaccctggggatgtgctgcatcatcaccgccagcatcctgctctggtacgcccagatccagccgcactggatcgcggcctccatcatcctggagttcttcctgatcgtgctcctgatccccgagcccgagaagcagcgcacgccccaggacaaccagctgacgtacgtggtcatcgccatcctcaccgtggtggccgccaccatggcgaacgagatgggcttcctggagaagaccaagaaggacctgggcctcgggagcatcacgacccaggagagcgagtccaacatcctggacatcgacctgcggccggccagcgcctggaccctctacgccgtcgccaccacgttcgtgacccccatgctgcgccactccatcgagaacagctccgtgaacgtcagcctgaccgcgatcgccaaccaggccaccgtgctcatgggcctggggaagggctggcccctgtccaagatggacatcggggtgcccctcctggccatcggctgctacagccaggtcaacccgatcacgctgaccgcggccctcctgctgctcgtggcccactacgccatcatcggccccgggctgcaggccaaggcgacccgggaggcccagaagcgcgccgccgccggcatcatgaagaaccccaccgtggacgggatcacggtcatcgacctggagcccatcccgtacgaccccaagttcgagaagcagctcggccaggtgatgctgctgatcctctgcgtgacccaggtcctgatgatgcgcaccacctgggcgctgtgcgaggccctcacgctggccaccgggcccatctccaccctgtgggagggcaaccccggccggttctggaacaccacgatcgccgtgagcatggccaacatcttccgcgggtcctacctcgcgggcgccgggctgctgttcagcatcatgaagaacaccaccaacacccggcgcggcacgggcaacatcggggagaccctcggcgagaagtggaagtcccggctgaacgccctgggcaagagcgagttccagatctacaagaagtccggcatccaggaggtggaccgcaccctcgccaaggaggggatcaagcggggcgagaccgaccaccacgcggtcagccgcggctccgccaagctgcggtggttcgtggagcgcaacatggtgacgccggaggggaaggtcgtggacctgggctgcgggcggggcgggtggagctactactgcggcggcctcaagaacgtgcgcgaggtcaaggggctgaccaagggcgggcccggccacgaggagcccatccccatgtccacctacgggtggaacctggtgcggctccagagcggcgtggacgtcttcttcaccccgcccgagaagtgcgacacgctgctgtgcgacatcggcgagagctcccccaaccccaccatcgaggccgggcgcaccctccgggtgctgaacctggtggagaactggctcaacaacaacacccagttctgcatcaaggtcctgaacccgtacatgcccagcgtgatcgagaagatggagaccctgcagcgcaagtacggcggggccctggtgcggaaccccctctcccgcaacagcacgcacgagatgtactgggtctccaacgccaccggcaacatcgtgagctccgtgaacatgatcagccggatgctgatcaaccgcttcaccatgaagcacaagaaggcgacctacgagccggacgtcgacctggggtccggcacgcgcaacatcggcatcgagagcgagatccccaacctcgacatcatcgggaagcggatcgagaagatcaagcaggagcacgagacctcctggcactacgaccaggaccacccctacaagacctgggcctaccacggcagctacgagaccaagcagacggggtccgccagctccatggtgaacggcgtggtccgcctgctgaccaagccctgggacgtggtgccgatggtcacccagatggccatgaccgacacgacccccttcggccagcagcgggtgttcaaggagaaggtggacacccgcacccaggagcccaaggaggggacgaagaagctcatgcggatcaccgccgagtggctgtggaaggagctgggcaagaagaagacgccccgcatgtgcacccgggaggagttcacgcgcaaggtccggagcaacgcggccctcggggccatcttcaccgacgagaacaagtggaagtccgcccgcgaggccgtggaggacagccggttctgggagctggtcgaccgcgagcggaacctgcacctcgagggcaagtgcgagacctgcgtgtacaacatgatggggaagcgcgagaagaagctgggcgagttcggcaaggcgaaggggtcccgggccatctggtacatgtggctgggcgcccgcttcctcgagttcgaggccctggggttcctgaacgaggaccactggttcagccggggcaacagcctctccggggtggagggcgagggcctgcaccgcctggggtacatcctccgggacgtcagcaagaaggagggcggggcgatgtacgccgacgacaccgccggctgggacacgcgcatcaccctggaggacctgaagaacgaggagatggtgatcaaccacatgaagggggagcacaagaagctcgccgaggccatcttcaagctgacctaccagaacaaggtggtccgggtgcagcgcccgacgccccgcggcacggtgatggacatcatctcccggcgcgaccagcggggcagcgggcaggtcggcacctacgggctgaacaccttcaccaacatggaggcgcagctcatccgccagatggagggcgagggcatcttcaagtccatccagcacctgacggtgaccgaggagatcgccgtgcagaactggctggcccgggtcgggcgcgagcggctcagccgcatggccatctccggcgacgactgcgtggtgaagcccctggacgaccggttcgccagcgcgctgaccgccctcaacgacatggggaaggtccgcaaggacatccagcagtgggagccctcccggggctggaacgactggacccaggtgccgttctgcagccaccacttccacgagctggtgatgaaggacgggcgcgtcctggtggtgccctgccggaaccaggacgagctcatcggccgcgcccggatctcccagggcgccgggtggagcctgaaggagacggcctgcctgggcaagtcctacgcgcagatgtggaccctcatgtacttccaccgccgggacctgcgcctggccgccaacgccatctgcagcgccgtcccctcccactgggtgcccaccagccggaccacctggtccatccacgcgaagcacgagtggatgacgaccgaggacatgctcgccgtgtggaaccgcgtctggatccaggagaacccgtggatggaggacaagacccccgtggagagctgggaggaggtgccctacctggggaagcgcgaggaccagtggtgcggcagcctgatcgggctcacctcccgggccacgtgggccaagaacatccagaccgcgatcaaccaggtccgcagcctgatcggcaacgaggagtacaccgactacatgccctccatgaagcggttccgccgggaggaggaggaggccggcgtgctgtggtga

SEQ ID NO: 9012 - RNA, 9876 nt, synthetic construct
  misc_feature 1..9876: note = derived and/or modified CDS sequence (opt1) from DENV-2__JX669485__SS-prME
  source 1..9876: mol_type = other RNA
accgcgggggtgatcatcatgctgatccccaccgccatggcgttccacctcaccacccgcaacggggagccccacatgatcgtcggcaagcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccgccgggagaagcgctccgtcgccctggtgccccacgtggggatgggcctcgagacccggaccgagacctggatgagctccgagggggcctggaagcacgtccagcgcatcgagacctggatcctgcggcacccgggcttcgccatcatggcggccatcctggcctacaccatcgggaccacccacttccagcgcgccctcatcttcatcctgctgacggcggtggcccccagcatgaccatgcggtgcatcggcatctccaaccgcgacttcgtggagggcgtcagcgggggctcctgggtggacatcgtgctcgagcacgggagctgcgtcaccaccatggccaagaacaagcccacgctggacttcgagctgatcaagaccgaggccaagcagcccgccaccctccggaagtactgcatcgaggcgaagctgaccaacacgaccaccgagtcccgctgcccgacccagggcgagcccagcctgaacgaggagcaggacaagcggttcatctgcaagcactccatggtggaccgcggctgggggaacggctgcggcctcttcggcaagggcgggatcgtgacgtgcgccatgttcacgtgcaagaagaacatggagggcaaggtcgtgctgcccgagaacctggagtacaccatcgtgatcacgccccacagcggggaggagcacgccgtcggcaacgacacggggaagcacggcaaggagatcaagatcaccccgcagtccagcatcaccgaggccgagctcaccgggtacggcaccgtgacgatggagtgcagcccccggaccggcctggacttcaacgagatggtgctgctccagatggaggagaaggcctggctggtccaccgccagtggttcctggacctccccctgccctggctgccgggggcggacacccagggcagcaactggatccagaaggagaccctcgtgacgttcaagaacccccacgccaagaagcaggacgtggtcgtgctggggtcccaggagggcgccatgcacaccgccctgaccggggccaccgagatccagatgagcagcggcaacctcctgttcacgggccacctgaagtgccggctccgcatggacaagctgcagctgaaggggatgtcctacagcatgtgcaccggcaagttcaagatcgtcaaggagatcgcggagacccagcacgggaccatcgtgatccgggtgcagtacgagggcgacggctccccctgcaagatccccttcgagatcatggacctcgagaagcgccacgtcctggggcggctgatcacggtgaacccgatcgtgaccgagaaggacagccccgtcaacatcgaggccgagccgcccttcggcgactcctacatcatcatcggggtggagccgggccagctcaagctgaactggttcaagaaggggagctccatcggccagatgttcgagaccaccatgcgcggcgccaagcgcatggccatcctgggggacacggcctgggacttcggcagcctcgggggcgtgttcacctccatcgggaaggcgctgcaccaggtcttcggcgccatctacggcgccgccttcagcggggtgtcctggaccatgaagatcctgatcggcgtgatcatcacctggatcgggatgaacagccggtccacgagcctgtccgtcagcctcgtgctggtgggcgtcgtgaccctgtacctcggggcgatggtgcaggccgactccggctgcgtcgtgagctggaagaacaaggagctgaagtgcggctccgggatcttcatcaccgacaacgtgcacacctggacggagcagtacaagttccagcccgagagccccagcaagctggcctccgccatccagaaggcccacgaggagggcatctgcgggatccgcagcgtcacccggctcgagaacctgatgtggaagcagatcacccccgagctgaaccacatcctctccgagaacgaggtgaagctgaccatcatgacgggcgacatcaaggggatcatgcaggcgggcaagcgcagcctgcggccgcagcccaccgagctcaagtactcctggaagacctggggcaaggccaagatgctgagcaccgagtcccacaaccagacgttcctgatcgacgggcccgagaccgccgagtgcccgaacaccaaccgcgcctggaacagcctcgaggtggaggactacggcttcggggtcttcaccacgaacatctggctgaagctgcgggagaagcaggacgtgttctgcgactccaagctcatgagcgccgcgatcaaggacaaccgcgccgtgcacgccgacatgggctactggatcgagtccgccctgaacggcacctggaagatggagaaggccagcttcatcgaggtcaagtcctgccactggcccaagagccacaccctgtggtccaacggggtgctcgagagcgagatgatcatccccaagaacttcgcgggccccgtgtcccagcacaactaccggccggggtaccacacccagaccgccggcccctggcacctggggaagctggagatggacttcgacttctgcgagggcacgaccgtcgtggtgaccgaggactgcggcaaccgcgggcccagcctccggaccacgaccgccagcggcaagctgatcaccgagtggtgctgccgctcctgcaccctgcccccgctccggtaccgcggggaggacggctgctggtacgggatggagatccggcccctgaaggagaaggaggagaacctggtcaacagcctcgtgacggccggccacggccagatcgacaacttctccctgggggtgctgggcatggccctcttcctggaggagatgctgcgcacccgggtcgggaccaagcacgccatcctcctggtggccgtgagcttcgtcaccctgatcacgggcaacatgtccttccgcgacctcgggcgggtgatcgtgatggtcggcgtgaccatgaccgacgacatcggcatgggggtgacctacctggccctgctcgccgcgttcaaggtccgccccacgttcgccgccggcctgctgctccgcaagctgaccagcaaggagctgatgatggccaccatcgggatcaccctcctgtcccagagcacgatccccgagaccatcctggagctcaccgacgccctggcgctgggcatgatggtgctcaagatcgtgcggaacatggagaagtaccagctggccgtcaccatcatggccatctcctgcgtgccgaacgccgtgatcctgctcaacgcctggaaggtcagctgcacgatcctggcggtggtctccgtgagccccctgctcctgacctccagccagcagaagaccgactggatccccctggccctcaccatcaagggcctgaaccccacggccatcttcctgaccaccctctcccgcaccagcaagaagcggtcctggccgctgaacgaggccgtgatggcggtcgggatggtgagcatcctggcctccagcctcctgaagaacgacatccccatgacgggccccctggtggccgggggcctcctgaccgtctgctacgtgctgaccgggcgcagcgccgacctcgagctggagcgggccgcggacgtgaagtgggaggaccaggccgagatctccggcagctcccccatcctgagcatcaccatctccgaggacggcagcatgtccatcaagaacgaggaggaggagcagacgctcaccatcctgatccgcaccgggctgctcgtcatcagcggcgtgttcccggtgtccatccccatcaccgccgccgcctggtacctgtgggaggtcaagaagcagcgggcgggggtgctgtgggacgtgcccagcccgccgcccgtcgagaaggccgagctcgaggacggcgcctaccgcatcaagcagcgggggatcctgggctactcccagatcggcgccggggtgtacaaggagggcaccttccacacgatgtggcacgtgacccgcggggccgtcctgatgcaccggggcaagcgcatcgagcccagctgggcggacgtgaagaaggacctcatctcctacgggggcggctggaagctggagggggagtggaaggagggcgaggaggtgcaggtcctggccctcgagcccgggaagaacccccgggccgtgcagaccaagcccggcctgttcaagaccaacacggggaccatcggcgccgtgagcctggacttctcccccggcaccagcgggtcccccatcgtcgaccgcaagggcaaggtggtggggctctacggcaacggcgtcgtgacccggagcggggcctacgtgtccgcgatcgcccagacggagaagtccatcgaggacaaccccgagatcgaggacgacatcttccgcaagaagcggctgaccatcatggacctgcaccccggcgccgggaagaccaagcgctacctgcccgccatcgtccgggaggcgatcaagcgcggcctccggaccctgatcctggccccgacgcgcgtggtggccgccgagatggaggaggccctccgcgggctgcccatccggtaccagacccccgcgatccgcgccgagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgcggcccgcggctacatcagcacccgggtcgagatgggggaggccgccggcatcttcatgaccgccacgccgcccgggtcccgcgacccgttcccccagagcaacgcgcccatcatggacgaggagcgggagatccccgagcgctcctggaacagcggccacgagtgggtgaccgacttcaaggggaagaccgtgtggttcgtcccgtccatcaaggccggcaacgacatcgccgcctgcctccggaagaacggcaagaaggtgatccagctgagccgcaagaccttcgactccgagtacgtgaagacgcgggcgaacgactgggacttcgtcgtgaccaccgacatcagcgagatgggggccaacttcaaggccgagcgcgtgatcgacccccggcgctgcatgaagcccgtcatcctgaccgacggcgaggagcgggtgatcctcgccgggcccatgccggtgacgcactccagcgccgcgcagcgccggggccgcgtcgggcgcaaccccaagaacgagaacgaccagtacatctacatgggcgagcccctggagaacgacgaggactgcgcccactggaaggaggccaagatgctgctcgacaacatcaacacccccgagggcatcatcccgtccatgttcgagcccgagcgggagaaggtggacgccatcgacggggagtaccgcctgcggggcgaggcccgcaagaccttcgtggacctgatgcggcgcggggacctccccgtctggctggcgtaccgggtggccgccgagggcatcaactacgccgaccgccggtggtgcttcgacgggatcaagaacaaccagatcctggaggagaacgtcgaggtggagatctggaccaaggagggcgagcgcaagaagctcaagccgcggtggctggacgcccgcatctacagcgaccccctggcgctcaaggagttcaaggagttcgccgccggccggaagtccctgacgctgaacctcatcaccgagatggggcgcctgcccaccttcatgacccagaaggcccgggacgcgctggacaacctcgccgtgctgcacacggccgaggccggcgggcgcgcctacaaccacgcgctgagcgagctccccgagaccctggagaccctgctcctgctgaccctcctggccacggtcaccggcggcatcttcctgttcctcatgtccgggaagggcatcgggaagatgaccctgggcatgtgctgcatcatcaccgccagcatcctgctctggtacgcccagatccagccgcactggatcgccgcgtccatcatcctggagttcttcctgatcgtgctcctgatccccgagcccgagaagcagcggacgccccaggacaaccagctgacgtacgtggtcatcgccatcctcaccgtggtggccgccaccatggccaacgagatggggttcctggagaagaccaagaaggacctgggcctcggcagcatcacgacccaggagagcgagtccaacatcctggacatcgacctgcgcccggcgagcgcctggaccctctacgccgtcgccaccacgttcgtgacccccatgctgcggcactccatcgagaacagctccgtgaacgtcagcctgaccgccatcgcgaaccaggccaccgtgctcatggggctgggcaaggggtggcccctgtccaagatggacatcggcgtgcccctcctggccatcgggtgctacagccaggtcaacccgatcacgctgaccgccgcgctcctgctgctcgtggcccactacgccatcatcggccccggcctgcaggccaaggccacccgcgaggcgcagaagcgggccgccgccgggatcatgaagaaccccaccgtggacggcatcacggtcatcgacctggagcccatcccgtacgaccccaagttcgagaagcagctcggccaggtgatgctgctgatcctctgcgtgacccaggtcctgatgatgcgcaccacctgggccctgtgcgaggcgctcacgctggccaccggccccatctccaccctgtgggaggggaaccccggccgcttctggaacaccacgatcgccgtgagcatggccaacatcttccggggctcctacctcgccggggcgggcctgctgttcagcatcatgaagaacaccaccaacacccgccgggggacgggcaacatcggcgagaccctcggggagaagtggaagtcccgcctgaacgccctgggcaagagcgagttccagatctacaagaagtccgggatccaggaggtggaccggaccctcgccaaggagggcatcaagcgcggggagaccgaccaccacgccgtcagccggggctccgcgaagctgcgctggttcgtggagcggaacatggtgacgccggagggcaaggtcgtggacctggggtgcggccgcgggggctggagctactactgcgggggcctcaagaacgtgcgggaggtcaagggcctgaccaagggcgggcccgggcacgaggagcccatccccatgtccacctacggctggaacctggtgcgcctccagagcggggtggacgtcttcttcaccccgcccgagaagtgcgacacgctgctgtgcgacatcggcgagagctcccccaaccccaccatcgaggccggccggaccctccgcgtgctgaacctggtggagaactggctcaacaacaacacccagttctgcatcaaggtcctgaacccgtacatgcccagcgtgatcgagaagatggagaccctgcagcggaagtacgggggcgccctggtgcgcaaccccctctcccggaacagcacgcacgagatgtactgggtctccaacgccaccgggaacatcgtgagctccgtgaacatgatcagccgcatgctgatcaaccggttcaccatgaagcacaagaaggccacctacgagctggacgtcgacctcggctccgggacgcgcaacatcggcatcgagagcgagaccccgaacctggacatcatcggcaagcgcatcgagaagatcaagcaggagcacgagacctcctggcactacgaccaggaccacccctacaagacctgggcgtaccacgggagctacgagacgaagcagaccggctccgccagctccatggtgaacggggtggtccggctgctcaccaagccctgggacgtggtgcccatggtcacccagatggccatgacggacaccaccccgttcggccagcagcgcgtgttcaaggagaaggtggacacccggacgcaggagcccaaggagggcaccaagaagctgatgcgcatcaccgccgagtggctgtggaaggagctcgggaagaagaagacgccccggatgtgcacgcgcgaggagttcacccggaaggtccgcagcaacgccgcgctgggcgccatcttcaccgacgagaacaagtggaagtccgcccgggaggccgtggaggacagccgcttctgggagctggtcgaccgggagcgcaacctccacctggaggggaagtgcgagacctgcgtgtacaacatgatgggcaagcgggagaagaagctgggggagttcggcaaggccaagggctcccgcgcgatctggtacatgtggctcggggcccggttcctggagttcgaggccctgggcttcctcaacgaggaccactggttcagccgcgggaacagcctgtccggcgtggagggggagggcctgcaccggctcggctacatcctgcgcgacgtcagcaagaaggagggcggggccatgtacgcggacgacacggccgggtgggacacccggatcaccctggaggacctcaagaacgaggagatggtgaccaaccacatgaagggcgagcacaagaagctggccgaggccatcttcaagctgacgtaccagaacaaggtggtccgcgtgcagcggcccaccccgcgcgggaccgtgatggacatcatctcccgccgggaccagcgcggcagcggccaggtcgggacctacggcctcaacacgttcaccaacatggaggcccagctgatccggcagatggagggggagggcatcttcaagtccatccagcacctgaccgtgaccgaggagatcgcggtgcagaactggctcgcccgcgtcggccgggagcgcctgagccggatggccatctccggggacgactgcgtggtgaagcccctggacgaccgcttcgccagcgccctcacggcgctgaacgacatgggcaaggtccggaaggacatccagcagtgggagccctcccgcgggtggaacgactggacccaggtgcccttctgcagccaccacttccacgagctggtgatgaaggacggccgggtcctcgtggtgccgtgccgcaaccaggacgagctgatcgggcgggcccgcatctcccagggcgccggctggagcctgaaggagaccgcctgcctcgggaagtcctacgcccagatgtggaccctgatgtacttccaccggcgcgacctgcggctcgcggccaacgccatctgcagcgccgtcccctcccactgggtgcccaccagccgcacgacctggtccatccacgccaagcacgagtggatgaccaccgaggacatgctggcggtgtggaaccgggtctggatccaggagaacccctggatggaggacaagacgccggtggagagctgggaggaggtgccctacctgggcaagcgcgaggaccagtggtgcgggagcctcatcggcctgacctcccgcgccacctgggccaagaacatccagaccgccatcaaccaggtccggagcctgatcgggaacgaggagtacacggactacatgccctccatgaagcgcttccggcgcgaggaggaggaggcgggcgtgctctggtga

SEQ ID NO: 9013 - RNA, 9876 nt, synthetic construct
  misc_feature 1..9876: note = derived and/or modified CDS sequence (opt1) from DENV-2__JX669486__SS-prME
  source 1..9876: mol_type = other RNA
accgcgggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcgccatcatggcggccatcctggcctacaccatcgggaccacccacttccagcgggccctcatcttcatcctgctgaccgcggtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgccaccctccgcaagtactgcatcgaggcgaagctgaccaacacgaccaccgagtcccggtgcccgacccagggcgagcccagcctgaacgaggagcaggacaagcgcttcatctgcaagcactccatggtggaccggggctgggggaacggctgcggcctgttcggcaagggcgggatcgtgacgtgcgccatgttcacgtgcaagaagaacatggagggcaaggtcgtgctgcccgagaacctggagtacaccatcgtgatcacgccccacagcggggaggagcacgccgtcggcaacgacacggggaagcacggcgaggagatcaagatcaccccgcagtccagcatcaccgaggccgagctcaccgggtacggcaccgtgacgatggagtgcagcccccggaccggcctggacttcaacgagatggtgctgctccagatggaggagaaggcctggctggtccaccggcagtggttcctggacctccccctgccctggctgccgggggcggacacccagggcagcaactggatccagaaggagaccctcgtgacgttcaagaacccccacgccaagaagcaggacgtggtcgtgctggggtcccaggagggcgccatgcacaccgccctgaccggggccaccgagatccagatgagcagcggcaacctcctgttcacgggccacctgaagtgccgcctccggatggacaagctgcagctgaaggggatgtcctacagcatgtgcaccggcaagttcaagatcgtcaaggagatcgcggagacccagcacgggaccatcgtgatccgcgtgcagtacgagggcgacggctccccctgcaagatccccttcgagatcatggacctcgagaagcggcacgtcctggggcgcctgatcacggtgaacccgatcgtgaccgagaaggacagccccgtcaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtgttcacctccatcgggaaggcgctgcaccaggtcttcggcgccatctacggcgccgccttcagcggggtgtcctggaccatgaagatcctgatcggcgtgatcatcacctggatcgggatgaacagccgctccacgagcctgtccgtcagcctcgtgctggtgggcgtcgtgaccctgtacctcggggcgatggtgcaggccgactccggctgcgtcgtgagctggaagaacaaggagctgaagtgcggctccgggatcttcatcaccgacaacgtgcacacctggacggagcagtacaagttccagcccgagagccccagcaagctggcctccgccatccagaaggcccacgaggagggcatctgcgggatccggagcgtcacccgcctcgagaacctgatgtggaagcagatcacccccgagctgaaccacatcctctccgagaacgaggtgaagctgaccatcatgacgggcgacatcaaggggatcatgcaggcgggcaagcggagcctgcgcccgcagcccaccgagctcaagtactcctggaagacctggggcaaggccaagatgctgagcaccgagtcccacaaccagacgttcctgatcgacgggcccgagaccgccgagtgcccgaacaccaaccgggcctggaacagcctcgaggtggaggactacggcttcggggtcttcaccacgaacatctggctgaagctgcgcgagaagcaggacgtgttctgcgactccaagctcatgagcgccgcgatcaaggacaaccgggccgtgcacgccgacatgggctactggatcgagtccgccctgaacgacacctggaagatggagaaggccagcttcatcgaggtcaagtcctgccactggcccaagagccacaccctgtggtccaacggcgtgctcgagagcgagatgatcatccccaagaacttcgcggggcccgtgtcccagcacaactaccgcccgggctaccacacccagaccgccgggccctggcacctgggcaagctggagatggacttcgacttctgcgaggggacgaccgtcgtggtgaccgaggactgcggcaaccggggccccagcctccgcaccacgaccgccagcgggaagctgatcaccgagtggtgctgccggtcctgcaccctgcccccgctccgctaccggggcgaggacgggtgctggtacggcatggagatccgccccctgaaggagaaggaggagaacctggtcaacagcctcgtgacggccgggcacggccagatcgacaacttctccctgggcgtgctggggatggccctcttcctggaggagatgctgcggacccgcgtcggcaccaagcacgccatcctcctggtggccgtgagcttcgtcaccctgatcacggggaacatgtccttccgggacctcggccgcgtgatggtgatggtcggggtgaccatgaccgacgacatcggcatgggcgtgacctacctggccctgctcgccgcgttcaaggtccgccccacgttcgccgccgggctgctgctccggaagctgaccagcaaggagctgatgatggccaccatcggcatcaccctcctgtcccagagcacgacccccgagaccatcctggagctcaccgacgccctggcgctggggatgatggtgctcaagatcgtgcgcaacatggagaagtaccagctggccgtcacgatcatgaccatcctgtgcgtgccgaacgccgtgatcctcctgaacgcctggaaggtctcctgcaccatcctggccgtggtcagcgtgagccccctcctgctgaccagctcccagcagaagacggactggatccccctcgcgctgaccatcaagggcctgaaccccaccgccatcttcctcaccacgctgagccggacctccaagaagcgcagctggccgctgaacgaggccgtgatggccgtcggcatggtgtccatcctcgcgagctccctgctgaagaacgacatccccatgaccgggcccctcgtggccggcgggctgctgaccgtctgctacgtgctcacgggccggagcgccgacctggagctggagcgcgccgccgacgtgaagtgggaggaccaggcggagatcagcgggtccagccccatcctctccatcaccatcagcgaggacggctccatgagcatcaagaacgaggaggaggagcagaccctgaccatcctgatccggaccggcctcctggtcatctccggggtgttcccggtgagcatccccatcacggccgccgcctggtacctgtgggaggtcaagaagcagcgcgccggcgtgctctgggacgtgcccagcccgccgcccgtcgagaaggcggagctggaggacggggcctaccggatcaagcagcgcggcatcctggggtacagccagatcggcgccggcgtgtacaaggaggggaccttccacaccatgtggcacgtgacccggggcgccgtcctcatgcaccgcgggaagcggatcgagccctcctgggccgacgtgaagaaggacctgatcagctacggcgggggctggaagctggagggcgagtggaaggagggggaggaggtgcaggtcctcgcgctggagcccggcaagaacccccgcgccgtgcagacgaagcccgggctgttcaagaccaacaccggcaccatcggggccgtgtccctcgacttcagccccggcacgtccggcagccccatcgtcgaccggaaggggaaggtggtgggcctgtacgggaacggcgtcgtgacccgctccggcgcctacgtgagcgccatcgcgcagaccgagaagtccatcgaggacaaccccgagatcgaggacgacatcttccggaagaagcgcctgaccatcatggacctgcaccccggggccggcaagacgaagcggtacctccccgccatcgtccgcgaggccatcaagcgggggctgcgcaccctgatcctcgcgccgacccgcgtggtggccgccgagatggaggaggccctgcggggcctgcccatccgctaccagacccccgccatccgggcggagcacacggggcgcgagatcgtcgacctcatgtgccacgccaccttcaccatgcggctgctgagccccgtgcgcgtgccgaactacaacctcatcatcatggacgaggcccacttcaccgaccccgccagcatcgccgcgcggggctacatctccacgcgcgtcgagatgggcgaggccgccgggatcttcatgaccgccacgccgcccggcagccgggacccgttcccccagtccaacgcccccatcatggacgaggagcgcgagatccccgagcggagctggaactccgggcacgagtgggtgaccgacttcaagggcaagacggtgtggttcgtcccgagcatcaaggcggggaacgacatcgccgcctgcctgcgcaagaacggcaagaaggtgatccagctgtcccggaagaccttcgacagcgagtacgtgaagacccgcgccaacgactgggacttcgtcgtgaccacggacatctccgagatgggcgcgaacttccgggccgagcgcgtgatcgacccccggcgctgcatgaagcccgtcatcctcaccgacggggaggagcgggtgatcctggccggccccatgccggtgacccacagctccgccgcccagcgccgcgggcgggtcggccgcaaccccaagaacgagaacgaccagtacatctacatgggggagcccctggagaacgacgaggactgcgcgcactggaaggaggccaagatgctcctggacaacatcaacacccccgagggcatcatcccgagcatgttcgagcccgagcgggagaaggtggacgccatcgacggcgagtaccgcctgcgcggggaggcccgcaagacgttcgtggacctcatgcggcgcggcgacctgcccgtctggctggcctaccgggtggcggccgaggggatcaactacgccgaccgccggtggtgcttcgacggcatcaagaacaaccagatcctcgaggagaacgtcgaggtggagatctggaccaaggagggggagcgcaagaagctgaagccgcggtggctggacgcccgcatctactccgaccccctcgccctgaaggagttcaaggagttcgcggccggccggaagtccctgaccctcaacctgatcaccgagatgggccgcctgcccacgttcatgacccagaaggcccggaacgccctcgacaacctggcggtgctgcacaccgccgaggccgggggccgcgcctacaaccacgccctctccgagctgcccgagaccctggagacgctcctgctgctcaccctgctggcgaccgtcaccgggggcatcttcctcttcctgatgagcggcaaggggatcggcaagatgaccctggggatgtgctgcatcatcacggcctccgtgctcctgtggtacgcccagatccagccgcactggatcgccgccagcatcatcctggagttcttcctcatcgtgctgctgatccccgagcccgagaagcagcggacgccccaggacaaccagctcacctacgtcgtgatcgcgatcctgaccgtggtcgccgccacgatggccaacgagatgggcttcctggagaagaccaagaaggacctcgggctgggctccatcaccacccaggagagcgagagcaacatcctggacatcgacctccgcccggcctccgcgtggacgctgtacgccgtggccaccaccttcgtgacccccatgctgcggcacagcatcgagaactccagcgtcaacgtgtccctcacggccatcgccaaccaggcgaccgtgctgatgggcctggggaagggctggcccctcagcaagatggacatcggggtccccctgctggccatcggctgctactcccaggtgaacccgatcaccctcaccgccgccctgctgctcctggtggcgcactacgccatcatcgggcccggcctgcaggccaaggccacgcgcgaggcccagaagcgcgcggccgccggcatcatgaagaaccccaccgtcgacgggatcaccgtggtggacctcgagcccatcccgtacgaccccaagttcgagaagcagctgggccaggtcatgctgctcatcctgtgcgtgacccaggtgctgatgatgcggacgacctgggccctctgcgaggccctgaccctggcgaccgggcccatcagcacgctctgggagggcaaccccgggcgcttctggaacaccaccatcgccgtctccatggccaacatcttccggggcagctacctggccggcgccgggctcctcttctccatcatgaagaacaccacgaacacccgccggggcaccgggaacatcggcgagaccctgggcgagaagtggaagtcccgcctgaacgcgctcgggaagtccgagttccagatctacaagcggagcggcatccaggaggtggaccgcacgctggccaaggaggggatcaagcggggcgagaccgaccaccacgccgtgtcccgcgggagcgccaagctgcggtggttcgtcgagcgcaacatggtgaccccggagggcaaggtggtcgacctcggctgcgggcggggcgggtggtcctactactgcggcgggctgaagaacgtgcgcgaggtgaagggcctgaccaagggcgggcccggccacgaggagcccatccccatgagcacgtacgggtggaacctcgtccggctgcagtccggcgtggacgtgttcttcaccccgcccgagaagtgcgacaccctgctctgcgacatcggggagagcagccccaaccccaccatcgaggcgggccgcaccctgcgggtcctgaacctcgtggagaactggctgaacaacaacacgcagttctgcatcaaggtgctgaacccgtacatgccctccgtcatcgagaagatggagaccctgcagcgcaagtacggcggggccctcgtgcggaaccccctgagccgcaactccacccacgagatgtactgggtgagcaacgccaccggcaacatcgtctccagcgtgaacatgatctcccgcatgctgatcaaccggttcacgatgaagcacaagaaggccacctacgagccggacgtggacctcgggagcggcacccgcaacatcgggatcgagtccgagatccccaacctggacatcatcggcaagcggatcgagaagatcaagcaggagcacgagaccagctggcactacgaccaggaccacccctacaagacgtgggcctaccacggctcctacgagaccaagcagaccgggagcgcgtccagcatggtcaacggcgtggtgcgcctgctcaccaagccctgggacgtcgtgccgatggtgacgcagatggccatgaccgacaccacccccttcgggcagcagcgggtcttcaaggagaaggtggacacgcgcacccaggagcccaaggagggcaccaagaagctgatgcggatcaccgccgagtggctgtggaaggagctcggcaagaagaagacgccccgcatgtgcacccgggaggagttcacccgcaaggtccggtccaacgccgccctgggggcgatcttcaccgacgagaacaagtggaagtccgcccgcgaggccgtggaggactcccggttctgggagctggtggaccgcgagcggaacctccacctggagggcaagtgcgagacgtgcgtctacaacatgatggggaagcgcgagaagaagctgggcgagttcgggaaggccaagggcagccgggccatctggtacatgtggctcggcgcgcgcttcctggagttcgaggccctggggttcctcaacgaggaccactggttctcccggggcaacagcctgagcggggtggagggcgaggggctgcaccgcctcggctacatcctgcgggacgtgtccaagaaggagggcggggccatgtacgccgacgacaccgcgggctgggacacccgcatcaccctggaggacctcaagaacgaggagatggtcacgaaccacatgaagggggagcacaagaagctggccgaggccgtgttcaagctgacctaccagaacaaggtggtccgcgtgcagcggccgacgccccgcggcaccgtgatggacatcatcagccggcgcgaccagcgggggtccggccaggtcggcacgtacgggctcaacaccttcaccaacatggaggcccagctgatccgccagatggagggcgaggggatcttcaagagcatccagcacctgaccgtgacggaggagatcgccgtgcagaactggctcgcgcgggtcggccgcgagcggctgtcccgcatggccatcagcggcgacgactgcgtggtgaagcccctggacgaccggttcgcctccgccctcaccgccctgaacgacatggggaaggtccgcaaggacatccagcagtgggagcccagccggggctggaacgactggacccaggtgccgttctgctcccaccacttccacgagctggtgatgaaggacgggcgcgtcctcgtggtgccctgccggaaccaggacgagctgatcggccgcgcgcggatcagccagggggccggctggtccctgaaggagaccgcctgcctcggcaagagctacgcccagatgtggaccctgatgtacttccaccgccgggacctgcgcctcgccgcgaacgccatctgctccgccgtccccagccactgggtgcccacgtcccgcaccacctggagcatccacgccaagcacgagtggatgaccacggaggacatgctggccgtgtggaaccgggtctggatccaggagaacccgtggatggaggacaagacccccgtggagtcctgggaggaggtgccctacctggggaagcgcgaggaccagtggtgcggcagcctcatcgggctgaccagccgggcgacctgggccaagaacatccagacggccatcaaccaggtccgctccctgatcggcaacgaggagtacaccgactacatgcccagcatgaagcggttccgccgggaggaggaggaggccggggtgctctggtga

SEQ ID NO: 9014 - RNA, 9876 nt, synthetic construct
  misc_feature 1..9876: note = derived and/or modified CDS sequence (opt1) from DENV-2__JX669487__SS-prME
  source 1..9876: mol_type = other RNA
accgcgggcgtgatcatcatgctgatccccaccgcgatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcgccatcatggcggccatcctggcctacaccatcgggaccacccacttccagcgggccctcatcttcatcctgctgacggcggtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgccaccctccgcaagtactgcatcgaggcgaagctgaccaacacgaccaccgagtcccggtgcccgacccagggcgagcccagcctgaacgaggagcaggacaagcgcttcatctgcaagcactccatggtggaccggggctgggggaacggctgcggcctcttcggcaagggcgggatcgtgacgtgcgccatgttcacgtgcaagaagaacatggagggcaaggtcgtgctgcccgagaacctggagtacaccatcatgatcacgccccacagcggggaggagcacgccgtgggcaacgacacggggaagcacggcaaggagatcaagatcaccccgcagtccagcatcaccgaggccgagctcaccgggtacggcaccgtcacgatggagtgcagcccccgcaccggcctggacttcaacgagatggtgctgctccagatggaggagaaggcctggctggtgcaccggcagtggttcctggacctccccctgccctggctgccgggggcggacacccagggcagcaactggatccagaaggagaccctcgtcacgttcaagaacccccacgccaagaagcaggacgtggtggtcctggggtcccaggagggcgccatgcacaccgccctgaccggggccaccgagatccagatgagcagcggcaacctcctgttcacgggccacctgaagtgccgcctccggatggacaagctgcagctgaaggggatgtcctacagcatgtgcaccggcaagttcaagatcgtgaaggagatcgcggagacccagcacgggaccatcgtcatccgcgtgcagtacgagggcgacggctccccctgcaagatccccttcgagatcatggacctcgagaagcggcacgtgctggggcgcctgatcacggtcaacccgatcgtgaccgagaaggacagccccgtgaacatcgaggccgagccgcccttcggcgactcctacatcatcatcggggtcgagccgggccagctcaagctgaactggttcaagaaggggagctccatcggccagatgttcgagaccaccatgcgcggcgccaagcggatggccatcctgggggacacggcctgggacttcggcagcctcgggggcgtgttcacctccatcgggaaggcgctgcaccaggtgttcggcgccatctacggcgccgccttcagcggggtctcctggaccatgaagatcctgatcggcgtgatcatcacctggatcgggatgaacagccgctccacgagcctgtccgtgagcctcgtcctggtgggcgtggtcaccctgtacctcggggcgatggtgcaggccgactccggctgcgtggtcagctggaagaacaaggagctgaagtgcggctccgggatcttcatcaccgacaacgtgcacacctggacggagcagtacaagttccagcccgagagccccagcaagctggcctccgccatccagaaggcccacgaggagggcatctgcgggatccggagcgtgacccgcctcgagaacctgatgtggaagcagatcacccccgagctgaaccacatcctctccgagaacgaggtcaagctgaccatcatgacgggcgacatcaaggggatcatgcaggcgggcaagcggagcctgcgcccgcagcccaccgagctcaagtactcctggaagacctggggcaaggccaagatgctgagcaccgagtcccacaaccagacgttcctgatcgacgggcccgagaccgccgagtgcccgaacaccaaccgggcctggaacagcctcgaggtggaggactacggcttcggggtgttcaccacgaacatctggctgaagctgcgcgagaagcaggacgtcttctgcgactccaagctcatgagcgccgcgatcaaggacaaccgggccgtgcacgccgacatgggctactggatcgagtccgccctgaacgacacctggaagatggagaaggccagcttcatcgaggtgaagtcctgccactggcccaagagccacaccctgtggtccaacggcgtcctcgagagcgagatgatcatccccaagaacttcgcggggcccgtgtcccagcacaactaccgcccgggctaccacacccagaccgccgggccctggcacctgggcaagctggagatggacttcgacttctgcgaggggacgaccgtggtcgtgaccgaggactgcggcaaccggggccccagcctccgcaccacgaccgccagcgggaagctgatcaccgagtggtgctgccggtcctgcaccctgcccccgctccgctaccggggcgaggacgggtgctggtacggcatggagatccgccccctgaaggagaaggaggagaacctggtgaacagcctcgtcacggccgggcacggccagatcgacaacttctccctgggcgtgctggggatggccctcttcctggaggagatgctgcggacccgcgtgggcaccaagcacgccatcctcctggtcgccgtgagcttcgtgaccctgatcacggggaacatgtccttccgggacctcggccgcgtcatggtgatggtgggggtcaccatgaccgacgacatcggcatgggcgtgacctacctggccctgctcgccgcgttcaaggtgcgccccacgttcgccgccgggctgctgctccggaagctgaccagcaaggagctgatgatggccaccatcggcatcgccctcctgtcccagagcaccatccccgagacgatcctggagctcaccgacgcgctggccctggggatgatggtcctccgcatcgtgcggaacatggagaagtaccagctggccgtgaccatcatggccatctcctgcgtcccgaacgccgtgatcctgctcaacgcgtggaaggtgagctgcaccatcctggccgccgtctccgtgagccccctgctcctgacgtccagccagcagaagaccgactggatccccctggccctcaccatcaagggcctgaaccccaccgcgatcttcctgacgaccctctcccgcaccagcaagaagcggtcctggccgctgaacgaggccgtcatggccgtgggcatggtgagcatcctggcctccagcctcctgaagaacgacatccccatgaccgggcccctggtcgccggcgggctcctgacggtgtgctacgtgctgaccggccgcagcgcggacctcgagctggagcgggccgccgacgtcaagtgggaggaccaggccgagatctccgggagctcccccatcctgagcatcaccatctccgaggacggcagcatgtccatcaagaacgaggaggaggagcagaccctcacgatcctgatccgcaccggcctgctcgtgatcagcggggtgttcccggtctccatccccatcaccgccgcggcctggtacctgtgggaggtgaagaagcagcgggccggcgtgctgtgggacgtccccagcccgccgcccgtggagaaggccgagctcgaggacggggcctaccgcatcaagcagcggggcatcctggggtactcccagatcggcgcgggcgtgtacaaggaggggaccttccacaccatgtggcacgtcacgcgcggcgccgtgctgatgcaccgggggaagcgcatcgagcccagctgggccgacgtgaagaaggacctcatctcctacggcgggggctggaagctggagggcgagtggaaggagggggaggaggtccaggtgctggccctcgagcccggcaagaacccccgggccgtgcagaccaagcccgggctgttcaagaccaacaccggcacgatcggggcgatcagcctggacttctcccccggcaccagcggctcccccatcgtcgaccgcaaggggaaggtggtgggcctctacgggaacggcgtcgtgacccggagcggcgcctacgtgtccgccatcgcccagaccgagaagtccatcgaggacaaccccgagatcgaggacgacatcttccgcaagaagcggctgacgatcatggacctgcaccccggggcgggcaagaccaagcgctacctgcccgccatcgtccgggaggccatcaagcgcgggctccgcaccctgatcctggccccgacccgggtggtggccgcggagatggaggaggccctccgcggcctgcccatccggtaccagacgcccgccatccgcgccgagcacaccgggcgggagatcgtcgacctgatgtgccacgccaccttcaccatgcgcctcctgagccccgtgcgggtgccgaactacaacctgatcatcatggacgaggcgcacttcacggaccccgcctccatcgccgcccgcggctacatcagcacccgggtcgagatgggcgaggccgcggggatcttcatgaccgccacgccgcccggctcccgcgacccgttcccccagagcaacgcccccatcatggacgaggagcgggagatccccgagcgctcctggaacagcgggcacgagtgggtgacggacttcaagggcaagaccgtgtggttcgtcccgtccatcaaggccgggaacgacatcgcggcctgcctccggaagaacggcaagaaggtgatccagctgagccgcaagaccttcgactccgagtacgtgaagacccgggccaacgactgggacttcgtcgtgacgaccgacatcagcgagatgggcgccaacttccgcgccgagcgggtgatcgacccccgccggtgcatgaagcccgtcatcctgaccgacggggaggagcgcgtgatcctcgcgggccccatgccggtgacccactccagcgccgcccagcgccgggggcgcatcggccggaaccccaagaacgagaacgaccagtacatctacatgggggagcccctggagaacgacgaggactgcgcccactggaaggaggccaagatgctgctcgacaacatcaacacgcccgagggcatcatcccgtccatgttcgagcccgagcgcgagaaggtcgacgcgatcgacggcgagtaccggctgcgcggggaggcccggaagaccttcgtggacctgatgcgccggggcgacctccccgtgtggctggcctaccgcgtcgccgccgaggggatcaactacgcggaccggcgctggtgcttcgacggcatcaagaacaaccagatcctggaggagaacgtggaggtggagatctggaccaaggagggggagcggaagaagctcaagccgcgctggctggacgcccggatctacagcgaccccctggccctcaaggagttcaaggagttcgccgcgggccgcaagtccctgaccctgaacctcatcacggagatgggccggctgcccaccttcatgacccagaaggcccgcgacgccctggacaacctcgccgtcctgcacaccgccgaggccggcgggcgggcctacaagcacgccctgagcgagctccccgagacgctggagaccctgctcctgctgaccctcctggccaccgtgaccggcgggatcttcctgttcctcatgtccgggaaggggatcggcaagatgaccctggggatgtgctgcatcatcaccgccagcatcctgctctggtacgcgcagatccagccgcactggatcgccgcctccatcatcctggagttcttcctgatcgtcctcctgatccccgagcccgagaagcagcgcacgccccaggacaaccagctgacctacgtggtgatcgccatcctcacggtcgtggccgcgaccatggccaacgagatgggcttcctggagaagaccaagaaggacctggggctcggcagcatcaccacgcaggagagcgagtccaacatcctggacatcgacctgcggccggccagcgcctggaccctctacgccgtggcgaccaccttcgtcacgcccatgctgcgccactccatcgagaacagctccgtgaacgtgagcctgaccgccatcgccaaccaggccaccgtcctcatgggcctggggaagggctggcccctgtccaagatggacatcggggtgcccctcctggcgatcggctgctacagccaggtgaacccgatcaccctgacggccgccctcctgctgctcgtcgcccactacgccatcatcgggcccggcctgcaggcgaaggccacccgcgaggcccagaagcgggccgccgcgggcatcatgaagaaccccaccgtggacgggatcaccgtgatcgacctggagcccatcccgtacgaccccaagttcgagaagcagctcggccaggtcatgctgctgatcctctgcgtgacccaggtgctgatgatgcgcaccacctgggccctgtgcgaggccctcaccctggccacggggcccatctccaccctgtgggagggcaaccccgggcggttctggaacaccaccatcgccgtcagcatggcgaacatcttccgcggctcctacctcgccggcgccgggctgctgttcagcatcatgaagaacacgaccaacacccggcgcggcaccgggaacatcggcgagacgctcggcgagaagtggaagtcccggctgaacgccctgggcaagagcgagttccagatctacaagaagtccggcatccaggaggtggaccgcaccctcgcgaaggaggggatcaagcggggcgagaccgaccaccacgccgtgagccgcgggtccgccaagctgcggtggttcgtcgagcgcaacatggtgaccccggagggcaaggtggtcgacctgggctgcgggcggggcgggtggagctactactgcggcgggctcaagaacgtgcgcgaggtgaagggcctgacgaagggcgggcccggccacgaggagcccatccccatgtccacctacgggtggaacctggtccggctccagagcggcgtggacgtgttcttcaccccgcccgagaagtgcgacaccctgctgtgcgacatcggggagagctcccccaaccccacgatcgaggccggccgcaccctccgggtcctgaacctggccgagaactggctcaacaacaacacccagttctgcatcaaggtgctgaacccgtacatgcccagcgtgatcgagaagatggagaccctgcagcgcaagtacggcggggcgctggtccggaaccccctctcccgcaacagcacccacgagatgtactgggtgtccaacgccacgggcaacatcgtgagctccgtcaacatgatcagccgcatgctgatcaaccggttcaccatgaagcacaagaaggccacctacgagccggacgtggacctggggtccggcacccgcaacatcgggatcgagagcgagatccccaacctcgacatcatcggcaagcggatcgagaagatcaagcaggagcacgagacgtcctggcactacgaccaggaccacccctacaagacctgggcctaccacggcagctacgagaccaagcagaccgggtccgccagctccatggtgaacggcgtcgtgcgcctgctgacgaagccctgggacgtggtcccgatggtgacccagatggcgatgaccgacaccacgcccttcgggcagcagcgggtgttcaaggagaaggtcgacacccgcacccaggagcccaaggagggcaccaagaagctcatgcggatcacggccgagtggctgtggaaggagctgggcaagaagaagacgccccgcatgtgcacccgggaggagttcacccgcaaggtgcggagcaacgccgccctcggggccatcttcacggacgagaacaagtggaagtccgcgcgcgaggccgtggaggacagccggttctgggagctggtcgaccgcgagcggaacctgcacctcgagggcaagtgcgagacctgcgtgtacaacatgatggggaagcgcgagaagaagctgggcgagttcgggaaggccaagggctcccgggccatctggtacatgtggctgggcgcgcgcttcctcgagttcgaggccctggggttcctgaacgaggaccactggttcagccggggcaacagcctctccggggtggagggcgaggggctgcaccgcctgggctacatcctccgggacgtcagcaagaaggagggcggggccatgtacgccgacgacaccgccggctgggacacccgcatcacgctggaggacctgaagaacgaggagatggtgaccaaccacatgaagggggagcacaagaagctcgcggaggccatcttcaagctgacctaccagaacaaggtcgtgcgcgtgcagcggccgacgccccgcggcacggtcatggacatcatctcccggaaggaccagcgcgggagcggccaggtgggcacctacgggctgaacaccttcaccaacatggaggcccagctcatccggcagatggagggcgaggggatcttcaagtccatccagcacctgacggtgaccgaggagatcgccgtccagaactggctggcccgcgtgggccgggagcgcctcagccggatggcgatctccggcgacgactgcgtggtcaagcccctggacgaccgcttcgccagcgccctgaccgccctcaacgacatggggaaggtgcggaaggacatccagcagtgggagccctcccgcggctggaacgactggacccaggtgccgttctgcagccaccacttccacgagctggtcatgaaggacgggcgggtgctggtggtcccctgccgcaaccaggacgagctcatcggccgggcccgcatctcccagggggcgggctggagcctgaaggagacggcctgcctgggcaagtcctacgcccagatgtggaccctcatgtacttccaccggcgcgacctgcggctggccgccaacgcgatctgcagcgccgtgccctcccactgggtgcccaccagccgcaccacctggtccatccacgccaagcacgagtggatgacgaccgaggacatgctcgccgtctggaaccgcgtgtggatccaggagaacccgtggatggaggacaagacccccgtggagagctgggaggaggtcccctacctggggaagcgggaggaccagtggtgcggcagcctgatcgggctcacctcccgcgcgacgtgggccaagaacatccagaccgccatcaaccaggtgcggagcctgatcggcaacgaggagtacaccgactacatgccctccatgaagcgcttccggcgcgaggaggaggaggccggggtgctgtggtga

SEQ ID NO: 9015 - RNA, 9876 nt, synthetic construct
  misc_feature 1..9876: note = derived and/or modified CDS sequence (opt1) from DENV-2__JX669488__SS-prME
  source 1..9876: mol_type = other RNA
accgcgggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacgtggatcctgcgccacccgggcttcgccatcatggcggccatcctggcctacaccatcgggaccacccacttccagcgggccctcatcttcatcctgctgacggcggtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgccaccctccgcaagtactgcatcgaggcgaagctgaccaacacgaccaccgagtcccggtgcccgacccagggcgagcccagcctgaacgaggagcaggacaagcgcttcatctgcaagcactccatggtggaccggggctgggggaacggctgcggcctcttcggcaagggcgggatcgtgacgtgcgccatgttcacgtgcaagaagaacatggagggcaaggtcgtgctgcccgagaacctggagtacaccatcgtgatcacgccccacagcggggaggagcacgccgtcggcaacgacacggggaagcacggcaaggagatcaagatcaccccgcagtccagcatcaccgaggccgagctcaccgggtacggcaccgtgacgatggagtgcagcccccgcaccggcctggacttcaacgagatggtgctgctccagatggaggagaaggcctggctggtccaccggcagtggttcctggacctccccctgccctggctgccgggggcggacacccagggcagcaactggatccagaaggagaccctcgtgacgttcaagaacccccacgccaagaagcaggacgtggtcgtgctggggtcccaggagggcgccatgcacaccgccctgaccggggccaccgagatccagatgagcagcggcaacctcctgttcacgggccacctgaagtgccgcctccggatggacaagctgcagctgaaggggatgtcctacagcatgtgcaccggcaagttcaagatcgtcaaggagatcgcggagacccagcacgggaccatcgtgatccgcgtgcagtacgagggcgacggctccccctgcaagatccccttcgagatcatggacctcgagaagcggcacgtcctggggcgcctgatcacggtgaacccgatcgtgaccgagaaggacagccccgtcaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtgttcacctccatcgggaaggcgctgcaccaggtcttcggcgccatctacggcgccgccttcagcggggtgtcctggaccatgaagatcctgatcggcgtgatcatcacctggatcgggatgaacagccgctccacgagcctgtccgtcagcctcgtgctggtgggcgtcgtgaccctgtacctcggggcgatggtgcaggccgactccggctgcgtcgtgagctggaagaacaaggagctgaagtgcggctccgggatcttcatcaccgacaacgtgcacacctggacggagcagtacaagttccagcccgagagccccagcaagctggcctccgccatccagaaggcccacgaggagggcatctgcgggatccggagcgtcacccgcctcgagaacctgatgtggaagcagatcacccccgagctgaaccacatcctctccgagaacgaggtgaagctgaccatcatgacgggcgacatcaaggggatcatgcaggcgggcaagcggagcctgcgcccgcagcccaccgagctcaagtactcctggaagacctggggcaaggccaagatgctgagcaccgagtcccacaaccagacgttcctgatcgacgggcccgagaccgccgagtgcccgaacaccaaccgggcctggaacagcctcgaggtggaggactacggcttcggggtcttcaccacgaacatctggctgaagctgcgcgagaagcaggacgtgttctgcgactccaagctcatgagcgccgcgatcaaggacaaccgggccgtgcacgccgacatgggctactggatcgagtccgccctgaacgacacctggaagatggagaaggccagcttcatcgaggtcaagtcctgccactggcccaagagccacaccctgtggtccaacggcgtgctcgagagcgagatgatcatccccaagaacttcgcggggcccgtgtcccagcacaactaccgcccgggctaccacacccagaccgccgggccctggcacctgggcaagctggagatggacttcgacttctgcgaggggacgaccgtcgtggtgaccgaggactgcggcaaccggggccccagcctccgcaccacgaccgccagcgggaagctgatcaccgagtggtgctgccggtcctgcaccctgcccccgctccgctaccggggcgaggacgggtgctggtacggcatggagatccgccccctgaaggagaaggaggagaacctggtcaacagcctcgtgacggccgggcacggccagatcgacaacttctccctgggcgtgctggggatggccctcttcctggaggagatgctgcggacccgcgtcggcaccaagcacgccatcctcctggtggccgccagcttcgtgaccctgatcacggggaacatgtccttccgggacctcggccgcgtcatggtgatggtgggggccaccatgaccgacgacatcggcatgggcgtcacctacctggcgctgctcgccgccttcaaggtgcgccccacgttcgccgccgggctgctgctccggaagctgaccagcaaggagctgatgatggcgaccatcggcatcgccctcctgtcccagagcaccatccccgagacgatcctggagctcaccgacgccctggccctggggatgatggtgctccgcatcgtccggaacatggagaagtaccagctggccgtgaccatcatggcgatctcctgcgtgccgaacgccgtcatcctgctcaacgcctggaaggtgagctgcaccatcctggccgcggtgtccgtcagccccctgctcctgacgtccagccagcagaagaccgactggatccccctggccctcaccatcaagggcctgaaccccaccgccatcttcctgacgaccctctcccgcaccagcaagaagcggtcctggccgctgaacgaggccgtgatggccgtcggcatggtgagcatcctggcgtccagcctcctgaagaacgacatccccatgaccgggcccctggtggccggcgggctcctgacggtctgctacgtgctgaccggccgcagcgccgacctcgagctggagcgggccgccgacgtgaagtgggaggaccaggcggagatctccgggagctcccccatcctgagcatcaccatctccgaggacggcagcatgtccatcaagaacgaggaggaggagcagaccctcacgatcctgatccgcaccggcctgctcgtcatcagcggggtgttcccggtgtccatccccatcaccgccgccgcctggtacctgtgggaggtcaagaagcagcgggccggcgtgctgtgggacgtgcccagcccgccgcccgtcgagaaggcggagctcgaggacggggcctaccgcatcaagcagcggggcatcctggggtactcccagatcggcgccggcgtgtacaaggaggggaccttccacaccatgtggcacgtgacgcgcggcgccgtcctgatgcaccgggggaagcgcatcgagcccagctgggccgacgtgaagaaggacctcatctcctacggcgggggctggaagctggagggcgagtggaaggagggggaggaggtgcaggtcctggcgctcgagcccggcaagaacccccgggccgtgcagaccaagcccgggctgttcaagaccaacaccggcacgatcggggccatcagcctggacttctcccccggcaccagcggctcccccatcgtggaccgcaaggggaaggtcgtgggcctctacgggaacggcgtggtcacccggagcggcgcctacgtgtccgcgatcgcccagaccgagaagtccatcgaggacaaccccgagatcgaggacgacatcttccgcaagaagcggctgacgatcatggacctgcaccccggggccggcaagaccaagcgctacctgcccgccatcgtgcgggaggccatcaagcgcgggctccgcaccctgatcctggcgccgacccgggtcgtggccgccgagatggaggaggccctccgcggcctgcccatccggtaccagacgcccgccatccgcgcggagcacaccgggcgggagatcgtggacctgatgtgccacgccaccttcaccatgcgcctcctgagccccgtccgggtgccgaactacaacctgatcatcatggacgaggcccacttcacggaccccgcctccatcgccgcgcgcggctacatcagcacccgggtggagatgggcgaggccgccgggatcttcatgaccgccacgccgcccggctcccgcgacccgttcccccagagcaacgcgcccatcatggacgaggagcgggagatccccgagcgctcctggaacagcgggcacgagtgggtcacggacttcaagggcaagaccgtgtggttcgtgccgtccatcaaggccgggaacgacatcgccgcctgcctccggaagaacggcaagaaggtcatccagctgagccgcaagaccttcgactccgagtacgtgaagacccgggccaacgactgggacttcgtggtcacgaccgacatcagcgagatgggcgcgaacttccgcgccgagcgggtgatcgacccccgccggtgcatgaagcccgtgatcctgaccgacggggaggagcgcgtcatcctcgccggccccatgccggtgacccactccagcgccgcccagcgccgggggcgcatcggccggaaccccaagaacgagaacgaccagtacatctacatgggggagcccctggagaacgacgaggactgcgcgcactggaaggaggccaagatgctgctcgacaacatcaacacgcccgagggcatcatcccgtccatgttcgagcccgagcgcgagaaggtggacgccatcgacggcgagtaccggctgcgcggggaggcccggaagaccttcgtcgacctgatgcgccggggcgacctccccgtgtggctggcctacaaggtggcggccgaggggatcaactacgccgaccgccggtggtgcttcgacggcatcaagaacaaccagatcctggaggagaacgtcgaggtggagatctggaccaaggagggggagcgcaagaagctcaagccgcggtggctggacgcccgcatctacagcgaccccctggcgctcaaggagttcaaggagttcgccgccggccggaagtccctgaccctgaacctcatcacggagatgggccgcctgcccaccttcatgacccagaaggcccgggacgccctggacaacctcgcggtgctgcacaccgccgaggccgggggccgcgcctacaagcacgccctgagcgagctccccgagacgctggagaccctgctcctgctgaccctcctggcgaccgtcaccggcgggatcttcctgttcctcatgtccgggaaggggatcggcaagatgaccctggggatgtgctgcatcatcaccgccagcatcctgctctggtacgcccagatccagccgcactggatcgccgcctccatcatcctggagttcttcctgatcgtgctcctgatccccgagcccgagaagcagcggacgccccaggacaaccagctgacctacgtcgtgatcgcgatcctcacggtggtcgccgccaccatggccaacgagatgggcttcctggagaagaccaagaaggacctggggctcggcagcatcaccacgcaggagagcgagtccaacatcctggacatcgacctgcgcccggccagcgcgtggaccctctacgccgtggccaccaccttcgtgacgcccatgctgcggcactccatcgagaacagctccgtcaacgtgagcctgaccgccatcgcgaaccaggccaccgtgctcatgggcctggggaagggctggcccctgtccaagatggacatcggggtccccctcctggccatcggctgctacagccaggtgaacccgatcaccctgacggccgccctcctgctgctcgtggcgcactacgccatcatcgggcccggcctgcaggccaaggccacccgcgaggcccagaagcgcgcggccgccggcatcatgaagaaccccaccgtcgacgggatcaccgtgatcgacctggagcccatcccgtacgaccccaagttcgagaagcagctcggccaggtgatgctgctgatcctctgcgtcacccaggtgctgatgatgcggaccacctgggccctgtgcgaggccctcaccctggcgacggggcccatctccaccctgtgggagggcaaccccgggcgcttctggaacaccaccatcgccgtgagcatggccaacatcttccggggctcctacctcgccggcgcggggctgctgttcagcatcatgaagaacacggccaacacccgccggggcaccgggaacatcggcgagaccctcggcgagaagtggaagtcccgcctgaacgccctgggcaagagcgagttccagatctacaagaagtccggcatccaggaggtcgaccggacgctcgccaaggaggggatcaagcgcggcgagaccgaccaccacgccgtgagccgggggtccgcgaagctgcgctggttcgtggagcggaacatggtcaccccggagggcaaggtggtggacctgggctgcgggcgcggcgggtggagctactactgcggcgggctcaagaacgtccgggaggtgaagggcctgaccaagggcgggcccggccacgaggagcccatccccatgtccacgtacgggtggaacctggtgcgcctccagagcggcgtcgacgtgttcttcaccccgcccgagaagtgcgacaccctgctgtgcgacatcggggagagctcccccaaccccaccatcgaggccggccggacgctccgcgtgctgaacctggccgagaactggctcaacaacaacacccagttctgcatcaaggtcctgaacccgtacatgcccagcgtgatcgagaagatggagaccctgcagcggaagtacggcggggccctggtgcgcaaccccctctcccggaacagcacccacgagatgtactgggtctccaacgccaccggcaacatcgtgagctccgtgaacatgatcagccgcatgctgatcaaccgcttcacgatgaagcacaagaaggcgacctacgagccggacgtcgacctggggtccggcacccggaacatcgggatcgagagcgagatccccaacctcgacatcatcggcaagcgcatcgagaagatcaagcaggagcacgagacctcctggcactacgaccaggaccacccctacaagacgtgggcctaccacggcagctacgagaccaagcagaccgggtccgccagctccatggtgaacggcgtggtccggctgctgaccaagccctgggacgtggtgccgatggtcacgcagatggccatgaccgacaccacccccttcgggcagcagcgcgtgttcaaggagaaggtggacacgcggacccaggagcccaaggagggcaccaagaagctcatgcgcatcaccgccgagtggctgtggaaggagctgggcaagaagaagacgccccggatgtgcacccgcgaggagttcacccggaaggtccgcagcaacgcggccctcggggccatcttcaccgacgagaacaagtggaagtccgcccgggaggcggtggaggacagccgcttctgggagctggtggaccgggagcgcaacctgcacctcgagggcaagtgcgagacgtgcgtctacaacatgatggggaagcgggagaagaagctgggcgagttcgggaaggccaagggctcccgcgccatctggtacatgtggctgggcgcccggttcctcgagttcgaggccctggggttcctgaacgaggaccactggttcagccgcggcaacagcctctccggggtggagggcgaggggctgcaccggctgggctacatcctccgcgacgtgagcaagaaggagggcggggcgatgtacgccgacgacaccgccggctgggacacccggatcaccctggaggacctgaagaacgaggagatggtcacgaaccacatggagggggagcacaagaagctcgccgaggccatcttcaagctgacctaccagaacaaggtggtccgcgtgcagcgcccgacgccccggggcaccgtgatggacatcatctcccgcaaggaccagcgggggagcggccaggtcggcacgtacgggctgaacaccttcaccaacatggaggcgcagctcatccgccagatggagggcgaggggatcttcaagtccatccagcacctgaccgtgacggaggagatcgccgtgcagaactggctggcccgggtcggccgcgagcggctcagccgcatggccatctccggcgacgactgcgtggtgaagcccctggacgaccggttcgccagcgcgctgaccgccctcaacgacatggggaaggtccgcaaggacatccagcagtgggagccctcccggggctggaacgactggacccaggtgccgttctgcagccaccacttccacgagctggtgatgaaggacgggcgcgtcctggtggtgccctgccggaaccaggacgagctcatcggccgcgcccggatctcccagggggccggctggagcctgaaggagaccgcctgcctgggcaagtcctacgcgcagatgtggacgctcatgtacttccaccgccgggacctgcgcctggccgccaacgccatctgcagcgcggtcccctcccactgggtgcccaccagccggaccacctggtccatccacgccaagcacgagtggatgaccacggaggacatgctcgccgtgtggaaccgcgtctggatccaggagaacccgtggatggaggacaagacccccgtggagagctgggaggaggtgccctacctggggaagcgcgaggaccagtggtgcggcagcctgatcgggctcacctcccgggccacctgggccaagaacatccagacggcgatcaaccaggtccgcagcctgatcggcaacgaggagtacaccgactacatgccctccatgaagcggttccgccgggaggaggaggaggccggggtgctgtggtga

SEQ ID NO: 9016 - RNA, 9876 nt, synthetic construct
  misc_feature 1..9876: note = derived and/or modified CDS sequence (opt1) from DENV-2__JX669479__SS-prME
  source 1..9876: mol_type = other RNA
accgccggcgtgatcgtcatgctgatccccaccgccatggcgttccacctcaccacccgcaacggggagccccacatgatcgtgggccggcaggagaagggcaagagcctgctgttcaagaccgaggacggggtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccaccccggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgccccacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaagatcgtgcagagcgagaacctggagtacaccatcgtgatcacgccccactccggggaggagcacgccgtcggcaacgacaccgggaagcacggcaaggagatcaagatcacgccccagagctccaccaccgaggccgagctgacggggtacggcaccgtgaccatggagtgcagcccgcgcaccggcctcgacttcaacgagatggtgctgctgcagatggaggacaaggcctggctcgtccaccggcagtggttcctggacctgcccctcccctggctgcccggggccgacacgcagggctccaactggatccagaaggagaccctggtgaccttcaagaacccgcacgcgaagaagcaggacgtggtcgtgctcgggagccaggagggcgccatgcacaccgccctgacgggggccaccgagatccagatgagctccggcaacctcctgttcaccggccacctgaagtgccgcctgcggatggacaagctccagctgaaggggatgagctactccatgtgcaccggcaagttcaagatcgtcaaggagatcgccgagacgcagcacgggaccatcgtgatccgcgtgcagtacgagggcgacggcagcccctgcaagatccccttcgagatcaccgacctggagaagcggcacgtcctcgggcgcctgatcaccgtgaaccccatcgtgacggagaaggactccccggtcaacatcgaggcggagccgcccttcggcgacagctacatcatcgtgggggtggagcccggccagctgaagctcaactggttcaagaaggggtccagcatcggccagatgttcgagaccaccatgcgcggcgccaagcggatggccatcctgggggacaccgcctgggacttcggctccctcgggggcgtcttcacgagcatcgggaaggccctccaccaggtgttcggcgcgatctacggcgccgccttctccggggtgagctggaccatgaagatcctgatcggcgtcatcatcacctggatcgggatgaactcccgcagcacctccctgagcgtgtccctggtgctcgtcggcgtggtgacgctgtacctgggggccatggtccaggcggacagcggctgcatcgtgtcctggaagaacaaggagctcaagtgcggcagcgggatcttcatcaccgacaacgtgcacacctggaccgagcagtacaagttccagccggagagcccctccaagctggccagcgccatccagaaggcccacgaggagggcatctgcgggatccggtccgtcacgcgcctggagaacctcatgtggaagcagatcacccccgagctgaaccacatcctgagcgagaacgaggtgaagctcaccatcatgaccggcgacatcaaggggatcatgcaggccggcaagcggtccctgcgcccccagccgacggagctgaagtacagctggaagacctggggcaaggcgaagatgctctccaccgagagccacaaccagaccttcctgatcgacgggcccgagacggccgagtgccccaacaccaaccgggcctggaactccctggaggtggaggactacggcttcggggtcttcaccaccaacatctggctcaagctgcgcgagaagcaggacgtgttctgcgacagcaagctgatgtccgccgccatcaaggacaaccgggcggtgcacgccgacatgggctactggatcgagagcgccctcaacgacacctggaagatggagaaggcctccttcatcgaggtcaagagctgccactggccgaagtcccacacgctgtggagcaacggcgtgctggagtccgagatgatcatccccaagaacttcgccgggcccgtgagccagcacaactaccgccccggctaccacacccagaccgcggggccgtggcacctcggcaagctggagatggacttcgacttctgcgaggggaccacggtcgtggtgaccgaggactgcggcaaccggggccccagcctgcgcaccaccacggcctccgggaagctcatcaccgagtggtgctgccggagctgcaccctgccgcccctgcgctaccggggcgaggacgggtgctggtacggcatggagatccgcccgctcaaggagaaggaggagaacctggtcaactccctggtgaccgccgggcacggccagatcgacaacttcagcctcggcgtgctggggatggccctgttcctcgaggagatgctgcggacgcgcgtcggcaccaagcacgcgatcctgctcgtggccctgtccttcgtgaccctgatcaccgggaacatgagcttccgggacctcggccgcgtcatggtgatggtgggggccacgatgaccgacgacatcggcatgggcgtcacctacctggccctgctcgccgcgttcaaggtgcgccccaccttcgccgccgggctgctgctccggaagctgacgtccaaggagctgatgatggccaccatcggcatcgccctcctgagccagtccaccctgcccgagaccatcctcgagctgacggacgcgctggccctcgggatgatggccctgaagatcgtgcgcaacatggagaagtaccagctggccgtcaccatcatggccatcagctgcgtgcccaacgcggtgatcctccagaacgcctggaaggtctcctgcaccatcctggccgccgtgagcgtgtccccgctgctcctgaccagctcccagcagaaggcggactggatccccctggccctcacgatcaagggcctgaaccccaccgccatcttcctgaccaccctcagccggacgtccaagaagcgcagctggcccctgaacgaggccatcatggccgtcggcatggtgtccatcctggcgagcagcctcctgaagaacgacatcccgatgaccgggcccctggtcgccggcgggctcctgaccgtgtgctacgtgctgaccggccggtccgccgacctcgagctggagcgcgccgccgacgtcaagtgggaggaccaggcggagatcagcgggtccagccccatcctgtccatcacgatcagcgaggacggctccatgagcatcaagaacgaggaggaggagcagaccctcaccatcctgatccggaccggcctgctcgtgatctccggggtgttccccgtcagcatcccgatcaccgccgccgcctggtacctgtgggaggtgaagaagcagcgcgccggcgtgctgtgggacgtccccagcccgccgcccgtggagaaggcggagctcgaggacggggcctaccggatcaagcagcgcggcatcctggggtacagccagatcggcgccggcgtgtacaaggaggggacgttccacaccatgtggcacgtcacccggggcgccgtgctgatgcaccgcgggaagcggatcgagccctcctgggccgacgtgaagaaggacctcatcagctacggcgggggctggaagctggagggcgagtggaaggagggggaggaggtccaggtgctggcgctcgagcccggcaagaacccccgcgccgtgcagaccaagcccgggatcttcaagacgaacaccggcaccatcggggccgtctccctggacttcagccccggcacctccggcagccccatcgtggaccggaaggggaaggtggtcggcctgtacgggaacggcgtggtgacgcgctccggcgcctacgtcagcgcgatcgcccagaccgagaagtccatcgaggacaacccggagatcgaggacgacatcttccggaagaagcgcctcaccatcatggacctgcaccccggggccggcaagaccaagcggtacctgcccgccatcgtgcgcgaggccatcaagcgggggctgcgcacgctcatcctggcgcccacccgcgtggtcgccgccgagatggaggaggccctgcggggcctcccgatccgctaccagacccccgccatccgggcggagcacaccgggcgcgagatcgtggacctgatgtgccacgccacgttcaccatgcggctgctctcccccgtgcgcgtccccaactacaacctgatcatcatggacgaggcccacttcaccgacccggccagcatcgccgcgcggggctacatctccacccgcgtggagatgggcgaggccgccgggatcttcatgacggccacgccgcccggcagccgggaccccttcccgcagtccaacgcgcccatcatggacgaggagcgcgagatccccgagcggagctggaactccgggcacgagtgggtgaccgacttcaagggcaagaccgtctggttcgtgcccagcatcaaggccgggaacgacatcgccgcctgcctgcgcaagaacggcaagaaggtgatccagctctcccggaagacgttcgacagcgagtacgtcaagacccgcgccaacgactgggacttcgtggtgaccaccgacatctccgagatgggcgcgaacttcaaggccgagcgggtcatcgacccgcgccggtgcatgaagcccgtgatcctgacggacggggaggagcgcgtgatcctggccggccccatgcccgtcacccacagctccgccgcccagcggcgcgggcgcatcggccggaacccgaagaacgagaacgaccagtacatctacatgggggagcccctcgagaacgacgaggactgcgcgcactggaaggaggccaagatgctgctggacaacatcaacacccccgagggcatcatccccagcatgttcgagccggagcgcgagaaggtggacgccatcgacggcgagtaccggctccgcggggaggcccggaagaccttcgtggacctgatgcgccggggcgacctgcccgtctggctcgcctacaaggtggcggccgaggggatcaactacgccgaccgcaagtggtgcttcgacggcatcaagaacaaccagatcctggaggagaacgtggaggtcgagatctggacgaaggagggggagcggaagaagctgaagccccgctggctcgacgcccggatctactccgacccgctggcgctgaaggagttcaaggagttcgccgccggccgcaagagcctcaccctgaacctgatcaccgagatgggccggctccccaccttcatgacgcagaaggcccgcaacgccctggacaacctggcggtgctccacaccgccgaggtcgggggccgggcctacacccacgccctgtccgagctgcccgagaccctcgagacgctgctgctcctgaccctgctcgccgcggtcaccgggggcatcttcctgttcctgatgagcggcaaggggatcggcaagatgaccctcgggatgtgctgcatcatcaccgcctccatcctgctgtggtacgcccagatccagccccactggatcgccgccagcatcatcctcgagttcttcctgatcgtgctgctcatcccggagcccgagaagcagcgcacgccccaggacaaccagctgacctacgtcgtgatcgcgatcctgaccgtggtcgccgccaccatggccaacgagatgggcttcctcgagaagacgaagaaggacctggggttcggcagcatcaccacccaggagtccgagagcaacatcctggacatcgacctccggcccgcctccgcgtggaccctgtacgccgtggccacgaccttcgtgaccccgatgctgcgccacagcatcgagaactccagcgtcaacgtgtccctcaccgccatcgcgaaccaggccacggtgctgatgggcctggggaagggctggcccctcagcaagatggacatcggggtccccctgctggccatcggctgctactcccaggtgaaccccatcaccctcaccgccgccctgctgctcctggtggcgcactacgccatcatcgggccgggcctgcaggccaaggccacccgggaggcccagaagcgcgcggccgccggcatcatgaagaaccccacggtcgacgggatcaccgtgatcgacctcgagcccatcccctacgacccgaagttcgagaagcagctgggccaggtgatgctgctcatcctgtgcgtcacccaggtgctgatgatgcggaccacgtgggccctctgcgaggccctgaccctggcgaccgggcccatcagcaccctctgggagggcaaccccgggcgcttctggaacacgaccatcgccgtgtccatggccaacatcttccgcggcagctacctggccggcgcggggctcctgttctccatcatgaagaacaccaccaacacgcggcgcggcaccgggaacgtcggcgagaccctgggcgagaagtggaagtcccggctgaaggccctcgggaagtccgagttccagatctacaagaagtccggcatccaggaggtggaccgcaccctggccaaggaggggatcaagcggggcgagacggaccaccacgccgtgtcccgcgggagcgccaagctgcggtggttcgtcgagcgcaacatggtgacccccgagggcaaggtggtcgacctcggctgcgggcggggcgggtggtcctactactgcggcgggctgaagaacgtgcgcgaggtgaagggcctgaccaagggcgggccgggccacgaggagcccatccccatgagcacctacgggtggaacctcgtccggctgcagagcggcgtggacgtgttcttcacgcccccggagaagtgcgacaccctgctctgcgacatcggggagtccagccccaaccccaccatcgaggcgggccgcaccctgcgggtcctgaacctcgtggagaactggctgaacaacaacacccagttctgcatcaaggtgctgaacccctacatgccgtccgtcatcgagaagatggagacgctccagcgcaagtacggcggggccctggtgcggaaccccctgagccgcaactccacccacgagatgtactgggtgagcaacgccaccggcaacatcgtctccagcgtgaacatgatctcccggatgctgatcaaccgcttcaccatgaagcacaagaaggccacgtacgagcccgacgtggacctcgggagcggcacccggaacatcgggatcgagtccgagatcccgaacctggacatcatcggcaagcgcatcgagaagatcaagcaggagcacgagaccagctggcactacgaccaggaccacccctacaagacctgggcctaccacggctcctacgagacgaagcagaccgggagcgcgtccagcatggtcaacggcgtggtgcgcctgctcaccaagccctgggacgtcgtgcccatggtgacccagatggccatgacggacaccaccccgttcgggcagcagcgggtcttcaaggagaaggtggacacccgcacgcaggagcccaaggagggcaccaagaagctgatgaagatcaccgccgagtggctgtggaaggagctcggcaaggagaagacgccccggatgtgcacgcgcgaggagttcacccggaaggtgcgctccaacgccgccctgggggcggtcttcaccgacgagaacaagtggaagtccgcccgggaggccgtggaggacggccgcttctgggagctggtggaccgggagcgcaacctccacctggaggggaagtgcgagacctgcgtctacaacatgatgggcaagcgggagaagaagctgggggagttcggcaaggccaagggctcccgcgcgatctggtacatgtggctcggggcccggttcctggagttcgaggccctgggcttcctcaacgaggaccactggttcagccgcgggaacagcctgtccggcgtggagggggagggcctgcaccggctcggctacatcctgcgcgaggtcgggaagaaggagggcggggccatgtacgccgacgacacggcgggctgggacacccggatcaccctggaggacctcaagaacgaggagatggtgaccaaccacatgaagggggagcacaagaagctggccgaggccatcttcaagctgacgtaccagaacaaggtggtccgcgtgcagcggcccaccccgcgcggcaccgtgatggacatcatcagccggaaggaccagcgcggctccgggcaggtcggcacctacgggctcaacacgttcaccaacatggaggcccagctgatccgccagatggagggcgagggcatcttcaagagcatccagcacctgaccgccaccgaggagatcgcggtgcagaactggctcgcccgggtggggcgcgagcggctgtcccgcatggccatcagcggcgacgactgcgtcgtgaagcccatcgacgaccggttcgcctccgccctgacggcgctcaacgacatggggaaggtgcgcaaggacatccagcagtgggagcccagccggggctggaacgactggacccaggtccccttctgctcccaccacttccacgagctggtgatgaaggacgggcgcgtgctggtcgtgccgtgccggaaccaggacgagctcatcggccgcgcccggatcagccagggcgccgggtggtccctgaaggagaccgcctgcctgggcaagagctacgcccagatgtggaccctcatgtacttccaccgccgggacctgcgcctggcggccaacgccatctgctccgccgtgcccagccactgggtccccacctcccggacgacctggagcatccacgcgaagcacgagtggatgaccaccgaggacatgctcgccgtgtggaaccgcgtgtggatccaggagaacccctggatggaggacaagacgccggtcgagtcctgggaggaggtgccctacctggggaagcgggaggaccagtggtgcggcagcctgatcgggctcaccagccgcgccacctgggccaagaacatccagaccgccatcaaccaggtgcggtccctgatcggcaacgagggctacacggactacatgcccagcatgaagcgcttccgccgggaggaggaggaggcgggggtcctgtggtga

SEQ ID NO: 9017 - RNA, 9876 nt, synthetic construct
  misc_feature 1..9876: note = derived and/or modified CDS sequence (opt1) from DENV-2__KF744403__SS-prME
  source 1..9876: mol_type = other RNA
accgccgggatgatcatcatgctgatccccaccgtgatggccttccacctcaccacccggaacggggagccccacatgatcgtcagccggcaggagaagggcaagagcctgctgttcaagaccgaggacggggtgaacatgtgcaccctcatggcgatggacctgggggagctgtgcgaggacaccatcacctacaagtgccccctcctgcgccagaacgagcccgaggacatcgactgctggtgcaacagcacctccacctgggtgacctacgggacctgcaccaccacgggcgagcaccggcgcgagaagcggagcgtcgccctggtgccccacgtgggcatggggctcgagacccgcaccgagacctggatgtccagcgagggcgcctggaagcacgcccagcggatcgagacgtggatcctgcgccaccccgggttcaccctgatggccgcgatcctcgcctacaccatcggcaccacgaacttccagcgggccctgatcttcatcctgctcaccgccgtcgcgccctccatgaccatgcgctgcatcgggatcagcaaccgggacttcgtggagggcgtgtccggcgggagctgggtcgacatcgtgctggagcacggctcctgcgtgaccacgatggccaagaacaagcccaccctggacttcgagctcatcaagaccgaggccaagcagcccgccaccctgcgcaagtactgcatcgaggccaagctgacgaacaccaccaccgagagccggtgcccgacgcagggggagccctccctcaacgaggagcaggacaagcgcttcgtctgcaagcacagcatggtggaccggggctggggcaacgggtgcggcctgttcgggaagggcgggatcgtgacctgcgcgatgttcacgtgcaagaagaacatggagggcaagatcgtccagcccgagaacctggagtacaccatcgtgatcacgccccactccggcgaggagcacgccgtggggaacgacaccggcaagcacgggaaggagatcaagatcaccccgcagagctccatcaccgaggccgagctcaccggctacgggacggtcaccatggagtgcagcccccgcaccggcctggacttcaacgagatggtgctgctccagatggagaacaaggcctggctggtgcaccggcagtggttcctggacctccccctgccctggctgccgggcgccgacacccaggggtccaactggatccagaaggagacgctcgtcaccttcaagaacccccacgcgaagaagcaggacgtggtggtcctgggcagccaggagggggccatgcacaccgccctgaccggcgccacggagatccagatgagctccgggaacctcctgttcaccggccacctgaagtgccgcctccggatggacaagctgcagctgaagggcatgagctactccatgtgcaccgggaagttcaaggtggtcaaggagatcgccgagacccagcacggcacgatcgtggtgcgcgtccagtacgagggggacggcagcccctgcaagatccccttcgagatcatggacctcgagaagcggcacgtgctgggccgcctgatcaccgtgaacccgatcgtcaccgagaaggactcccccgtgaacatcgaggcggagccgcccttcggggacagctacgtgatcatcggcgtcgagccggggcagctcaagctgaactggttcaagaagggctccagcatcgggcagatgttcgagaccacgatgcgcggcgccaagcggatggccatcctgggcgacaccgcctgggacttcgggtccctcggcggggtgttcaccagcatcggcaaggccctgcaccaggtgttcggggcgatctacggcgccgccttctccggcgtcagctggaccatgaagatcctgatcggggtgatcatcacgtggatcggcatgaactcccgcagcacctccctgagcgtgtccctcgtcctggtgggggtggtcaccctgtacctcggcgtggtggtccaggccgacagcgggtgcgtggtgtcctggcggaacaaggagctgaagtgcggcagcggcatcttcatcaccgacaacgtccacacgtggaccgagcagtacaagttccagcccgagagcccctccaagctggcgagcgccatccagaaggcccaccaggaggggatctgcggcatccgctccgtgacccggctcgagaacctgatgtggaagcagatcacccccgagctgaaccacatcctcagcgagaacgaggtgaagctgacgatcatgaccggggacatcaagggcatcatgcacgccgggaagcgctccctgcggccgcagcccaccgagctccgctacagctggaagacctggggcaaggccaagatcctgtccacggagagccacaaccagaccttcctgatcgacggccccgagaccgcggagtgcccgaacaccaaccgggcctggaactccctcgaggtcgaggactacgggttcggcgtgttcacgaccaacatctggctgcgcctgcgggagaagcaggacgccttctgcgacagcaagctcatgtccgccgccatcaaggacaaccgcgcggtgcacgccgacatggggtactggatcgagagcgccctgaacgacacctggaagatcgagaaggcctccttcatcgaggtcaagagctgccactggcccaagtcccacaccctgtggagcaacggcgtgctcgagtccgagatgatcatccccaagaacttcgccggccccgtgagccagcacaactaccggccggggtaccacacccagacggcgggcccctggcacctggggaagctggagatggacttcgacttctgcaagggcaccaccgtcgtggtgaccgaggactgcgggaaccgcggccccagcctccggacgaccaccgcctccggcaagctgatcaccgagtggtgctgccgcagctgcacgctgcccccgctccggtaccgcggggaggacggctgctggtacgggatggagatccggcccctgaaggagaaggaggagaacctggtctccagcctcgtgaccgccggccacgggcagatcgacaacttctccctgggcgtgctgggcatggccctcttcctggaggagatgctgcgcacccgcgtcgggaccaagcacgcgatcctcctggtggccgtgagcttcgtcacgctgatcaccggcaacatgtccttccgggacctcgggcgcgtgatggtgatggtcggcgccaccatgaccgacgacatcgggatgggcgtgacgtacctggccctgctcgccgcgttcaaggtgcggcccaccttcgccgccggcctgctgctccgcaagctgaccagcaaggagctgatgatgaccacgatcgggatcgtcctcctgtcccagagcaccatccccgagaccatcctggagctcaccgacgccctggccctgggcatgatggtgctcaagatcgtgcggaagatggagcgctaccagctggcggtcacgatcatggccatcctgtgcgtgccgaacgccgtcatcctccagaacgcctggaaggtgtcctgcaccatcctggccgtggtcagcgtgagccccctgctcctgaccagctcccagcagaaggcggactggatccccctggccctcaccatcaaggggctgaaccccacggccatcttcctgaccaccctcagccggacctccaagaagcgcagctggccgctgaacgaggccatcatggcggtgggcatggtctccatcctggccagcagcctcctgaagaacgacatccccatgacgggccccctggtggccgggggcctcctgaccgtgtgctacgtcctgaccgggcggtccgccgacctcgagctggagaaggccgcggacgtgcgctgggaggaccaggccgagatcagcggctccagccccatcctgtccatcatcatcagcgaggacgggtccatgagcatcaagaacgaggaggaggagcagaccctcacgatcctgatccggaccggcctgctcgtgatctccggcctgttcccggtcagcatccccatcaccgccgccgcctggtacctgtgggaggtgaagaagcagcgcgcgggggtgctctgggacgtccccagcccgccgcccgtgggcaaggccgagctggaggacggggcctaccggatcaagcagaagggcatcctggggtacagccagatcggcgccggcgtgtacaaggaggggaccttccacaccatgtggcacgtcacgcgcggcgccgtgctcatgcacaaggggaagcggatcgagccctcctgggcggacgtgaagaaggacctgatcagctacggcgggggctggaagctggagggcgagtggaaggagggggaggaggtccaggtgctcgccctggagcccggcaagaacccccgcgccgtgcagaccaagcccgggctgttcaagaccaacgccggcaccatcggggccgtctccctcgacttcagccccggcacgtccggcagccccatcatcgacaagaaggggaaggtggtgggcctgtacgggaacggcgtcgtgacccggaacggctcctacgtgagcgcgatcgcccagaccgagaagtccatcgaggacaaccccgagatcgaggacgacatcttccgcaagaagcggctgaccatcatggacctgcaccccggggccggcaagacgaagcgctacctccccgccatcgtccgggaggcgatcaagcgcgggctgcgcaccctgatcctcgccccgacccgggtggtggccgccgagatggaggaggccctgcgcggcctgcccatccggtaccagacccccgcgatccgcgccgagcacacggggcgggagatcgtcgacctcatgtgccacgccaccttcaccatgcgcctgctgtcccccatccgggtgccgaactacaacctcatcatcatggacgaggcccacttcaccgaccccgccagcatcgcggcccgcggctacatctccacgcgggtggagatgggcgaggccgccgggatcttcatgaccgccacgccgcccggcagccgcgacccgttcccccagtccaacgcgcccatcatggacgaggagcgggagatccccgagcgcagctggaactccgggcacgagtgggtcaccgacttcaagggcaagacggtgtggttcgtgccgagcatcaaggccgggaacgacatcgccgcctgcctgcggaagaacggcaagaaggtcatccagctgtcccgcaagaccttcgacagcgagtacgtgaagacccggaccaacgactgggacttcgtggtcacgaccgacatctccgagatgggcgcgaacttcaaggccgagcgcgtgatcgacccccggcgctgcatgaagcccgtgatcctcaccgacggggaggagcgggtcatcctggccggccccatgccggtgacccacagctccgccgcccagcgccgcgggcggatcggccgcaaccccaagaacgagaacgaccagtacatctacatgggggagcccctggagaacgacgaggactgcgcgcactggaaggaggccaagatgctcctggacaacatcaacacgcccgagggcatcatcccgagcatgttcgagcccgagcgggagaaggtggacgccatcgacggcgagtaccgcctgcgcggggaggcccgcaagaccttcgtcgacctcatgcggcgcggcgacctgcccgtgtggctggcctacaaggtggcggccgaggggatcaactacgccgaccggcgctggtgcttcgacggcatccggaacaaccagatcctcgaggagaacgtcgaggtggagatctggaccaaggagggggagcgcaagaagctgaagccgcggtggctggacgcccgcatctactccgaccccctcgccctgaaggagttcaaggagttcgcggccggccggaagtccctgaccctcaacctgatcacggagatgggccgcctgcccaccttcatgacccagaaggcccgggacgccctcgacaacctggcggtcctgcacaccgccgaggccgggggccgcgcctacaaccacgccctctccgagctgcccgagacgctggagatcctcctgctgctcaccctgctggcgaccgtgaccgggggcatcttcctcttcctgatgagcggccgggggatcggcaagatgacgctggggatgtgctgcatcatcaccgcctccatcctcctgtggtacgcccagatccagccgcactggatcgccgccagcatcatcctggagttcttcctcatcgtgctgctgatccccgagcccgagaagcagcgcacgccccaggacaaccagctcacctacgtcgtgatcgcgatcctgaccgtggtcgccgccacgatggccaacgagatgggcttcctggagaagaccaagaaggacctcgggctgggcagcatcaccacccagcagccggagtccaacatcctggacatcgacctccggcccgccagcgcgtggacgctgtacgccgtggccaccaccttcatcacccccatgctgcgccactccatcgagaacagctccgtgaacgtcagcctcacggccatcgccaaccaggcgaccgtgctgatgggcctggggaagggctggcccctctccaagatggacatcggggtgccgctgctggccatcggctgctacagccaggtcaaccccatcaccctcaccgccgccctgctgctcctggtggcgcactacgccatcatcgggcccggcctgcaggccaaggccacgcgcgaggcccagaagcgggcggccgccggcatcatgaagaaccccaccgtggacgggatcaccgtcatcgacctcgacccgatcccctacgaccccaagttcgagaagcagctgggccaggtgatgctgctcgtgctgtgcgtcacccaggtgctgatgatgcgcacgacctgggccctctgcgaggccctgaccctggcgaccgggcccatctccacgctctgggagggcaacccggggcggttctggaacaccaccatcgccgtgagcatggccaacatcttccgcggctcctacctggccggcgccgggctcctgttcagcatcatgaagaacaccacgaacacccggcgcggcaccgggaacatcggcgagaccctgggcgagaagtggaagtcccggctgaacgcgctcggcaagagcgagttccagatctacaagaagtccggcatccaggaggtcgaccgcacgctggccaaggaggggatcaagcggggcgagaccgaccaccacgccgtgagccgcgggtccgccaagctgcggtggttcgtggagcgcaacatgatcacccccgagggcaaggtcgtggacctcggctgcgggcggggcgggtggagctactactgcggcgggctgaagaacgtgcgcgaggtcaagggcctgaccaagggcgggcccggccacgaggagcccatcccgatgtccacgtacgggtggaacctcgtgcggctgcagagcggcgtggacgtcttcttcacgccgcccgagaagtgcgacaccctgctctgcgacatcggggagagctcccccaacccgaccgtggaggcgggccgcacgctgcgggtgctgaacctcgtcgagaactggctgaacaacaacacccagttctgcatcaaggtgctgaacccctacatgcccagcgtgatcgagaagatggaggccctgcagcgcaagtacggcggggccctcgtccggaacccgctgtcccgcaacagcacccacgagatgtactgggtgtccaacgccagcggcaacatcgtgtccagcgtcaacatgatctcccgcatgctgatcaaccggttcaccatgaagcacaagaaggccacctacgagcccgacgtggacctcgggagcggcacgcgcaacatcgggatcgagtccgaggtgcccaacctggacatcatcggcaagcggatcgagaagatcaagcaggagcacgagaccagctggcactacgaccaggaccacccctacaagacctgggcgtaccacggctcctacgagaccaagcagacggggagcgcctccagcatggtcaacggcgtggtgcgcctgctcaccaagccgtgggacgtcatccccatggtgacccagatggccatgaccgacacgacccccttcgggcagcagcgggtgttcaaggagaaggtcgacacccgcacccaggagcccaaggagggcacgaagaagctgatgaagatcaccgccgagtggctgtggaaggagctcggcaagaagaagaccccgcggatgtgcacccgcgaggagttcacgcggaaggtgcgctccaacgccgcgctgggggccatcttcaccgacgagaacaagtggaagtccgcccgggaggccgtggaggactcccgcttctgggagctggtcgacaaggagcggaacctccacctggagggcaagtgcgagacctgcgtgtacaacatgatggggaagcgcgagaagaagctgggcgagttcgggaaggccaagggcagccgggcgatctggtacatgtggctcggcgcccgcttcctggagttcgaggccctggggttcctcaacgaggaccactggttcagccgggagaactccctgagcggcgtcgagggggagggcctgcacaagctcgggtacatcctgcgcgacgtgtccaagaaggagggcggcgccatgtacgcggacgacaccgccgggtgggacacgcggatcaccctggaggacctcaagaacgaggagatggtgaccaaccacatggagggcgagcacaagaagctggccgaggccatcttcaagctgacctaccagaacaaggtcgtgcgcgtgcagcggcccacgccccgcgggaccgtcatggacatcatcagccgccgggaccagcgcggctccggccaggtgggcacctacggcctcaacaccttcacgaacatggaggcccagctgatccggcagatggagggggagggcgtgttcaagagcatccagcacctgaccgcgaccgaggagatcgccgtccagaactggctcgcccgcgtggggcgggagcgcctgtcccggatggccatcagcggcgacgactgcgtggtcaagcccctggacgaccgcttcgcctccgcgctcaccgccctgaacgacatgggcaaggtgcggaaggacatccagcagtgggagccgagcaaggggtggaacgactggacccaggtgcccttctgctcccaccacttccacgagctgatcatgaaggacggccgcgtcctcgtggtgccctgccggaaccaggacgagctgatcgggcgcgcccggatcagccagggcgccgggtggtccctgcgcgagaccgcctgcctcggcaagagctacgcgcagatgtggtccctgatgtacttccaccggcgcgacctgcggctcgccgccaacgccatctgcagcgccgtcccctcccactgggtgccgaccagccgcaccacgtggagcatccacgcgaagcacgagtggatgaccaccgaggacatgctgaccgtgtggaaccgggtctggatccaggagaacccctggatggaggacaagacccccgtggagtcctgggaggagatcccctacctgggcaagcgcgaggaccagtggtgcgggagcctcatcggcctgacgtcccgcgccacctgggccaagaacatccagaccgccatcaaccaggtgcggagcctgatcgggaacgaggagtacaccgactacatgccgtccatgaagcgcttccggcgcgaggaggaggaggcgggcgtcctctggtga

SEQ ID NO: 9018 - RNA, 9876 nt, synthetic construct
  misc_feature 1..9876: note = derived and/or modified CDS sequence (opt1) from DENV-2__KF744406__SS-prME
  source 1..9876: mol_type = other RNA
accgccgggatgatcatcatgctgatccccaccgtgatggccttccacctcaccacccggaacggggagccccacatgatcgtcagccggcaggagaagggcaagagcctgctgttcaagaccgaggacggggtgaacatgtgcaccctcatggcgatggacctgggcgagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggagcgtcgccctggtgccccacgtgggcatggggctcgagacccgcaccgagacctggatgtccagcgagggcgcctggaagcacgcccagcggatcgagacgtggatcctgcgccaccccgggttcaccctgatggccgcgatcctcgcctacaccatcggcaccacgaacttccagcgggccctgatcttcatcctgctcaccgccgtcgcgccctccatgaccatgcgctgcatcgggatcagcaaccgggacttcgtggagggcgtgtccggcgggagctgggtcgacatcgtgctggagcacggctcctgcgtgaccacgatggccaagaacaagcccaccctggacttcgagctcatcaagaccgaggccaagcagcccgccaccctgcgcaagtactgcatcgaggccaagctgacgaacaccaccaccgagagccggtgcccgacgcagggggagccctccctcaacgaggagcaggacaagcgcttcgtctgcaagcacagcatggtggaccggggctggggcaacgggtgcggcctgttcgggaagggcgggatcgtgacctgcgcgatgttcacgtgcaagaagaacatggagggcaagatcgtccagcccgagaacctggagtacaccatcgtgatcacgccccactccggcgaggagcacgccgtggggaacgacaccggcaagcacgggaaggagatcaagatcaccccgcagagctccatcaccgaggccgagctcaccggctacgggacggtcaccatggagtgcagcccccgcaccggcctggacttcaacgagatggtgctgctccagatggagaacaaggcctggctggtgcaccggcagtggttcctggacctccccctgccctggctgccgggcgccgacacccaggggtccaactggatccagaaggagacgctcgtcaccttcaagaacccccacgcgaagaagcaggacgtggtggtcctgggcagccaggagggggccatgcacaccgccctgaccggcgccacggagatccagatgagctccgggaacctcctgttcaccggccacctgaagtgccgcctccggatggacaagctgcagctgaagggcatgagctactccatgtgcaccgggaagttcaaggtggtcaaggagatcgccgagacccagcacggcacgatcgtggtgcgcgtccagtacgagggggacggcagcccctgcaagatccccttcgagatcatggacctcgagaagcggcacgtgctgggccgcctgatcaccgtgaacccgatcgtcaccgagaaggactcccccgtgaacatcgaggcggagccgcccttcggggacagctacgtgatcatcggcgtcgagccggggcagctcaagctgaactggttcaagaagggctccagcatcgggcagatgttcgagaccacgatgcgcggcgccaagcggatggccatcctgggcgacaccgcctgggacttcgggtccctcggcggggtgttcaccagcatcggcaaggccctgcaccaggtgttcggggcgatctacggcgccgccttctccggcgtcagctggaccatgaagatcctgatcggggtgatcatcacgtggatcggcatgaactcccgcagcacctccctgagcgtgtccctcgtcctggtgggggtggtcaccctgtacctcggcgtggtggtccaggccgacagcgggtgcgtggtgtcctggcggaacaaggagctgaagtgcggcagcggcatcttcatcaccgacaacgtccacacgtggaccgagcagtacaagttccagcccgagagcccctccaagctggcgagcgccatccagaaggcccaccaggaggggatctgcggcatccgctccgtgacccggctcgagaacctgatgtggaagcagatcacccccgagctgaaccacatcctcagcgagaacgaggtgaagctgacgatcatgaccggggacatcaagggcatcatgcacgccgggaagcgctccctgcggccgcagcccaccgagctccgctacagctggaagacctggggcaaggccaagatcctgtccacggagagccacaaccagaccttcctgatcgacggccccgagaccgcggagtgcccgaacaccaaccgggcctggaactccctcgaggtcgaggactacgggttcggcgtgttcacgaccaacatctggctgcgcctgcgggagaagcaggacgccttctgcgacagcaagctcatgtccgccgccatcaaggacaaccgcgcggtgcacgccgacatggggtactggatcgagagcgccctgaacgacacctggaagatcgagaaggcctccttcatcgaggtcaagagctgccactggcccaagtcccacaccctgtggagcaacggcgtgctcgagtccgagatgatcatccccaagaacttcgccggccccgtgagccagcacaactaccggccggggtaccacacccagacggcgggcccctggcacctggggaagctggagatggacttcgacttctgcaagggcaccaccgtcgtggtgaccgaggactgcgggaaccgcggccccagcctccggacgaccaccgcctccggcaagctgatcaccgagtggtgctgccgcagctgcacgctgcccccgctccggtaccgcggggaggacggctgctggtacgggatggagatccggcccctgaaggagaaggaggagaacctggtctccagcctcgtgaccgccggccacgggcagatcgacaacttctccctgggcgtgctgggcatggccctcttcctggaggagatgctgcgcacccgcgtcgggaccaagcacgcgatcctcctggtggccgtgagcttcgtcacgctgatcaccggcaacatgtccttccgggacctcgggcgcgtgatggtgatggtcggcgccaccatgaccgacgacatcgggatgggcgtgacgtacctggccctgctcgccgcgttcaaggtgcggcccaccttcgccgccggcctgctgctccgcaagctgaccagcaaggagctgatgatgaccacgatcgggatcgtcctcctgtcccagagcaccatccccgagaccatcctggagctcaccgacgccctggccctgggcatgatggtgctcaagatcgtgcggaagatggagcgctaccagctggcggtcacgatcatggccatcctgtgcgtgccgaacgccgtcatcctccagaacgcctggaaggtgtcctgcaccatcctggccgtggtcagcgtgagccccctgctcctgaccagctcccagcagaaggcggactggatccccctggccctcaccatcaaggggctgaaccccacggccatcttcctgaccaccctcagccggacctccaagaagcgcagctggccgctgaacgaggccatcatggcggtgggcatggtctccatcctggccagcagcctcctgaagaacgacatccccatgacgggccccctggtggccgggggcctcctgaccgtgtgctacgtcctgaccgggcggtccgccgacctcgagctggagaaggccgcggacgtgcgctgggaggaccaggccgagatcagcggctccagccccatcctgtccatcatcatcagcgaggacgggtccatgagcatcaagaacgaggaggaggagcagaccctcacgatcctgatccggaccggcctgctcgtgatctccggcctgttcccggtcagcatccccatcaccgccgccgcctggtacctgtgggaggtgaagaagcagcgcgcgggggtgctctgggacgtccccagcccgccgcccgtgggcaaggccgagctggaggacggggcctaccggatcaagcagaagggcatcctggggtacagccagatcggcgccggcgtgtacaaggaggggaccttccacaccatgtggcacgtcacgcgcggcgccgtgctcatgcacaaggggaagcggatcgagccctcctgggcggacgtgaagaaggacctgatcagctacggcgggggctggaagctggagggcgagtggaaggagggggaggaggtccaggtgctcgccctggagcccggcaagaacccccgcgccgtgcagaccaagcccgggctgttcaagaccaacgccggcaccatcggggccgtctccctcgacttcagccccggcacgtccggcagccccatcatcgacaagaaggggaaggtggtgggcctgtacgggaacggcgtcgtgacccggaacggctcctacgtgagcgcgatcgcccagaccgagaagtccatcgaggacaaccccgagatcgaggacgacatcttccgcaagaagcggctgaccatcatggacctgcaccccggggccggcaagacgaagcgctacctccccgccatcgtccgggaggcgatcaagcgcgggctgcgcaccctgatcctcgccccgacccgggtggtggccgccgagatggaggaggccctgcgcggcctgcccatccggtaccagacccccgcgatccgcgccgagcacacggggcgggagatcgtcgacctcatgtgccacgccaccttcaccatgcgcctgctgtcccccatccgggtgccgaactacaacctcatcatcatggacgaggcccacttcaccgaccccgccagcatcgcggcccgcggctacatctccacgcgggtggagatgggcgaggccgccgggatcttcatgaccgccacgccgcccggcagccgcgacccgttcccccagtccaacgcgcccatcatggacgaggagcgggagatccccgagcgcagctggaactccgggcacgagtgggtcaccgacttcaagggcaagacggtgtggttcgtgccgagcatcaaggccgggaacgacatcgccgcctgcctgcggaagaacggcaagaaggtcatccagctgtcccgcaagaccttcgacagcgagtacgtgaagacccggaccaacgactgggacttcgtggtcacgaccgacatctccgagatgggcgcgaacttcaaggccgagcgcgtgatcgacccccggcgctgcatgaagcccgtgatcctcaccgacggggaggagcgggtcatcctggccggccccatgccggtgacccacagctccgccgcccagcgccgcgggcggatcggccgcaaccccaagaacgagaacgaccagtacatctacatgggggagcccctggagaacgacgaggactgcgcgcactggaaggaggccaagatgctcctggacaacatcaacacgcccgagggcatcatcccgagcatgttcgagcccgagcgggagaaggtggacgccatcgacggcgagtaccgcctgcgcggggaggcccgcaagaccttcgtcgacctcatgcggcgcggcgacctgcccgtgtggctggcctacaaggtggcggccgaggggatcaactacgccgaccggcgctggtgcttcgacggcatccggaacaaccagatcctcgaggagaacgtcgaggtggagatctggaccaaggagggggagcgcaagaagctgaagccgcggtggctggacgcccgcatctactccgaccccctcgccctgaaggagttcaaggagttcgcggccggccggaagtccctgaccctcaacctgatcacggagatgggccgcctgcccaccttcatgacccagaaggcccgggacgccctcgacaacctggcggtcctgcacaccgccgaggccgggggccgcgcctacaaccacgccctctccgagctgcccgagacgctggagatcagcctcctgctgaccctcctggcgaccgtgaccgggggcatcttcctgttcctcatgtccggccgggggatcggcaagatgacgctggggatgtgctgcatcatcaccgccagcatcctgctctggtacgcccagatccagccgcactggatcgccgccagcatcatcctggagttcttcctgatcgtgctcctgatccccgagcccgagaagcagcgcacgccccaggacaaccagctgacctacgtcgtgatcgcgatcctcaccgtggtcgccgccacgatggccaacgagatgggcttcctggagaagaccaagaaggacctggggctcggctccatcaccacccagcagccggagagcaacatcctggacatcgacctgcggcccgcctccgcgtggacgctctacgccgtggccaccaccttcatcacccccatgctgcgccacagcatcgagaactccagcgtgaacgtctccctgacggccatcgccaaccaggcgaccgtgctcatgggcctggggaagggctggcccctgagcaagatggacatcggggtgccgctcctggccatcggctgctactcccaggtcaaccccatcaccctgaccgccgccctcctgctgctcgtggcgcactacgccatcatcgggcccggcctgcaggccaaggccacgcgcgaggcccagaagcgggcggccgccggcatcatgaagaaccccaccgtggacgggatcaccgtcatcgacctggacccgatcccctacgaccccaagttcgagaagcagctcggccaggtgatgctgctggtgctctgcgtcacccaggtgctgatgatgcgcacgacctgggccctgtgcgaggccctcaccctggcgaccgggcccatcagcacgctgtgggagggcaacccggggcggttctggaacaccaccatcgccgtgtccatggccaacatcttccgcggcagctacctcgccggcgccgggctgctgttctccatcatgaagaacaccacgaacacccggcgcggcaccgggaacatcggcgagaccctcggcgagaagtggaagtcccggctgaacgcgctggggaagtccgagttccagatctacaagaagtccggcatccaggaggtcgaccgcacgctcgccaaggaggggatcaagcggggcgagaccgaccaccacgccgtgtcccgcgggagcgccaagctgcggtggttcgtggagcgcaacatgatcacccccgagggcaaggtcgtggacctgggctgcgggcggggcgggtggtcctactactgcggcgggctcaagaacgtgcgcgaggtcaagggcctgaccaagggcgggcccggccacgaggagcccatcccgatgagcacgtacgggtggaacctggtgcggctccagagcggcgtggacgtcttcttcacgccgcccgagaagtgcgacaccctgctgtgcgacatcggggagtccagccccaacccgaccgtggaggcgggccgcacgctccgggtgctgaacctggtcgagaactggctcaacaacaacacccagttctgcatcaaggtgctgaacccctacatgccctccgtgatcgagaagatggaggccctgcagcgcaagtacggcggggccctggtccggaacccgctcagccgcaactccacccacgagatgtactgggtgagcaacgcctccggcaacatcgtgagctccgtcaacatgatcagccgcatgctgatcaaccggttcaccatgaagcacaagaaggccacctacgagcccgacgtggacctggggtccggcacgcgcaacatcgggatcgagagcgaggtgcccaacctcgacatcatcggcaagcggatcgagaagatcaagcaggagcacgagacctcctggcactacgaccaggaccacccctacaagacctgggcgtaccacggcagctacgagaccaagcagacggggtccgccagctccatggtcaacggcgtggtgcgcctgctgaccaagccgtgggacgtcatccccatggtgacccagatggccatgaccgacacgacccccttcgggcagcagcgggtgttcaaggagaaggtcgacacccgcacccaggagcccaaggagggcacgaagaagctcatgaagatcaccgccgagtggctgtggaaggagctgggcaagaagaagaccccgcggatgtgcacccgcgaggagttcacgcggaaggtgcgcagcaacgccgcgctcggggccatcttcaccgacgagaacaagtggaagtccgcccgggaggccgtggaggacagccgcttctgggagctggtcgacaaggagcggaacctgcacctcgagggcaagtgcgagacctgcgtgtacaacatgatggggaagcgcgagaagaagctgggcgagttcgggaaggccaagggcagccgggcgatctggtacatgtggctgggcgcccgcttcctcgagttcgaggccctggggttcctgaacgaggaccactggttctcccgggagaacagcctctccggcgtcgagggggagggcctgcacaagctggggtacatcctccgcgacgtgagcaagaaggagggcggcgccatgtacgcggacgacaccgccgggtgggacacgcggatcaccctggaggacctgaagaacgaggagatggtgaccaaccacatggagggcgagcacaagaagctcgccgaggccatcttcaagctgacctaccagaacaaggtcgtgcgcgtgcagcggcccacgccccgcgggaccgtcatggacatcatctcccgccgggaccagcgcggcagcggccaggtgggcacctacggcctgaacaccttcacgaacatggaggcccagctcatccggcagatggagggggagggcgtgttcaagtccatccagcacctgaccgcgaccgaggagatcgccgtccagaactggctggcccgcgtggggcgggagcgcctcagccggatggccatctccggcgacgactgcgtggtcaagcccctggacgaccgcttcgccagcgcgctgaccgccctcaacgacatgggcaaggtgcggaaggacatccagcagtgggagccgtccaaggggtggaacgactggacccaggtgcccttctgcagccaccacttccacgagctgatcatgaaggacggccgcgtcctggtggtgccctgccggaaccaggacgagctcatcgggcgcgcccggatctcccagggcgccgggtggagcctgcgcgagaccgcctgcctgggcaagtcctacgcgcagatgtggagcctcatgtacttccaccggcgcgacctgcggctggccgccaacgccatctgctccgccgtccccagccactgggtgccgaccagccgcaccacgtggtccatccacgcgaagcacgagtggatgaccaccgaggacatgctcaccgtgtggaaccgggtctggatccaggagaacccctggatggaggacaagacccccgtggagagctgggaggagatcccctacctgggcaagcgcgaggaccagtggtgcgggtccctgatcggcctcacgagccgcgccacctgggccaagaacatccagaccgccatcaaccaggtgcggtccctgatcgggaacgaggagtacaccgactacatgccgagcatgaagcgcttccggcgcgaggaggaggaggcgggcgtcctgtggtga

SEQ ID NO: 9019 - RNA, 9876 nt, synthetic construct
  misc_feature 1..9876: note = derived and/or modified CDS sequence (opt1) from DENV-2__KF744404__SS-prME
  source 1..9876: mol_type = other RNA
accgccgggatgatcatcatgctgatccccaccgtgatggccttccacctcaccacccggaacggggagccccacatgatcgtcagccggcaggagaagggcaagagcctgctgttcaagaccgaggacggggtgaacatgtgcaccctcatggcgatggacctgggcgagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggagcgtcgccctggtgccccacgtgggcatggggctcgagacccgcaccgagacctggatgtccagcgagggcgcctggaagcacgcccagcggatcgagacgtggatcctgcgccaccccgggttcaccctgatggccgcgatcctcgcctacaccatcggcaccacgaacttccagcgggccctgatcttcatcctgctcaccgccgtcgcgccctccatgaccatgcgctgcatcgggatcagcaaccgggacttcgtggagggcgtgtccggcgggagctgggtcgacatcgtgctggagcacggctcctgcgtgaccacgatggccaagaacaagcccaccctggacttcgagctcatcaagaccgaggccaagcagcccgccaccctgcgcaagtactgcatcgaggccaagctgacgaacaccaccaccgagagccggtgcccgacgcagggggagccctccctcaacgaggagcaggacaagcgcttcgtctgcaagcacagcatggtggaccggggctggggcaacgggtgcggcctgttcgggaagggcgggatcgtgacctgcgcgatgttcacgtgcaagaagaacatggagggcaagatcgtccagcccgagaacctggagtacaccatcgtgatcacgccccactccggcgaggagcacgccgtggggaacgacaccggcaagcacgggaaggagatcaagatcaccccgcagagctccatcaccgaggccgagctcaccggctacgggacggtcaccatggagtgcagcccccgcaccggcctggacttcaacgagatggtgctgctccagatggagaacaaggcctggctggtgcaccggcagtggttcctggacctccccctgccctggctgccgggcgccgacacccaggggtccaactggatccagaaggagacgctcgtcaccttcaagaacccccacgcgaagaagcaggacgtggtggtcctgggcagccaggagggggccatgcacaccgccctgaccggcgccacggagatccagatgagctccgggaacctcctgttcaccggccacctgaagtgccgcctccggatggacaagctgcagctgaagggcatgagctactccatgtgcaccgggaagttcaaggtggtcaaggagatcgccgagacccagcacggcacgatcgtggtgcgcgtccagtacgagggggacggcagcccctgcaagatccccttcgagatcatggacctcgagaagcggcacgtgctgggccgcctgatcaccgtgaacccgatcgtcaccgagaaggactcccccgtgaacatcgaggcggagccgcccttcggggacagctacgtgatcatcggcgtcgagccggggcagctcaagctgaactggttcaagaagggctccagcatcgggcagatgttcgagaccacgatgcgcggcgccaagcggatggccatcctgggcgacaccgcctgggacttcgggtccctcggcggggtgttcaccagcatcggcaaggccctgcaccaggtgttcggggcgatctacggcgccgccttctccggcgtcagctggaccatgaagatcctgatcggggtgatcatcacgtggatcggcatgaactcccgcagcacctccctgagcgtgtccctcgtcctggtgggggtggtcaccctgtacctcggcgtggtggtccaggccgacagcgggtgcgtggtgtcctggcggaacaaggagctgaagtgcggcagcggcatcttcatcaccgacaacgtccacacgtggaccgagcagtacaagttccagcccgagagcccctccaagctggcgagcgccatccagaaggcccaccaggaggggatctgcggcatccgctccgtgacccggctcgagaacctgatgtggaagcagatcacccccgagctgaaccacatcctcagcgagaacgaggtgaagctgacgatcatgaccggggacatcaagggcatcatgcacgccgggaagcgctccctgcggccgcagcccaccgagctccgctacagctggaagacctggggcaaggccaagatcctgtccacggagagccacaaccagaccttcctgatcgacggccccgagaccgcggagtgcccgaacaccaaccgggcctggaactccctcgaggtcgaggactacgggttcggcgtgttcacgaccaacatctggctgcgcctgcgggagaagcaggacgccttctgcgacagcaagctcatgtccgccgccatcaaggacaaccgcgcggtgcacgccgacatggggtactggatcgagagcgccctgaacgacacctggaagatcgagaaggcctccttcatcgaggtcaagagctgccactggcccaagtcccacaccctgtggagcaacggcgtgctcgagtccgagatgatcatccccaagaacttcgccggccccgtgagccagcacaactaccggccggggtaccacacccagacggcgggcccctggcacctggggaagctggagatggacttcgacttctgcaagggcaccaccgtcgtggtgaccgaggactgcgggaaccgcggccccagcctccggacgaccaccgcctccggcaagctgatcaccgagtggtgctgccgcagctgcacgctgcccccgctccggtaccgcggggaggacggctgctggtacgggatggagatccggcccctgaaggagaaggaggagaacctggtctccagcctcgtgaccgccggccacgggcagatcgacaacttctccctgggcgtgctgggcatggccctcttcctggaggagatgctgcgcacccgcgtcgggaccaagcacgcgatcctcctggtggccgtgagcttcgtcacgctgatcaccggcaacatgtccttccgggacctcgggcgcgtgatggtgatggtcggcgccaccatgaccgacgacatcgggatgggcgtgacgtacctggccctgctcgccgcgttcaaggtgcggcccaccttcgccgccggcctgctgctccgcaagctgaccagcaaggagctgatgatgaccacgatcgggatcgtcctcctgtcccagagcaccatccccgagaccatcctggagctcaccgacgccctggccctgggcatgatggtgctcaagatcgtgcggaagatggagcgctaccagctggcggtcacgatcatggccatcctgtgcgtgccgaacgccgtcatcctccagaacgcctggaaggtgtcctgcaccatcctggccgtggtcagcgtgagccccctgctcctgaccagctcccagcagaaggcggactggatccccctggccctcaccatcaaggggctgaaccccacggccatcttcctgaccaccctcagccggacctccaagaagcgcagctggccgctgaacgaggccatcatggcggtgggcatggtctccatcctggccagcagcctcctgaagaacgacatccccatgacgggccccctggtggccgggggcctcctgaccgtgtgctacgtcctgaccgggcggtccgccgacctcgagctggagaaggccgcggacgtgcgctgggaggaccaggccgagatcagcggctccagccccatcctgtccatcatcatcagcgaggacgggtccatgagcatcaagaacgaggaggaggagcagaccctcacgatcctgatccggaccggcctgctcgtgatctccggcctgttcccggtcagcatccccatcaccgccgccgcctggtacctgtgggaggtgaagaagcagcgcgcgggggtgctctgggacgtccccagcccgccgcccgtgggcaaggccgagctggaggacggggcctaccggatcaagcagaagggcatcctggggtacagccagatcggcgccggcgtgtacaaggaggggaccttccacaccatgtggcacgtcacgcgcggcgccgtgctcatgcacaaggggaagcggatcgagccctcctgggcggacgtgaagaaggacctgatcagctacggcgggggctggaagctggagggcgagtggaaggagggggaggaggtccaggtgctcgccctggagcccggcaagaacccccgcgccgtgcagaccaagcccgggctgttcaagaccaacgccggcaccatcggggccgtctccctcgacttcagccccggcacgtccggcagccccatcatcgacaagaaggggaaggtggtgggcctgtacgggaacggcgtcgtgacccggaacggctcctacgtgagcgcgatcgcccagaccgagaagtccatcgaggacaaccccgagatcgaggacgacatcttccgcaagaagcggctgaccatcatggacctgcaccccggggccggcaagacgaagcgctacctccccgccatcgtccgggaggcgatcaagcgcgggctgcgcaccctgatcctcgccccgacccgggtggtggccgccgagatggaggaggccctgcgcggcctgcccatccggtaccagacccccgcgatccgcgccgagcacacggggcgggagatcgtcgacctcatgtgccacgccaccttcaccatgcgcctgctgtcccccatccgggtgccgaactacaacctcatcatcatggacgaggcccacttcaccgaccccgccagcatcgcggcccgcggctacatctccacgcgggtggagatgggcgaggccgccgggatcttcatgaccgccacgccgcccggcagccgcgacccgttcccccagtccaacgcgcccatcatggacgaggagcgggagatccccgagcgcagctggaactccgggcacgagtgggtcaccgacttcaagggcaagacggtgtggttcgtgccgagcatcaaggccgggaacgacatcgccgcctgcctgcggaagaacggcaagaaggtcatccagctgtcccgcaagaccttcgacagcgagtacgtgaagacccggaccaacgactgggacttcgtggtcacgaccgacatctccgagatgggcgcgaacttcaaggccgagcgcgtgatcgacccccggcgctgcatgaagcccgtgatcctcaccgacggggaggagcgggtcatcctggccggccccatgccggtgacccacagctccgccgcccagcgccgcgggcggatcggccgcaaccccaagaacgagaacgaccagtacatctacatgggggagcccctggagaacgacgaggactgcgcgcactggaaggaggccaagatgctcctggacaacatcaacacgcccgagggcatcatcccgagcatgttcgagcccgagcgggagaaggtggacgccatcgacggcgagtaccgcctgcgcggggaggcccgcaagaccttcgtcgacctcatgcggcgcggcgacctgcccgtgtggctggcctacaaggtggcggccgaggggatcaactacgccgaccggcgctggtgcttcgacggcatccggaacaaccagatcctcgaggagaacgtcgaggtggagatctggaccaaggagggggagcgcaagaagctgaagccgcggtggctggacgcccgcatctactccgaccccctcgccctgaaggagttcaaggagttcgcggccggccggaagtccctgaccctcaacctgatcacggagatgggccgcctgcccaccttcatgacccagaaggcccgggacgccctcgacaacctggcggtcctgcacaccgccgaggccgggggccgcgcctacaaccacgccctctccgagctgcccgagacgctgcagatcagcctcctgctgaccctcctggcgaccgtgaccgggggcatcttcctgttcctcatgtccggccgggggatcggcaagatgacgctggggatgtgctgcatcatcaccgccagcatcctgctctggtacgcccagatccagccgcactggatcgccgccagcatcatcctggagttcttcctgatcgtgctcctgatccccgagcccgagaagcagcgcacgccccaggacaaccagctgacctacgtcgtgatcgcgatcctcaccgtggtcgccgccacgatggccaacgagatgggcttcctggagaagaccaagaaggacctggggctcggctccatcaccacccagcagccggagagcaacatcctggacatcgacctgcggcccgcctccgcgtggacgctctacgccgtggccaccaccttcatcacccccatgctgcgccacagcatcgagaactccagcgtgaacgtctccctgacggccatcgccaaccaggcgaccgtgctcatgggcctggggaagggctggcccctgagcaagatggacatcggggtgccgctcctggccatcggctgctactcccaggtcaaccccatcaccctgaccgccgccctcctgctgctcgtggcgcactacgccatcatcgggcccggcctgcaggccaaggccacgcgcgaggcccagaagcgggcggccgccggcatcatgaagaaccccaccgtggacgggatcaccgtcatcgacctggacccgatcccctacgaccccaagttcgagaagcagctcggccaggtgatgctgctggtgctctgcgtcacccaggtgctgatgatgcgcacgacctgggccctgtgcgaggccctcaccctggcgaccgggcccatcagcacgctgtgggagggcaacccggggcggttctggaacaccaccatcgccgtgtccatggccaacatcttccgcggcagctacctcgccggcgccgggctgctgttctccatcatgaagaacaccacgaacacccggcgcggcaccgggaacatcggcgagaccctcggcgagaagtggaagtcccggctgaacgcgctggggaagtccgagttccagatctacaagaagtccggcatccaggaggtcgaccgcacgctcgccaaggaggggatcaagcggggcgagaccgaccaccacgccgtgtcccgcgggagcgccaagctgcggtggttcgtggagcgcaacatgatcacccccgagggcaaggtcgtggacctgggctgcgggcggggcgggtggtcctactactgcggcgggctcaagaacgtgcgcgaggtcaagggcctgaccaagggcgggcccggccacgaggagcccatcccgatgagcacgtacgggtggaacctggtgcggctccagagcggcgtggacgtcttcttcacgccgcccgagaagtgcgacaccctgctgtgcgacatcggggagtccagccccaacccgaccgtggaggcgggccgcacgctccgggtgctgaacctggtcgagaactggctcaacaacaacacccagttctgcatcaaggtgctgaacccctacatgccctccgtgatcgagaagatggaggccctgcagcgcaagtacggcggggccctggtccggaacccgctcagccgcaactccacccacgagatgtactgggtgagcaacgcctccggcaacatcgtgagctccgtcaacatgatcagccgcatgctgatcaaccggttcaccatgaagcacaagaaggccacctacgagcccgacgtggacctggggtccggcacgcgcaacatcgggatcgagagcgaggtgcccaacctcgacatcatcggcaagcggatcgagaagatcaagcaggagcacgagacctcctggcactacgaccaggaccacccctacaagacctgggcgtaccacggcagctacgagaccaagcagacggggtccgccagctccatggtcaacggcgtggtgcgcctgctgaccaagccgtgggacgtcatccccatggtgacccagatggccatgaccgacacgacccccttcgggcagcagcgggtgttcaaggagaaggtcgacacccgcacccaggagcccaaggagggcacgaagaagctcatgaagatcaccgccgagtggctgtggaaggagctgggcaagaagaagaccccgcggatgtgcacccgcgaggagttcacgcggaaggtgcgcagcaacgccgcgctcggggccatcttcaccgacgagaacaagtggaagtccgcccgggaggccgtggaggacagccgcttctgggagctggtcgacaaggagcggaacctgcacctcgagggcaagtgcgagacctgcgtgtacaacatgatggggaagcgcgagaagaagctgggcgagttcgggaaggccaagggcagccgggcgatctggtacatgtggctgggcgcccgcttcctcgagttcgaggccctggggttcctgaacgaggaccactggttctcccgggagaacagcctctccggcgtcgagggggagggcctgcacaagctggggtacatcctccgcgacgtgagcaagaaggagggcggcgccatgtacgcggacgacaccgccgggtgggacacgcggatcaccctggaggacctgaagaacgaggagatggtgaccaaccacatggagggcgagcacaagaagctcgccgaggccatcttcaagctgacctaccagaacaaggtcgtgcgcgtgcagcggcccacgccccgcgggaccgtcatggacatcatctcccgccgggaccagcgcggcagcggccaggtgggcacctacggcctgaacaccttcacgaacatggaggcccagctcatccggcagatggagggggagggcgtgttcaagtccatccagcacctgaccgcgaccgaggagatcgccgtccagaactggctggcccgcgtggggcgggagcgcctcagccggatggccatctccggcgacgactgcgtggtcaagcccctggacgaccgcttcgccagcgcgctgaccgccctcaacgacatgggcaaggtgcggaaggacatccagcagtgggagccgtccaaggggtggaacgactggacccaggtgcccttctgcagccaccacttccacgagctgatcatgaaggacggccgcgtcctggtggtgccctgccggaaccaggacgagctcatcgggcgcgcccggatctcccagggcgccgggtggagcctgcgcgagaccgcctgcctgggcaagtcctacgcgcagatgtggagcctcatgtacttccaccggcgcgacctgcggctggccgccaacgccatctgctccgccgtccccagccactgggtgccgaccagccgcaccacgtggtccatccacgcgaagcacgagtggatgaccaccgaggacatgctcaccgtgtggaaccgggtctggatccaggagaacccctggatggaggacaagacccccgtggagagctgggaggagatcccctacctgggcaagcgcgaggaccagtggtgcgggtccctgatcggcctcacgagccgcgccacctgggccaagaacatccagaccgccatcaaccaggtgcggtccctgatcgggaacgaggagtacaccgactacatgccgagcatgaagcgcttccggcgcgaggaggaggaggcgggcgtcctgtggtga

SEQ ID NO: 9020 - RNA, 9876 nt, synthetic construct
  misc_feature 1..9876: note = derived and/or modified CDS sequence (opt1) from DENV-2__KF744407__SS-prME
  source 1..9876: mol_type = other RNA
accgccggcatgatcatcatgctgatccccaccgtgatggccttccacctcaccacccggaacggggagccccacatgatcgtcagccggcaggagaagggcaagagcctgctgttcaagaccgaggacggggtgaacatgtgcaccctcatggcgatggacctgggcgagctgtgcgaggacaccatcacctacaagtgccccctcctgcggcagaacgagcccgaggacatcgactgctggtgcaacagcacctccacctgggtgacctacgggacctgcaccaccacgggcgagcaccggcgcgagaagcggagcgtcgccctggtgccccacgtgggcatggggctcgagacccgcaccgagacctggatgtccagcgagggcgcctggaagcacgcccagcggatcgagacgtggatcctgcgccaccccgggttcaccctgatggccgcgatcctcgcctacaccatcggcaccacgaacttccagcgggccctgatcttcatcctgctcaccgccgtcgcgccctccatgaccatgcgctgcatcgggatcagcaaccgggacttcgtggagggcgtgtccggcgggagctgggtcgacatcgtgctggagcacggctcctgcgtgaccacgatggccaagaacaagcccaccctggacttcgagctcatcaagaccgaggccaagcaccccgccaccctgcgcaagtactgcatcgaggccaagctgacgaacaccaccaccgcgagccggtgcccgacgcagggggagccctccctcaacgaggagcaggacaagcgcttcgtctgcaagcacagcatggtggaccggggctggggcaacgggtgcggcctgttcgggaagggcgggatcgtgacctgcgccatgttcacgtgcaagaagaacatggagggcaaggtcgtgcagcccgagaacctggagtacaccatcgtgatcacgccccactccggcgaggagcacgccgtcgggaacgacaccggcaagcacgggaaggagatcaagatcaccccgcagagctccatcaccgaggccgagctcaccggctacgggacggtgaccatggagtgcagcccccgcaccggcctggacttcaacgagatggtgctgctccagatggagaacaaggcctggctggtccaccggcagtggttcctggacctccccctgccctggctgccgggcgcggacacccaggggtccaactggatccagaaggagacgctcgtgaccttcaagaacccccacgccaagaagcaggacgtggtcgtgctgggcagccaggagggggccatgcacaccgccctgaccggcgccacggagatccagatgagctccgggaacctcctgttcaccggccacctgaagtgccgcctccggatggacaagctgcagctgaagggcatgagctactccatgtgcaccgggaagttcaaggtcgtgaaggagatcgcggagacccagcacggcacgatcgtggtccgcgtgcagtacgagggggacggcagcccctgcaagatccccttcgagatcatggacctcgagaagcggcacgtgctgggccgcctgatcaccgtcaacccgatcgtgaccgagaaggactcccccgtgaacatcgaggccgagccgcccttcggggacagctacgtcatcatcggcgtggagccggggcagctcaagctgaactggttcaagaagggctccagcatcgggcagatgttcgagaccacgatgcgcggcgccaagcggatggccatcctgggcgacaccgcctgggacttcgggtccctcggcggggtgttcaccagcatcggcaaggcgctgcaccaggtcttcggggccatctacggcgccgccttctccggcgtgagctggaccatgaagatcctgatcggggtgatcatcacgtggatcggcatgaactcccgcagcacctccctgagcgtctccctcgtgctggtgggggtcgtgaccctgtacctcggcgtgatggtccaggcggacagcgggtgcgtggcctcctggaagaacaaggagctgaagtgcggcagcggcatcttcatcaccgacaacgtgcacacgtggaccgagcagtacaagttccagcccgagagcccctccaagctggccagcgccatccagaaggcccaccaggaggggatctgcggcatccggtccgtcacccgcctcgagaacctgatgtggaagcagatcacccccgagctgaaccacatcctcagcgagaacgaggtgaagctgacgatcatgaccggggacatcaagggcatcatgcacgcggggaagcggtccctgcgcccgcagcccaccgagctccggtacagctggaagacctggggcaaggccaagatcctgtccacggagagccacaaccagaccttcctgatcgacggccccgagaccgccgagtgcccgaacaccaaccgcgcctggaactccctcgaggtggaggactacgggttcggcgtcttcacgaccaacatctggctgcggctgcgcgagaagcaggacgccttctgcgacagcaagctcatgtccgcggccatcaaggacaaccgggccgtgcacgccgacatggggtactggatcgagagcgccctgaacgacacctggaagatcgagaaggcgtccttcatcgaggtcaagagctgccactggcccaagtcccacaccctgtggagcaacggcgtgctcgagtccgagatgatcatccccaagaacttcgccggccccgtgagccagcacaactaccgcccggggtaccacacccagacggccggcccctggcacctggggaagctggagatggacttcgacttctgcgagggcaccaccgtggtcgtgaccgaggactgcgggaaccggggccccagcctccgcacgaccaccgcctccggcaagctgatcaccgagtggtgctgccggagctgcacgctgcccccgctccgctaccgcggggaggacggctgctggtacgggatggagatccgccccctgaaggagaaggaggagaacctggtgtccagcctcgtcaccgcgggccacgggcagatcgacaacttctccctgggcgtgctgggcatggccctcttcctggaggagatgctgcggacccgcgtggggaccaagcacgccatcctcctggtcgccgtgagcttcgtgacgctgatcaccggcaacatgtccttccgcgacctcgggcgggtcatggtgatggtgggcgccaccatgaccgacgacatcgggatgggcgtcacgtacctggcgctgctcgccgccttcaaggtgcgccccaccttcgccgccggcctgctgctccggaagctgaccagcaaggagctgatgatgaccacgatcgggatcgtgctcctgtcccagagcaccatccccgagaccatcctggagctcaccgacgcgctggccctgggcatgatggtcctcaagatcgtgcgcaacatggagaagtaccagctggccgtgacgatcatggccatcctgtgcgtcccgaacgccgtgatcctccagaacgcgtggaaggtctcctgcaccatcctggccgtggtgagcgtcagccccctgctcctgaccagctcccagcagaaggccgactggatccccctggccctcaccatcaaggggctgaaccccacggcgatcttcctgaccaccctcagccggacctccaagaagcgcagctggccgctgaacgaggccatcatggccgtgggcatggtgtccatcctggccagcagcctcctgaagaacgacatccccatgacgggccccctggtcgccgggggcctcctgaccgtgtgctacgtgctgaccgggcggtccgcggacctcgagctggagaaggccgccgacgtccgctgggaggagcaggccgagatcagcggctccagccccatcctgtccatcatcatcagcgaggacgggtccatgagcatcaagaacgaggaggaggagcagaccctcacgatcctgatccggaccggcctgctcgtgatctccggcctgttcccggtgagcatccccatcaccgccgcggcctggtacctgtgggaggtcaagaagcagcgcgccggggtgctctgggacgtgcccagcccgccgcccgtcggcaaggccgagctggaggacggggcctaccggatcaagcagaagggcatcctggggtacagccagatcggcgcgggcgtgtacaaggaggggaccttccacaccatgtggcacgtgacgcgcggcgccgtcctcatgcacaaggggaagcggatcgagccctcctgggccgacgtgaagaaggacctgatcagctacggcgggggctggaagctggagggcgagtggaaggagggggaggaggtgcaggtcctcgccctggagcccggcaagaacccccgcgccgtgcagaccaagcccgggctgttcaagaccaacgcgggcaccatcggggccgtgtccctcgacttcagccccggcacgtccggcagccccatcatcgacaagaaggggaaggtcgtgggcctgtacgggaacggcgtggtcacccggaacggctcctacgtgagcgccatcgcccagaccgagaagtccatcgaggacaaccccgagatcgaggacgacatcttccgcaagaagcggctgaccatcatggacctgcaccccggggcgggcaagacgaagcgctacctccccgccatcgtgcgggaggccatcaagcgcgggctgcggaccctgatcctcgccccgacccgcgtcgtggccgcggagatggaggaggccctgcgcggcctgcccatccggtaccagacccccgccatccgcgccgagcacacggggcgggagatcgtggacctcatgtgccacgccaccttcaccatgcgcctgctgtcccccatccgggtcccgaactacaacctcatcatcatggacgaggcgcacttcaccgaccccgccagcatcgccgcccgcggctacatctccacgcgggtggagatgggcgaggccgcggggatcttcatgaccgccacgccgcccggcagccgcgacccgttcccccagtccaacgcccccatcatggacgaggagcgggagatccccgagcgcagctggaactccgggcacgagtgggtgaccgacttcaagggcaagacggtctggttcgtgccgagcatcaaggccgggaacgacatcgcggcctgcctgcggaagaacggcaagaaggtgatccagctgtcccgcaagaccttcgacagcgagtacgtcaagacccggaccaacgactgggacttcgtggtgacgaccgacatctccgagatgggcgccaacttcaaggccgagcgcgtcatcgacccccggcgctgcatgaagcccgtgatcctcaccgacggggaggagcgggtgatcctggccggccccatgccggtcacccacagctccgcggcccagcgccgggggcgcatcggccgcaaccccaagaacgagaacgaccagtacatctacatgggggagcccctggagaacgacgaggactgcgcccactggaaggaggccaagatgctcctggacaacatcaacacgcccgagggcatcatcccgagcatgttcgagcccgagcgggagaaggtggacgccatcgacggcgagtaccgcctgcgcggggaggcgcgcaagaccttcgtggacctcatgcggcgcggcgacctgcccgtctggctggcctacaaggtggccgccgaggggatcaactacgccgaccggcgctggtgcttcgacggcatccggaacaaccagatcctcgaggagaacgtggaggtcgagatctggaccaaggagggggagcgcaagaagctgaagccgcggtggctggacgcgcgcatctactccgaccccctcgccctgaaggagttcaaggagttcgccgccggccggaagtccctgaccctcaacctgatcacggagatgggccgcctgcccaccttcatgacccagaaggcgcgggacgccctcgacaacctggccgtgctgcacaccgccgaggccgggggccgcgcgtacaaccacgccctctccgagctgcccgagacgctggagaccctcctgctgctcaccctgctggccaccgtcaccggcgggatcttcctcttcctgatgagcgggaaggggatcggcaagatgaccctggggatgtgctgcatcatcaccgcctccgtgctcctgtggtacgcccagatccagccgcactggatcgcggccagcatcatcctggagttcttcctcatcgtgctgctgatccccgagcccgagaagcagcggacgccccaggacaaccagctcacctacgtcgtgatcgccatcctgacggtggtcgccgccaccatggcgaacgagatgggcttcctggagaagaccaagaaggacttcgggctcggcagcatcgccacccagcagccggagtccaacatcctggacatcgacctgcgccccgccagcgcctggacgctctacgccgtggcgaccaccttcatcacccccatgctgcggcactccatcgagaacagctccgtgaacgtcagcctgacggccatcgccaaccaggccaccgtgctcatgggcctggggaagggctggcccctgtccaagatggacatcggggtgccgctcctggcgatcggctgctacagccaggtcaaccccatcaccctgaccgccgccctcctgctgctcgtggcccactacgccatcatcgggcccggcctgcaggcgaaggccacgcgcgaggcccagaagcgggccgccgcgggcatcatgaagaaccccaccgtggacgggatcaccgtcatcgacctggacccgatcccctacgaccccaagttcgagaagcagctcggccaggtgatgctgctggtgctctgcgtcacccaggtgctgatgatgcgcacgacctgggccctgtgcgaggccctcaccctggccaccgggcccatctccacgctgtgggagggcaacccggggcgcttctggaacaccaccatcgccgtgagcatggcgaacatcttccggggctcctacctcgccggcgccgggctgctgttcagcatcatgaagaacaccacgaacacccgccggggcaccgggaacatcggcgagaccctcggcgagaagtggaagtcccgcctgaacgccctgggcaagagcgagttccagatctacaagaagtccggcatccaggaggtcgaccggacgctcgcgaaggaggggatcaagcgcggcgagaccgaccaccacgccgtgagccgggggtccgccaagctgcgctggttcgtggagcggaacatgatcacccccgagggcaaggtcgtggacctgggctgcgggcgcggcgggtggagctactactgcggcgggctcaagaacgtgcgggaggtcaagggcctgaccaagggcgggcccggccacgaggagcccatcccgatgtccacgtacgggtggaacctggtgcgcctccagagcggcgtggacgtcttcttcacgccgcccgagaagtgcgacaccctgctgtgcgacatcggggagagctcccccaacccgaccgtggaggccggccggacgctccgcgtgctgaacctggtcgagaactggctcaacaacaacacccagttctgcatcaaggtgctgaacccctacatgcccagcgtgatcgagaagatggaggccctgcagcggaagtacggcggggcgctggtccgcaacccgctctcccggaacagcacccacgagatgtactgggtgtccaacgccagcggcaacatcgtgtccagcgtcaacatgatctcccgcatgctgatcaaccggttcaccatgaagcacaagaaggccacctacgagcccgacgtggacctggggagcggcacgcgcaacatcgggatcgagtccgaggtgcccaacctcgacatcatcggcaagcgcatcgagaagatcaagcaggagcacgagaccagctggcactacgaccaggaccacccctacaagacctgggcctaccacggctcctacgagaccaagcagacggggagcgcctccagcatggtcaacggcgtggtgcggctgctgaccaagccgtgggacgtcatccccatggtgacccagatggcgatgaccgacacgacccccttcgggcagcagcgcgtgttcaaggagaaggtcgacacccggacccaggagcccaaggagggcacgaagaagctcatgaagatcaccgccgagtggctgtggaaggagctgggcaagaagaagaccccgcgcatgtgcacccgggaggagttcacgcgcaaggtgcggtccaacgccgccctcggggccatcttcaccgacgagaacaagtggaagtccgcgcgcgaggccgtggaggactcccggttctgggagctggtcgacaaggagcgcaacctgcacctcgagggcaagtgcgagacctgcgtgtacaacatgatggggaagcgggagaagaagctgggcgagttcgggaaggccaagggcagccgcgccatctggtacatgtggctgggcgcgcggttcctcgagttcgaggccctggggttcctgaacgaggaccactggttcagccgcgagaactccctcagcggcgtcgagggggagggcctgcacaagctggggtacatcctccgggacgtgtccaagaaggagggcggcgccatgtacgccgacgacaccgccgggtgggacacgcgcatcaccctggaggacctgaagaacgaggagatggtgaccaaccacatggagggcgagcacaagaagctcgcggaggccatcttcaagctgacctaccagaacaaggtcgtgcgggtgcagcgccccacgccccgggggaccgtcatggacatcatcagccgccgggaccagcgcggctccggccaggtggggacctacggcctgaacaccttcacgaacatggaggcccagctcatccgccagatggagggggagggcgtgttcaagagcatccagcacctgaccgccaccgaggagatcgccgtccagaactggctgacccgggtggggcgcgagcggctctcccgcatggcgatcagcggcgacgactgcgtggtcaagcccctggacgaccggttcgcctccgccctgacggccctcaacgacatgggcaaggtgcgcaaggacatccagcagtgggagccgagcaaggggtggaacgactggacccaggtgcccttctgctcccaccacttccacgagctgatcatgaaggacggccgggtcctggtggtgccctgccgcaaccaggacgagctcatcgggcgggcccgcatcagccagggcgcggggtggtccctgcgggagaccgcctgcctgggcaagagctacgcccagatgtggtccctcatgtacttccaccgccgggacctgcgcctggccgccaacgcgatctgcagcgccgtcccctcccactgggtgccgaccagccggacgacctggagcatccacgccaagcacgagtggatgaccaccgaggacatgctcaccgtgtggaaccgcgtctggatccaggagaacccctggatggaggacaagacgcccgtggagtcctgggaggagatcccctacctgggcaagcgggaggaccagtggtgcgggagcctgatcggcctcacctcccgcgccacctgggcgaagaacatccagaccgccatcaaccaggtgcggagcctgatcgggaacgaggagtacacggactacatgccgtccatgaagcgcttccgccgggaggaggaggaggccggcgtcctgtggtga

SEQ ID NO: 9021 - RNA, 9876 nt, synthetic construct
  misc_feature 1..9876: note = derived and/or modified CDS sequence (opt1) from DENV-2__KF744399__SS-prME
  source 1..9876: mol_type = other RNA
accgccggcatgatcatcatgctgatccccaccgtgatggccttccacctcaccacccgcaacggggagccccacatgatcgtgagccggcaggagaagggcaagagcctgctgttcaagaccgaggacggggtgaacatgtgcaccctcatggcgatggacctgggcgagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggagcgtcgccctggtgccccacgtgggcatggggctcgagacccgcaccgagacctggatgagcagcgagggcgcctggaagcacgcccagcggatcgagacgtggatcctgcgccacccggggttcaccctgatggccgcgatcctcgcctacaccatcggcaccacgaacttccagcgggccctgatcttcatcctgctcaccgccgtcgcgcccagcatgaccatgcgctgcatcgggatcagcaaccgggacttcgtggagggcgtgtccggcgggagctgggtcgacatcgtgctggagcacggctcctgcgtgaccacgatggccaagaacaagcccaccctggacttcgagctcatcaagaccgaggccaagcaccccgccaccctgcgcaagtactgcatcgaggccaagctgacgaacaccaccaccgagagccggtgcccgacgcagggggagccctccctcaacgaggagcaggacaagcgcttcgtctgcaagcacagcatggtggaccggggctggggcaacgggtgcggcctgttcgggaagggcgggatcgtgacctgcgcgatgttcacgtgcaagaagaacatggagggcaagatcgtccagcccgagaacctggagtacaccatcgtgatcacgccccactccggcgaggagaacgccgtggggaacgacaccggcaagcacgggaaggagatcaaggtcaccccgcagagctccatcaccgaggccgagctcaccggctacgggacggtgaccatggagtgcagcccccgcaccggcctgggcttcaacgagatggtgctgctccagatggagaacaaggcctggctggtccaccggcagtggttcctggacctccccctgccctggctgccgggggccgacacccagggctccaactggatccagaaggagacgctcgtgaccttcaagaacccccacgcgaagaagcaggacgtggtcgtgctggggagccaggagggcgccatgcacaccgccctgaccggggccacggagatccagatgagctccggcaacctcctgttcaccggccacctgaagtgccgcctccggatggacaagctgcagctgaaggggatgagctactccatgtgcaccggcaagttcaaggtcgtgaaggagatcgccgagacccagcacgggacgatcgtggtccgcgtgcagtacgagggcgacggcagcccctgcaagatccccttcgagatcatggacctcgagaagcggcacgtgctggggcgcctgatcaccgtcaacccgatcgtgaccgagaaggactcccccgtgaacatcgaggcggagccgcccttcggcgacagctacgtcatcatcggggtggagccgggccagctcaagctgtcctggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtggtcatcacgtggatcgggatgaacagccgctccaccagcctgtccgtgagcctcgtgctggtcggcgtggtgaccctgtacctcggggtcatggtgcaggccgactccggctgcgtggtcagctggaagaacaaggagctgaagtgcggcagcgggatcttcatcaccgacaacgtgcacacgtggaccgagcagtacaagttccagcccgagtcccccagcaagctggcgtccgccatccagaaggcccaccaggagggcatctgcgggatccggagcgtgacccgcctcgagaacctgatgtggaagcagatcacccccgagctgaaccacatcctctccgagaacgaggtcaagctgacgatcatgaccggcgacatcaaggggatcatgcacgccggcaagcggagcctgcgcccgcagcccaccgagctccggtactcctggaaggcctggggcaaggcgaagatcctgagcaccgagctgcacaaccagacgttcctcatcgacgggcccgagaccgccgagtgcccgaacaccaaccgcgcctggaactccctggaggtggaggactacggcttcggggtgttcaccacgaacatctggctgaagctccgggagaagcaggacgccttctgcgacagcaagctgatgtccgccgcgatcaaggacaaccgcgccgtccacgccgacatgggctactggatcgagagcgccctgaacgacacctggaagatcgagaaggcctccttcatcgaggtcaagagctgccactggcccaagtcccacaccctctggagcaacggcgtgctggagtccgagatgatcatccccaagaacttcgcggggcccgtgagccagcacaactaccggccgggctaccacacccagaccgccgggccctggcacctgggcaagctcgagatggacttcgacttctgcaaggggacgaccgtggtggtcaccgaggactgcggcaaccgcggccccagcctgcggaccacgaccgcctccgggaagctgatcaccgagtggtgctgccgcagctgcaccctcccgcccctgcggtaccgcggcgaggacgggtgctggtacggcatggagatccggcccctgaaggagaaggaggagaacctcgtgaactccctggtgacggccgggcacggccagatcgacaacttcagcctgggcgtcctcgggatggcgctgttcctggaggagatgctccgcacccgggtgggcaccaagcacgccatcctgctggtggccgtctccttcgtgaccctcatcacggggaacatgagcttccgcgacctgggccgcgtgatggtcatggtgggggccaccatgaccgacgacatcggcatgggcgtgacctacctggccctcctggcggccttcaaggtccggcccacgttcgccgccgggctgctcctgcgcaagctgacctccaaggagctcatgatgaccaccatcggcatcgtgctgctgagccagtccacgatccccgagaccatcctcgagctgaccgacgccctggcgctcgggatgatggtgctgaagatcgtccggaagatggagcgctaccagctggccgtgaccatcatggccatcctctgcgtccccaacgccgtgatcctgcagaacgcctggaaggtgagctgcacgatcctggcggtcgtgtccgtgagccccctcctgctgacctccagccagcagaaggccgactggatccccctcgccctgaccatcaagggcctgaaccccaccgccatcttcctcacgaccctgtcccggaccagcaagaagcgctcctggccgctgaacgaggcgatcatggccgtcggcatggtgagcatcctcgcctccagcctgctgaagaacgacatccccatgaccgggcccctcgtggccggcgggctgctgacggtctgctacgtgctcaccggccggagcgccgacctggagctggagaaggcggccgacgtgcgctgggaggagcaggccgagatctccgggagctcccccatcctcagcatcatcatctccgaggacggcagcatgtccatcaagaacgaggaggaggagcagaccctgaccatcctgatccggacgggcctcctggtcatcagcgggctgttcccggtgtccatccccatcaccgccgccgcgtggtacctctgggaggtgaagaagcagcgcgccggcgtcctgtgggacgtgccctccccgccgcccgtggggaaggccgagctggaggacggcgcctaccggatcaagcagaaggggatcctcggctactcccagatcggcgccggggtctacaaggagggcaccttccacaccatgtggcacgtgacccgcggggcggtgctgatgcacaagggcaagcggctggagcccagctgggccgacgtcaagaaggacctcatctcctacgggggcggctggaagctggagggggagtggaaggagggcgaggaggtccaggtgctggccctcgagcccgggaagaacccccgcgccgtccagacgaagcccggcctgttcaagaccaacaccgggaccatcggcgccgtgagcctggacttctcccccggcacgagcgggtcccccatcatcgacaagaagggcaaggtggtcgggctgtacggcaacggcgtggtgacccggaacgggagctacgtctccgcgatcgcccagaccgagaagtccatcgaggacaaccccgagatcgaggacgacatcttccgcaagaagcggctcaccatcatggacctgcaccccggcgccgggaagacgaagcgctacctgcccgccatcgtgcgggaggcgatcaagcgcggcctccggaccctgatcctggccccgacccgcgtggtcgccgccgagatggaggaggccctccgcgggctgcccatccggtaccagacccccgcgatccgcgccgagcacacgggccgggagatcgtggacctgatgtgccacgccaccttcaccatgcgcctcctgagccccatccgggtgccgaactacaacctgatcatcatggacgaggcccacttcaccgaccccgcctccatcgcggcccgcggctacatcagcacgcgggtcgagatgggggaggccgccggcatcttcatgaccgccacgccgcccgggtcccgcgacccgttcccccagagcaacgcgcccatcatggacgaggagcgggagatccccgagcgctcctggaacagcggccacgagtgggtgaccgacttcaaggggaagacggtgtggttcgtcccgtccatcaaggccggcaacgacatcgccgcctgcctccggaagaacggcaagaaggtgatccagctgagccgcaagaccttcgactccgagtacgtgaagacccggaccaacgactgggacttcgtcgtgacgaccgacatcagcgagatgggggcgaacttcaaggccgagcgcgtgatcgacccccggcgctgcatgaagcccgtcatcctgaccgacggcgaggagcgggtgatcctcgccgggcccatgccggtgacccactccagcgccgcccagcgccggggccgcatcgggcgcaaccccaagaacgagaacgaccagtacatctacatgggcgagcccctggagaacgacgaggactgcgcgcactggaaggaggccaagatgctgctcgacaacatcaacacgcccgagggcatcatcccgtccatgttcgagcccgagcgggagaaggtcgacgccatcgacggggagtaccgcctgcggggcgaggcccgcaagaccttcgtggacctgatgcggcgcggggacctccccgtgtggctggcctacaaggtcgcggccgagggcatcaactacgccgaccggcgctggtgcttcgacgggatccggaacaaccagatcctggaggagaacgtggaggtcgagatctggaccaaggagggcgagcgcaagaagctcaagccgcggtggctggacgcccgcatctacagcgaccccctggccctcaaggagttcaaggagttcgcggccggccggaagtccctgaccctgaacctcatcacggagatggggcgcctgcccaccttcatgacccagaaggcccgggacgccctggacaacctcgcggtgctgcacaccgccgaggccggcgggcgcgcctacaaccacgccctgagcgagctccccgagacgctggagaccctgctcctgctgaccctcctggcgaccgtgacgggcggcatcttcctgttcctcatgtccgggaagggcatcgggaagatgaccctgggcatgtgctgcatcatcaccgccagcgtcctgctctggtacgcccagatccagccgcactggatcgccgcctccatcatcctggagttcttcctgatcgtgctcctgatccccgagcccgagaagcagcggacgccccaggacaaccagctgacctacgtggtcatcgcgatcctcacggtggtggccgccaccatggccaacgagatggggttcctggagaagaccaagaaggacttcggcctgggcagcatcgccacccagcagccggagagcaacatcctcgacatcgacctgcgccccgcgtccgcctggacgctgtacgccgtcgccaccaccttcatcacccccatgctccggcacagcatcgagaactccagcgtgaacgtgtccctgacggccatcgcgaaccaggccaccgtcctgatggggctcggcaaggggtggcccctgagcaagatggacatcggcgtgccgctgctcgccatcgggtgctactcccaggtgaaccccatcaccctgaccgccgcgctgctcctgctggtcgcccactacgccatcatcggccccggcctccaggccaaggccacgcgcgaggcgcagaagcgggccgccgccgggatcatgaagaaccccaccgtggacggcatcaccgtgatcgacctggacccgatcccctacgaccccaagttcgagaagcagctggggcaggtcatgctcctggtgctgtgcgtgacccaggtcctcatgatgcgcacgacctgggccctgtgcgaggcgctgaccctcgccaccggccccatcagcacgctgtgggaggggaacccgggccgcttctggaacaccaccatcgccgtgtccatggccaacatcttccggggcagctacctggccggggcgggcctcctgttctccatcatgaagaacaccacgaacacccgccgggggaccggcaacatcggcgagaccctgggggagaagtggaagtcccgcctcaacgccctgggcaagtccgagttccagatctacaagaagtccgggatccaggaggtggaccggacgctggccaaggagggcatcaagcgcggggagaccgaccaccacgccgtctcccggggcagcgcgaagctccgctggttcgtggagcggaacatggtgacccccgagggcaaggtcgtggacctggggtgcggccgcgggggctggtcctactactgcgggggcctgaagaacgtgcgggaggtcaagggcctcaccaagggcgggcccgggcacgaggagcccatcccgatgagcacgtacggctggaacctggtgcgcctgcagtccggggtggacgtcttcttcacgccgcccgagaagtgcgacaccctcctgtgcgacatcggcgagagcagccccaacccgaccgtggaggccggccggacgctgcgcgtgctcaacctggtcgagaactggctgaacaacaacacccagttctgcatcaaggtgctgaacccctacatgccctccgtgatcgagaagatggaggccctccagcggaagtacgggggcgccctggtccgcaacccgctgagccggaactccacccacgagatgtactgggtgagcaacgcctccgggaacatcgtgagctccgtcaacatgatcagccgcatgctcatcaaccggttcaccatgcgccacaagaaggcgacctacgagcccgacgtggacctgggctccgggacgcgcaacatcggcatcgagagcgagatccccaacctggacatcatcggcaagcggatcgagaagatcaagcaggagcacgagacctcctggcactacgaccaggaccacccctacaagacctgggcctaccacgggagctacgagaccaagcagacgggctccgccagctccatggtgaacggggtcgtgcgcctcctgaccaagccgtgggacgtgatccccatggtcacccagatggccatgaccgacacgacccccttcggccagcagcgggtgttcaaggagaaggtggacacccgcacccaggagcccaaggagggcacgaagaagctgatgaagatcaccgccgagtggctctggaaggagctggggaagaagaagaccccgcggatgtgcacccgcgaggagttcacgcggaaggtccgcagcaacgcggccctgggcgccatcttcaccgacgagaacaagtggaagtccgcccgggaggccgtggaggacagccgcttctgggagctcgtcgacaaggagcggaacctgcacctggaggggaagtgcgagacctgcgtgtacaacatgatgggcaagcgcgagaagaagctcggggagttcggcaaggcgaagggctcccgggccatctggtacatgtggctgggggcccgcttcctggagttcgaggccctcggcttcctgaacgaggaccactggttcagccgggagaacagcctgtccggggtggagggcgaggggctccacaagctgggctacatcctgcgcgaggtcagcaagaaggagggcggggcgatgtacgccgacgacaccgccggctgggacacgcggatcaccctcgaggacctgaagaacgaggagatggtgaccaaccacatggagggggagcacaagaagctggccgaggccatcttcaagctcacctaccagaacaaggtggtccgcgtgcagcggcccacgccccgcggcaccgtgatggacatcatctcccggcgcgaccagcgcgggagcggccaggtcggcacctacgggctgaacaccttcacgaacatggaggcgcagctgatccggcagatggagggcgagggggtgttcaagtccatccagcacctcaccgccaccgaggagaacgccgtgcagaactggctggcccgcgtcggccgggagcgcctgagccggatggccatctccggcgacgactgcgtggtgaagcccctcgacgaccgcttcgcgagcgccctgaccgccctgaacgacatggggaaggtccggaaggacatccagcagtgggagccgtcccgcggctggaacgactggacccaggtgcccttctgcagccaccacttccacgagctcatcatgaaggacgggcgggtgctggtcgtgccctgccgcaaccaggacgagctgatcggccgggcccgcatctcccagggggccggctggagcctccgggagaccgcgtgcctgggcaagtcctacgcccagatgtggagcctgatgtacttccaccgccgggacctccgcctggccgccaacgccatctgctccgcggtgcccagccactgggtcccgacctcccggaccacgtggagcatccacgccaagaacgagtggatgaccaccgaggacatgctgaccgtgtggaaccgcgtgtggatccaggagaacccctggatggaggacaagacccccgtcgagagctgggaggagatcccctacctcgggaagcgggaggaccagtggtgcggctccctgatcgggctgacgagccgcgccacctgggccaagaacatccagaccgcgatcaaccaggtgcgctccctcatcggcaacgaggagtacaccgactacatgccgagcatgaagcggttccgccgggaggaggaggaggccggggtgctgtggtga

SEQ ID NO: 9022 - RNA, 9876 nt, synthetic construct
  misc_feature 1..9876: note = derived and/or modified CDS sequence (opt1) from DENV-2__JX286516__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcatcgtgaccatggagtgcagcccccggaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcaccgacctggagaagcggcacgtcctcgggcgcctgatcaccgtgaacccgatcgtgaccgagaaggacagccccgtcaacatcgaggcggagccgcccttcggcgactcctacatcatcgtgggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcatcgtgagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtcacccgcctggagaacctcatgtggaagcagatcacgcccgagctgaaccacatcctgtccgagaacgaggtgaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtcgtggtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcgtcggcacgaagcacgcgatcctgctcgtggccctgagcttcgtgaccctgatcaccgggaacatgtccttccgggacctcggccgcgtcatggtgatggtgggggccaccatgacggacgacatcggcatgggcgtcacctacctggccctgctcgccgcgttcaaggtgcgccccaccttcgccgccgggctgctgctccggaagctgaccagcaaggagctgatgatggccacgatcggcatcgccctcctgtcccagagcaccctgcccgagaccatcctcgagctgaccgacgcgctggccctcgggatgatggccctgaagatcgtgcgcaacatggagaagtaccagctggccgtcacgatcatggccatctcctgcgtgccgaacgcggtgatcctccagaacgcctggaaggtcagctgcaccatcctggccgccgtgtccgtgagccccctgctcctgacctccagccagcagaaggcggactggatccccctggccctcaccatcaagggcctgaaccccacggccatcttcctgaccaccctctcccggaccagcaagaagcgctcctggccgctgaacgaggccatcatggccgtcggcatggtgagcatcctggcgtccagcctcctgaagaacgacatccccatgacggggcccctggtcgccggcgggctcctgaccgtgtgctacgtgctgaccggccggagcgccgacctcgagctggagcgcgccgccgacgtcaagtgggaggaccaggcggagatctccgggagctcccccatcctgagcatcaccatctccgaggacggcagcatgtccatcaagaacgaggaggaggagcagacgctcaccatcctgatccggaccggcctgctcgtgatcagcggggtgttcccggtctccatccccatcaccgccgccgcctggtacctgtgggaggtgaagaagcagcgcgccggcgtgctgtgggacgtccccagcccgccgcccgtggggaaggcggagctcgaggacggcgcctaccggatcaagcagcgcgggatcctgggctactcccagatcggcgccggggtgtacaaggagggcaccttccacacgatgtggcacgtcacccgcggggccgtgctgatgcaccgcggcaagcggatcgagcccagctgggccgacgtgaagaaggacctcatctcctacgggggcggctggaagctggagggggagtggaaggagggcgaggaggtccaggtgctggcgctcgagcccgggaagaacccccgcgccgtgcagaccaagcccggcatcttcaagaccaacacggggaccatcggcgccgtcagcctggacttctcccccggcaccagcgggtcccccatcgtggaccggaagggcaaggtggtcgggctgtacggcaacggcgtggtgacccgcagcggggcctacgtctccgcgatcgcccagacggagaagtccatcgaggacaaccccgagatcgaggacgacatcttccggaagaagcgcctcaccatcatggacctgcaccccggcgccgggaagaccaagcggtacctgcccgccatcgtgcgcgaggccatcaagcggggcctgcgcaccctcatcctggcgccgacgcgcgtggtcgccgccgagatggaggaggccctgcgggggctccccatccgctaccagacccccgccatccgggcggagcacaccggccgcgagatcgtggacctgatgtgccacgccaccttcacgatgcggctgctcagccccgtgcgcgtcccgaactacaacctgatcatcatggacgaggcccacttcaccgaccccgcctccatcgccgcgcggggctacatcagcacccgcgtggagatgggggaggccgccggcatcttcatgaccgccacgccgcccgggtcccgggacccgttcccccagagcaacgcgcccatcatggacgaggagcgcgagatccccgagcggtcctggaacagcggccacgagtgggtgaccgacttcaaggggaagaccgtctggttcgtgccgtccatcaaggccggcaacgacatcgccgcctgcctgcgcaagaacggcaagaaggtgatccagctcagccggaagaccttcgactccgagtacgtcaagacgcgcgccaacgactgggacttcgtggtgaccaccgacatcagcgagatgggggcgaacttcaaggccgagcgggtcatcgacccccgccggtgcatgaagcccgtgatcctgaccgacggcgaggagcgcgtgatcctggccgggcccatgccggtcacgcactccagcgccgcccagcggcgcggccgcatcgggcggaaccccaagaacgagaacgaccagtacatctacatgggcgagcccctcgagaacgacgaggactgcgcgcactggaaggaggccaagatgctgctggacaacatcaacacccccgagggcatcatcccgtccatgttcgagcccgagcgcgagaaggtggacgccatcgacggggagtaccggctccgcggcgaggcccggaagaccttcgtggacctgatgcgccgcggggacctgcccgtctggctcgcctacaaggtggcggccgagggcatcaactacgccgaccgcaagtggtgcttcgacgggatcaagaacaaccagatcctggaggagaacgtggaggtcgagatctggaccaaggagggcgagcggaagaagctgaagccgcgctggctcgacgcccggatctacagcgaccccctggcgctgaagggcttcaaggagttcgccgccgggcgcaagtccctcacgctgaacctgatcaccgagatgggccggctccccaccttcatgacccagaaggcccgcaacgccctggacaacctggcggtgctccacacggccgaggtcgggggcaaggcctacacccacgccctgagcgagctgcccgagaccctcgagaccctgctgctcctgacgctgctcgccgcggtcaccggcgggatcttcctgttcctgatgtccggcaaggggatcggcaagatgaccctcgggatgtgctgcatcatcaccgccagcatcctgctgtggtacgcccagatccagccgcactggatcgccgcctccatcatcctcgagttcttcctgatcgtgctgctcatccccgagcccgagaagcagcggacgccccaggacaaccagctgacgtacgtcgtgatcgcgatcctgaccgtggtcgccgccaccatggccaacgagatgggcttcctcgagaagaccaagaaggacctgggcttcgggagcatcacgacccaggagagcgagtccaacatcctggacatcgacctccgcccggccagcgcgtggaccctgtacgccgtggccaccacgttcgtgacccccatgctgcggcactccatcgagaacagctccgtcaacgtgagcctcaccgccatcgcgaaccaggccaccgtgctgatgggcctggggaagggctggcccctctccaagatggacatcggggtccccctgctggccatcggctgctacagccaggtgaacccgatcacgctcaccgccgccctgctgctcctggtggcgcactacgccatcatcggccccgggctgcaggccaaggccacccgcgaggcccagaagcgggcggccgccggcatcatgaagaaccccaccgtcgacgggatcacggtgatcgacctcgagcccatcccgtacgaccccaagttcgagaagcagctgggccaggtgatgctgctcatcctgtgcgtcacccaggtgctgatgatgcgcaccacctgggccctctgcgaggccctgacgctggcgaccgggcccatctccaccctctgggagggcaaccccggccggttctggaacaccacgatcgccgtgagcatggccaacatcttccgcgggtcctacctggccggcgcggggctcctgttcagcatcatgaagaacaccaccaacacccgccggggcacgggcaacgtcggggagaccctgggcgagaagtggaagtcccgcctgaacgccctcggcaagagcgagttccagatctacaagaagtccggcatccaggaggtggaccggaccctggccaaggaggggatcaagcgcggcgagaccgaccaccacgccgtgagccggggctccgccaagctgcgctggttcgtcgagcggaacatggtgacgccggaggggaaggtggtcgacctcggctgcgggcgcggcgggtggagctactactgcggcggcctgaagaacgtgcgggaggtgaaggggctgaccaagggcgggcccggccacgaggagcccatccccatgtccacctacgggtggaacctcgtccgcctgcagagcggcgtggacgtgttcttcaccccgcccgagaagtgcgacacgctgctctgcgacatcggcgagagctcccccaaccccaccatcgaggcggggcggaccctgcgcgtcctgaacctcgtggagaactggctgaacaacaacacccagttctgcatcaaggtgctgaacccgtacatgcccagcgtcatcgagaagatggagaccctccagcggaagtacggcggggccctggtgcgcaaccccctgtcccggaacagcacgcacgagatgtactgggtgtccaacgccaccggcaacatcgtcagctccgtgaacatgatcagccgcatgctgatcaaccggttcaccatgaagcacaagaaggccacctacgagccggacgtggacctcgggtccggcacgcgcaacatcggcatcgagagcgagatccccaacctggacatcatcgggaagcggatcgagaagatcaagcaggagcacgagacctcctggcactacgaccaggaccacccctacaagacctgggcctaccacggcagctacgagaccaagcagacggggtccgcgagctccatggtcaacggcgtggtgcgcctgctcaccaagccctgggacgtcgtgccgatggtgacccagatggccatgaccgacacgacccccttcggccagcagcgcgtcttcaaggagaaggtggacacccggacccaggagcccaaggaggggacgaagaagctgatgaagatcaccgccgagtggctgtggaaggagctcggcaaggagaagacgccccggatgtgcacccgggaggagttcacgcgcaaggtgcggagcaacgccgccctgggggcggtcttcaccgacgagaacaagtggaagtccgcccgcgaggccgtggaggacggccggttctgggagctggtggaccgcgagcggaacctccacctggaggggaagtgcgagacctgcgtctacaacatgatgggcaagcgcgagaagaagctgggcgagttcgggaaggccaagggcagccgggcgatctggtacatgtggctcggggcccgcttcctggagttcgaggccctgggcttcctcaacgaggaccactggttctcccgggggaacagcctgagcggcgtggagggcgaggggctgcaccgcctcggctacatcctgcgggaggtcgggaagaaggagggcggggccatgtacgccgacgacaccgcgggctgggacacgcgcatcaccctggaggacctcaagaacgaggagatggtgaccaaccacatgaagggcgagcacaagaagctggccgaggccatcttcaagctgacctaccagaacaaggtggtccgggtgcagcgcccgacgccccgggggaccgtgatggacatcatctcccgcaaggaccagcggggcagcgggcaggtcggcacctacggcctcaacaccttcacgaacatggaggcccagctgatccgccagatggagggggagggcatcttcaagtccatccagcacctgaccgccaccgaggagatcgcggtgcagaactggctcgcccgcgtggggcgggagcgcctgagccggatggccatctccggcgacgactgcgtcgtgaagcccatcgacgaccgcttcgccagcgccctgaccgcgctcaacgacatggggaaggtgcggaaggacatccagcagtgggagccctcccgcggctggaacgactggacgcaggtcccgttctgcagccaccacttccacgagctggtgatgaaggacggccgggtgctggtcgtgccctgccgcaaccaggacgagctcatcgggcgggcccgcatctcccagggcgccgggtggagcctgaaggagaccgcctgcctgggcaagtcctacgcccagatgtggaccctcatgtacttccaccggcgcgacctgcggctggcggccaacgccatctgcagcgccgtgccctcccactgggtccccaccagccgcaccacgtggtccatccacgcgaagcacgagtggatgaccaccgaggacatgctcgccgtgtggaaccgggtgtggatccaggagaacccgtggatggaggacaagacccccgtcgagagctgggaggaggtgccctacctggggaagcgcgaggaccagtggtgcggctccctgatcggcctcacgagccgggccacctgggccaagaacatccagaccgccatcaaccaggtgcgcagcctgatcgggaacgagggctacaccgactacatgccctccatgaagcggttccgccgcgaggaggaggaggcgggggtcctgtggtga

SEQ ID NO: 9023 - RNA, 9876 nt, synthetic construct
  misc_feature 1..9876: note = derived and/or modified CDS sequence (opt1) from DENV-2__JX286518__SS-prME
  source 1..9876: mol_type = other RNA
accgccggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccggaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcggcggggtcttcacgtccatcgggaaggccctccaccaggtgttcggggcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcatcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacacgctgtggtccaacggcgtgctggagagcgagatgatcatccccaagaacttcgccgggcccgtgtcccagcacaactaccgcccgggctaccacacccagaccgcggggccctggcacctcggcaagctggagatggacttcgacttctgcgaggggaccacggtcgtggtgaccgaggactgcggcaaccggggccccagcctgcgcaccaccacggccagcgggaagctcatcaccgagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacgcgcgtcggcaccaagcacgcgatcctgctcgtggccctgagcttcgtgaccctgatcaccgggaacatgtccttccgggacctcggccgcgtcatggtgatggtgggggccacgatgaccgacgacatcggcatgggcgtcacctacctggccctgctcgccgcgttcaaggtgcgccccaccttcgccgccgggctgctgctccggaagctgacgagcaaggagctgatgatggccaccatcggcatcgccctcctgtcccagagcaccctgcccgagaccatcctcgagctgacggacgcgctggccctcgggatgatggccctgaagatcgtgcgcaacatggagaagtaccagctggccgtcaccatcatggccatctcctgcgtgccgaacgcggtgatcctccagaacgcctggaaggtcagctgcaccatcctggccgccgtgtccgtgagccccctgctcctgacctccagccagcagaaggcggactggatccccctggccctcacgatcaagggcctgaaccccaccgccatcttcctgaccaccctctcccggacgagcaagaagcgctcctggccgctgaacgaggccatcatggccgtcggcatggtgagcatcctggcgtccagcctcctgaagaacgacatccccatgaccgggcccctggtcgccggcgggctcctgaccgtgtgctacgtgctgaccggccggagcgccgacctcgagctggagcgcgccgccgacgtcaagtgggaggaccaggcggagatctccgggagctcccccatcctgagcatcacgatctccgaggacggcagcatgtccatcaagaacgaggaggaggagcagaccctcaccatcctgatccggaccggcctgctcgtgatcagcggggtgttcccggtctccatccccatcaccgccgccgcctggtacctgtgggaggtgaagaagcagcgcgccggcgtgctgtgggacgtccccagcccgccgcccgtggggaaggcggagctcgaggacggcgcctaccggatcaagcagcgcgggatcctgggctactcccagatcggcgccggggtgtacaaggagggcacgttccacaccatgtggcacgtcacccgcggggccgtgctgatgcaccgcggcaagcggatcgagcccagctgggccgacgtgaagaaggacctcatctcctacgggggcggctggaagctggagggggagtggaaggagggcgaggaggtccaggtgctggcgctcgagcccgggaagaacccccgcgccgtgcagaccaagcccggcatcttcaagacgaacaccgggaccatcggcgccgtcagcctggacttctcccccggcaccagcgggtcccccatcgtggaccggaagggcaaggtggtcgggctgtacggcaacggcgtggtgacgcgcagcggggcctacgtctccgcgatcgcccagaccgagaagtccatcgaggacaaccccgagatcgaggacgacatcttccggaagaagcgcctcaccatcatggacctgcaccccggcgccgggaagaccaagcggtacctgcccgccatcgtgcgcgaggccatcaagcggggcctgcgcacgctcatcctggcgccgacccgcgtggtcgccgccgagatggaggaggccctgcgggggctccccatccgctaccagacccccgccatccgggcggagcacaccggccgcgagatcgtggacctgatgtgccacgccacgttcaccatgcggctgctcagccccgtgcgcgtcccgaactacaacctgatcatcatggacgaggcccacttcaccgaccccgcctccatcgccgcgcggggctacatcagcacccgcgtggagatgggggaggccgccggcatcttcatgacggccacgccgcccgggtcccgggacccgttcccccagagcaacgcgcccatcatggacgaggagcgcgagatccccgagcggtcctggaacagcggccacgagtgggtgaccgacttcaaggggaagaccgtctggttcgtgccgtccatcaaggccggcaacgacatcgccgcctgcctgcgcaagaacggcaagaaggtgatccagctcagccggaagacgttcgactccgagtacgtcaagacccgcgccaacgactgggacttcgtggtgaccaccgacatcagcgagatgggggcgaacttcaaggccgagcgggtcatcgacccccgccggtgcatgaagcccgtgatcctgacggacggcgaggagcgcgtgatcctggccgggcccatgccggtcacccactccagcgccgcccagcggcgcggccgcatcgggcggaaccccaagaacgagaacgaccagtacatctacatgggcgagcccctcgagaacgacgaggactgcgcgcactggaaggaggccaagatgctgctggacaacatcaacacccccgagggcatcatcccgtccatgttcgagcccgagcgcgagaaggtggacgccatcgacggggagtaccggctccgcggcgaggcccggaagaccttcgtggacctgatgcgccgcggggacctgcccgtctggctcgcctaccgcgtggcggccgagggcatcaactacgccgaccggaagtggtgcttcgacgggatcaagaacaaccagatcctggaggagaacgtggaggtcgagatctggacgaaggagggcgagcgcaagaagctgaagccgcggtggctcgacgcccgcatctacagcgaccccctggcgctgaaggagttcaaggagttcgccgccggccggaagtccctcaccctgaacctgatcaccgagatggggcgcctccccaccttcatgacgcagaaggcccggaacgccctggacaacctggcggtgctccacaccgccgaggtgggcgggaaggcctacacccacgccctgagcgagctgcccgagaccctcgagacgctgctgctcctgaccctgctcgccgcggtcaccggcggcatcttcctgttcctgatgtccgggaagggcatcgggaagatgaccctcggcatgtgctgcatcatcaccgccagcatcctgctgtggtacgcccagatccagccgcactggatcgccgcctccatcatcctcgagttcttcctgatcgtgctgctcatccccgagcccgagaagcagcgcacgccccaggacaaccagctgacctacgtcgtgatcgcgatcctgaccgtggtcgccgccaccatggccaacgagatggggttcctcgagaagacgaagaaggacctgggcttcggcagcatcaccacccaggagagcgagtccaacatcctggacatcgacctccggccggccagcgcgtggaccctgtacgccgtggccacgaccttcgtgacccccatgctgcgccactccatcgagaacagctccgtcaacgtgagcctcaccgccatcgcgaaccaggccacggtgctgatggggctgggcaaggggtggcccctctccaagatggacatcggcgtccccctgctggccatcgggtgctacagccaggtgaacccgatcaccctcaccgccgccctgctgctcctggtggcgcactacgccatcatcggccccggcctgcaggccaaggccacccgggaggcccagaagcgcgcggccgccgggatcatgaagaaccccacggtcgacggcatcaccgtgatcgacctcgagcccatcccgtacgaccccaagttcgagaagcagctggggcaggtcatgctgctcatcctgtgcgtcacccaggtgctgatgatgcggaccacgtgggccctctgcgaggccctgaccctggcgaccggccccatctccaccctctgggaggggaaccccggccgcttctggaacacgaccatcgccgtgagcatggccaacatcttccgcggctcctacctggccggggcgggcctcctgttcagcatcatgaagaacaccaccaacacgcggcgcgggaccggcaacgtcggcgagaccctgggggagaagtggaagtcccggctgaacgccctcggcaagagcgagttccagatctacaagaagtccgggatccaggaggtggaccgcaccctggccaaggagggcatcaagcgcggggagacggaccaccacgccgtgagccgcggctccgccaagctgcggtggttcgtcgagcgcaacatggtgaccccggagggcaaggtggtcgacctcgggtgcggccgcgggggctggagctactactgcgggggcctgaagaacgtgcgcgaggtgaagggcctgaccaagggcggccccgggcacgaggagcccatccccatgtccacctacggctggaacctcgtccggctgcagagcggggtggacgtgttcttcacgccgcccgagaagtgcgacaccctgctctgcgacatcggcgagagctcccccaaccccaccatcgaggcgggccgcaccctgcgggtcctgaacctcgtggagaactggctgaacaacaacacccagttctgcatcaaggtgctgaacccgtacatgcccagcgtcatcgagaagatggagacgctccagcgcaagtacgggggcgccctggtgcggaaccccctgtcccgcaacagcacccacgagatgtactgggtgtccaacgccaccgggaacatcgtcagctccgtgaacatgatcagccggatgctgatcaaccgcttcaccatgaagcacaagaaggccacgtacgagccggacgtggacctcggctccgggacccggaacatcggcatcgagagcgagatccccaacctggacatcatcggcaagcgcatcgagaagatcaagcaggagcacgagacctcctggcactacgaccaggaccacccctacaagacctgggcctaccacgggagctacgagacgaagcagaccggctccgcgagctccatggtcaacggggtggtgcgcctgctcaccaagccctgggacgtcgtgccgatggtgacccagatggccatgacggacaccacccccttcggccagcagcgggtcttcaaggagaaggtggacacccgcacgcaggagcccaaggagggcaccaagaagctgatgaagatcaccgccgagtggctgtggaaggagctcgggaaggagaagacgccccggatgtgcacgcgcgaggagttcacccggaaggtgcgcagcaacgccgccctgggcgcggtcttcaccgacgagaacaagtggaagtccgcccgggaggccgtggaggacgggcgcttctgggagctggtggaccgggagcgcaacctccacctggagggcaagtgcgagacctgcgtctacaacatgatggggaagcgggagaagaagctgggcgagttcggcaaggccaaggggagccgcgcgatctggtacatgtggctcggcgcccggttcctggagttcgaggccctggggttcctcaacgaggaccactggttctcccgcggcaacagcctgagcggggtggagggcgagggcctgcaccggctcgggtacatcctgcgcgaggtcggcaagaaggagggcggcgccatgtacgccgacgacacggcggggtgggacacccggatcaccctggaggacctcaagaacgaggagatggtgaccaaccacatgaagggcgagcacaagaagctggccgaggccatcttcaagctgacgtaccagaacaaggtggtccgcgtgcagcggccgacgccccggggcaccgtgatggacatcatctcccggaaggaccagcgcgggagcggccaggtcgggacctacggcctcaacacgttcaccaacatggaggcccagctgatccgccagatggagggcgaggggatcttcaagtccatccagcacctgaccgccaccgaggagatcgcggtgcagaactggctcgcccgggtgggccgcgagcggctgagccgcatggccatctccggggacgactgcgtcgtgaagcccatcgacgaccggttcgccagcgccctgacggcgctcaacgacatgggcaaggtgcgcaaggacatccagcagtgggagccctcccgggggtggaacgactggacccaggtcccgttctgcagccaccacttccacgagctggtgatgaaggacggccgcgtgctggtcgtgccctgccggaaccaggacgagctcatcggccgcgcccggatctcccagggggccggctggagcctgaaggagaccgcctgcctggggaagtcctacgcccagatgtggaccctcatgtacttccaccgccgggacctgcgcctggcggccaacgccatctgcagcgccgtgccctcccactgggtccccaccagccggacgacctggtccatccacgcgaagcacgagtggatgaccaccgaggacatgctcgccgtgtggaaccgcgtgtggatccaggagaacccgtggatggaggacaagacgcccgtcgagagctgggaggaggtgccctacctgggcaagcgggaggaccagtggtgcgggtccctgatcggcctcaccagccgcgccacctgggccaagaacatccagaccgccatcaaccaggtgcggagcctgatcggcaacgaggggtacacggactacatgccctccatgaagcgcttccgccgggaggaggaggaggcgggcgtcctgtggtga

SEQ ID NO: 9024 - RNA, 9876 nt, synthetic construct
  misc_feature 1..9876: note = derived and/or modified CDS sequence (opt1) from DENV-2__JX286519__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcatcaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtggagggcgtcagcgggggcagctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtccagcccgagaacctggagtacaccatcgtgatcacgccccacagcggggaggagcacgccgtgggcaacgacaccgggaagcacggcaaggagatcaagatcaccccgcagtccagcaccaccgaggccgagctgacggggtacggcaccgtcaccatggagtgcagcccccggaccggcctcgacttcaacgagatggtgctgctgcagatggaggacaaggcctggctcgtgcaccggcagtggttcctggacctgcccctcccctggctgccgggggccgacacgcagggcagcaactggatccagaaggagaccctggtcaccttcaagaacccccacgcgaagaagcaggacgtggtggtcctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacgcagcacgggaccatcgtcatccgcgtgcagtacgagggcgacggctccccctgcaagatccccttcgagatcaccgacctggagaagcggcacgtgctcgggcgcctgatcaccgtcaacccgatcgtgacggagaaggacagccccgtgaacatcgaggcggagccgcccttcggcgactcctacatcatcgtcggggtggagccgggccagctgaagctcaactggttcaagaaggggagctccatcggccagatgttcgagaccaccatgcgcggcgccaagcggatggccatcctgggggacaccgcctgggacttcggcagcctcggcggggtgttcacgtccatcgggaaggccctccaccaggtcttcggggcgatctacggcgccgccttcagcggggtgtcctggaccatgaagatcctgatcggcgtgatcatcacctggatcgggatgaacagccgctccaccagcctgtccgtcagcctggtgctcgtgggcgtcgtgacgctgtacctgggggccatggtgcaggcggactccggctgcatcgtcagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtgacgcgcctggagaacctcatgtggaagcagatcacccccgagctgaaccacatcctgtccgagaacgaggtcaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacacgctgtggtccaacggcgtcctggagagcgagatgatcatccccaagaacttcgccgggcccgtgtcccagcacaactaccgcccgggctaccacacccagaccgcggggccctggcacctcggcaagctggagatggacttcgacttctgcgaggggaccacggtggtcgtgaccgaggactgcggcaaccggggccccagcctgcgcaccaccacggccagcgggaagctcatcaccgagtggtgctgccggtcctgcaccctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacgcgcgtgggcaccaagcacgcgatcctgctcgtcgccctgagcttcgtgaccctgatcaccgggaacatgtccttccgggacctcggccgcgtgatggtcatggtgggggccacgatgaccgacgacatcggcatgggcgtgacctacctggccctgctcgccgcgttcaaggtccgccccaccttcgccgccgggctgctgctccggaagctgacgagcaaggagctgatgatggccaccatcggcatcgccctcctgtcccagagcaccctgcccgagaccatcctcgagctgacggacgcgctggccctcgggatgatggccctgaagatcgtgcgcaacatggagaagtaccagctggccgtgaccatcatggccatctcctgcgtcccgaacgcggtgatcctccagaacgcctggaaggtgagctgcaccatcctggccgccgtctccgtgagccccctgctcctgacctccagccagcagaaggcggactggatccccctggccctcacgatcaagggcctgaaccccaccgccatcttcctgaccaccctctcccggacgagcaagaagcgctcctggccgctgaacgaggccatcatggccgtgggcatggtcagcatcctggcgtccagcctcctgaagaacgacatccccatgaccgggcccctggtggccggcgggctcctgaccgtctgctacgtgctgaccggccggagcgccgacctcgagctggagcgcgccgccgacgtgaagtgggaggaccaggcggagatctccgggagctcccccatcctgagcatcacgatctccgaggacggcagcatgtccatcaagaacgaggaggaggagcagaccctcaccatcctgatccggaccggcctgctcgtcatcagcggggtgttcccggtgtccatccccatcaccgccgccgcctggtacctgtgggaggtcaagaagcagcgcgccggcgtgctgtgggacgtgcccagcccgccgcccgtcgggaaggcggagctcgaggacggcgcctaccggatcaagcagcgcgggatcctgggctactcccagatcggcgccggggtgtacaaggagggcacgttccacaccatgtggcacgtgacccgcggggccgtcctgatgcaccgcggcaagcggatcgagcccagctgggccgacgtgaagaaggacctcatctcctacgggggcggctggaagctggagggggagtggaaggagggcgaggaggtgcaggtcctggcgctcgagcccgggaagaacccccgcgccgtgcagaccaagcccggcatcttcaagacgaacaccgggaccatcggcgccgtgagcctggacttctcccccggcaccagcgggtcccccatcgtcgaccggaagggcaaggtggtggggctgtacggcaacggcgtcgtgacgcgcagcggggcctacgtgtccgcgatcgcccagaccgagaagtccatcgaggacaaccccgagatcgaggacgacatcttccggaagaagcgcctcaccatcatggacctgcaccccggcgccgggaagaccaagcggtacctgcccgccatcgtccgcgaggccatcaagcggggcctgcgcacgctcatcctggcgccgacccgcgtggtggccgccgagatggaggaggccctgcgggggctccccatccgctaccagacccccgccatccgggcggagcacaccggccgcgagatcgtcgacctgatgtgccacgccacgttcaccatgcggctgctcagccccgtgcgcgtgccgaactacaacctgatcatcatggacgaggcccacttcaccgaccccgcctccatcgccgcgcggggctacatcagcacccgcgtcgagatgggggaggccgccggcatcttcatgacggccacgccgcccgggtcccgggacccgttcccccagagcaacgcgcccatcatggacgaggagcgcgagatccccgagcggtcctggaacagcggccacgagtgggtgaccgacttcaaggggaagaccgtgtggttcgtcccgtccatcaaggccggcaacgacatcgccgcctgcctgcgcaagaacggcaagaaggtgatccagctcagccggaagacgttcgactccgagtacgtgaagacccgcgccaacgactgggacttcgtcgtgaccaccgacatcagcgagatgggggcgaacttcaaggccgagcgggtgatcgacccccgccggtgcatgaagcccgtcatcctgacggacggcgaggagcgcgtgatcctggccgggcccatgccggtgacccactccagcgccgcccagcggcgcggccgcatcgggcggaaccccaagaacgagaacgaccagtacatctacatgggcgagcccctcgagaacgacgaggactgcgcgcactggaaggaggccaagatgctgctggacaacatcaacacccccgagggcatcgtcccgtccatgttcgagcccgagcgcgagaaggtggacgccatcgacggggagtaccggctccgcggcgaggcccggaagaccttcgtggacctgatgcgccgcggggacctgcccgtctggctcgcctacaaggtggcggccgagggcatcaactacgccgaccgcaagtggtgcttcgacgggatcaagaacaaccagatcctggaggagaacgtggaggtcgagatctggacgaaggagggcgagcggaagaagctgaagccgcgctggctcgacgcccggatctacagcgaccccctggcgctgaaggagttcaaggagttcgccgccggccgcaagtccctcaccctgaacctgatcaccgagatggggcggctccccaccttcatgacgcagaaggcccgcagcgccctggacaacctggcggtgctccacaccgccgaggtgggcgggaaggcctacacccacgccctgtccgagctgcccgagaccctcgagacgctgctgctcctgaccctgctcgccgcggtcaccggcggcatcttcctgttcctgatgagcgggaagggcatcgggaagatgaccctcggcatgtgctgcatcatcaccgcctccatcctgctgtggtacgcccagatccagccgcactggatcgccgccagcatcatcctcgagttcttcctgatcgtgctgctcatccccgagcccgagaagcagcggacgccccaggacaaccagctgacctacgtcgtgatcgcgatcctgaccgtggtcgccgccaccatggccaacgagatggggttcctcgagaagacgaagaaggacctgggcttcggcagcatcaccacccaggagtccgagagcaacatcctggacatcgacctccgcccggcctccgcgtggaccctgtacgccgtggccacgaccttcgtgacccccatgctgcggcacagcatcgagaactccagcgtcaacgtgtccctcaccgccatcgcgaaccaggccacggtgctgatggggctgggcaaggggtggcccctcagcaagatggacatcggcgtccccctgctggccatcgggtgctactcccaggtgaacccgatcaccctcaccgccgccctgctgctcctggtggcgcactacgccatcatcggccccggcctgcaggccaaggccacccgcgaggcccagaagcgggcggccgccgggatcatgaagaaccccacggtcgacggcatcaccgtgatcgacctcgagcccatcccgtacgaccccaagttcgagaagcagctgggccaggtgatgctgctcatcctgtgcgtcacccaggtgctgatgatgcgcaccacgtgggccctctgcgaggccctgaccctggcgaccggccccatcagcaccctctgggaggggaaccccggccggttctggaacacgaccatcgccgtgtccatggccaacatcttccgcggcagctacctggccggggcgggcctcctgttctccatcatgaagaacaccaccaacacgcgccgggggaccggcaacgtcggcgagaccctgggggagaagtggaagtcccgcctgaacgccctcggcaagtccgagttccagatctacaagaagtccgggatccaggaggtggaccggaccctggccaaggagggcatcaagcgcggggagacggaccaccacgccgtgtcccggggcagcgccaagctgcgctggttcgtcgagcggaacatggtgaccccggagggcaaggtggtcgacctcgggtgcggccgcgggggctggtcctactactgcgggggcctgaagaacgtgcgggaggtgaagggcctgaccaagggcgggcccgggcacgaggagcccatccccatgagcacctacggctggaacctcgtccgcctgcagagcggggtggacgtgttcttcacgccgcccgagaagtgcgacaccctgctctgcgacatcggcgagtccagccccaaccccaccatcgaggcgggccggaccctgcgcgtcctgaacctcgtggagaactggctgaacaacaacacccagttctgcatcaaggtgctgaacccgtacatgccctccgtcatcgagaagatggagacgctccagcggaagtacgggggcgccctggtgcgcaaccccctgagccggaactccacccacgagatgtactgggtgagcaacgccaccgggaacatcgtctccagcgtgaacatgatctcccgcatgctgatcaaccggttcaccatgaagcacaagaaggccacgtacgagccggacgtggacctcggcagcgggacccgcaacatcggcatcgagtccgagatccccaacctggacatcatcggcaagcggatcgagaagatcaagcaggagcacgagaccagctggcactacgaccaggaccacccctacaagacctgggcctaccacgggtcctacgagacgaagcagaccggcagcgcgtccagcatggtcaacggggtggtgcgcctgctcaccaagccctgggacgtcgtgccgatggtgacccagatggccatgacggacaccacccccttcggccagcagcgcgtcttcaaggagaaggtggacacccggacgcaggagcccaaggagggcaccaagaagctgatgaagatcaccgccgagtggctgtggaaggagctcgggaaggagaagacgccccggatgtgcacgcgggaggagttcacccgcaaggtgcggtccaacgccgccctgggcgcggtcttcaccgacgagaacaagtggaagtccgcccgcgaggccgtggaggacgggcggttctgggagctggtggaccgcgagcggaacctccacctggagggcaagtgcgagacctgcgtctacaacatgatggggaagcgcgagaagaagctgggcgagttcggcaaggccaaggggtcccgggcgatctggtacatgtggctcggcgcccgcttcctggagttcgaggccctggggttcctcaacgaggaccactggttcagccggggcaacagcctgtccggggtggagggcgagggcctgcaccgcctcgggtacatcctgcgggaggtcggcaagaaggagggcggggccatgtacgccgacgacacggcggggtgggacacccgcatcaccctggaggacctcaagaacgaggagatggtgaccaaccacatgaagggcgagcacaagaagctggccgaggccatcttcaagctgacgtaccagaacaaggtggtccgggtgcagcgcccgacgccccggggcaccgtgatggacatcatcagccgcaaggaccagcgggggtccggccaggtcgggacctacggcctcaacacgttcaccaacatggaggcccagctgatccgccagatggagggcgaggggatcttcaagagcatccagcacctgaccgccaccgaggagatcgcggtgcagaactggctcgcccgcgtgggccgggagcgcctgtcccggatggccatcagcggggacgactgcgtcgtgaagcccatcgacgaccgcttcgcctccgccctgacggcgctcaacgacatgggcaaggtgcggaaggacatccagcagtgggagcccagccgcgggtggaacgactggacccaggtcccgttctgctcccaccacttccacgagctggtgatgaaggacggccgggtgctggtcgtgccctgccgcaaccaggacgagctcatcggccgggcccgcatcagccagggggccggctggtccctgaaggagaccgcctgcctgggcaagagctacgcccagatgtggaccctcatgtacttccaccggcgcgacctgcggctggcggccaacgccatctgctccgccgtgcccagccactgggtccccacctcccgcacgacctggagcatccacgcgaagcacgagtggatgaccaccgaggacatgctcgccgtgtggaaccgggtgtggatccaggagaacccgtggatggaggacaagacgcccgtcgagtcctgggaggaggtgccctacctgggcaagcgcgaggaccagtggtgcgggagcctgatcggcctcaccagccgggccacctgggccaagaacatccagaccgccatcaaccaggtgcgctccctgatcggcaacgaggggtacacggactacatgcccagcatgaagcggttccgccgcgaggaggaggaggcgggcgtcctgtggtga

SEQ ID NO: 9025 - RNA, 9876 nt, synthetic construct
  misc_feature 1..9876: note = derived and/or modified CDS sequence (opt1) from DENV-2__KP188549__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcgggggcgtcttcacgtccatcgggaaggccctccaccaggtgttcggcgcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcatcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacacgctgtggtccaacggcgtgctggagagcgagatggtgatccccaagaacttcgccgggcccgtctcccagcacaactaccgcccgggctaccacacccagaccgcggggccctggcacctcggcaagctggagatggacttcgacttctgcgaggggaccacggtggtggtcaccgaggactgcgagaagcggggccccagcctgcgcaccaccacggccagcggcaagctcatcaccgagtggtgctgccggtcctgcaccctgcccccgctgcgctaccgcggggaggacggctgctggtacgggatggagatccgccccctcaaggagaaggaggagaacctggtgaacagcctggtgaccgccggccacgggcagatcgacaacttctccctcggcgtcctgggcatggccctgttcctcgaggagatgctgcggacgcgcgtggggaccaagcacgcgatcctgctcgtggccctgagcttcgtcaccctgatcaccggcaacatgtccttccgggacctcgggcgcgtgatggtgatggtcggcgccacgatgaccgacgacatcgggatgggcgtgacctacctggccctgctcgccgcgttcaaggtgcgccccaccttcgccgccggcctgctgctccggaagctgacgagcaaggagctgatgatggccaccatcgggatcgccctcctgtcccagagcaccctgcccgagaccatcctcgagctgacggacgcgctggccctcggcatgatggccctgaagatcgtccgcaacatggagaagtaccagctggccgtgaccatcatggccatctcctgcgtgccgaacgcggtcatcctccagaacgcctggaaggtgagctgcaccatcctggccgccgtgtccgtcagccccctgctcctgacctccagccagcagaaggcggactggatccccctggccctcacgatcaaggggctgaaccccaccgccatcttcctgaccaccctctcccggacgagcaagaagcgctcctggccgctgaacgaggccatcatggccgtgggcatggtcagcatcctggcgtccagcctcctgaagaacgacatccccatgaccggccccctggtggccgggggcctcctgaccgtgtgctacgtcctgaccgggcggagcgccgacctcgagctggagcgcgccgccgacgtgaagtgggaggaccaggcggagatctccggcagctcccccatcctgagcatcacgatctccgaggacgggagcatgtccatcaagaacgaggaggaggagcagaccctcaccatcctgatccggaccggcctgctcgtgatcagcggcgtcttcccggtgtccatccccatcaccgccgccgcctggtacctgtgggaggtgaagaagcagcgcgccggggtcctgtgggacgtgcccagcccgccgcccgtgggcaaggcggagctcgaggacggggcctaccggatcaagcagcgcggcatcctggggtactcccagatcggcgccggcgtctacaaggaggggacgttccacaccatgtggcacgtgacccggggcgccgtgctgatgcaccgcgggaagcggatcgagcccagctgggccgacgtcaagaaggacctcatctcctacggcgggggctggaagctggagggcgagtggaaggagggggaggaggtccaggtgctggcgctcgagcccggcaagaacccccgcgccgtccagaccaagcccgggatcttcaagacgaacaccggcaccatcggggccgtgagcctggacttctcccccggcaccagcggctcccccatcgtggaccggaaggggaaggtcgtgggcctgtacgggaacggcgtggtcacgcgcagcggcgcctacgtgtccgcgatcgcccagaccgagaagtccatcgaggacaaccccgagatcgaggacgacatcttccggaagaagcgcctcaccatcatggacctgcaccccggggccggcaagaccaagcggtacctgcccgccatcgtgcgcgaggccatcaagcgggggctgcgcacgctcatcctggcgccgacccgcgtcgtggccgccgagatggaggaggccctgcggggcctccccatccgctaccagacccccgccatccgggcggagcacaccgggcgcgagatcgtggacctgatgtgccacgccacgttcaccatgcggctgctcagccccgtccgcgtgccgaactacaacctgatcatcatggacgaggcccacttcaccgaccccgcctccatcgccgcgcggggctacatcagcacccgcgtggagatgggcgaggccgccgggatcttcatgacggccacgccgcccggctcccgggacccgttcccccagagcaacgcgcccatcatggacgaggagcgcgagatccccgagcggtcctggaacagcgggcacgagtgggtcaccgacttcaagggcaagaccgtgtggttcgtgccgtccatcaaggccgggaacgacatcgccgcctgcctgcgcaagaacggcaagaaggtcatccagctcagccggaagacgttcgactccgagtacgtgaagacccgcgccaacgactgggacttcgtggtcaccaccgacatcagcgagatgggcgcgaacttcaaggccgagcgggtgatcgacccccgccggtgcatgaagcccgtgatcctgacggacggggaggagcgcgtcatcctggccggccccatgccggtgacccactccagcgccgcccagcggcgcgggcgcatcggccggaaccccaagaacgagaacgaccagtacatctacatgggggagcccctcgagaacgacgaggactgcgcgcactggaaggaggccaagatgctgctggacaacatcaacacccccgagggcatcatcccgtccatgttcgagcccgagcgcgagaaggtggacgccatcgacggcgagtaccggctccgcggggaggcccggaagaccttcgtcgacctgatgcgccggggcgacctgcccgtgtggctcgcctacaaggtggcggccgaggggatcaactacgccgaccgcaagtggtgcttcgacggcatcaagaacaaccagatcctggaggagaacgtcgaggtggagatctggacgaaggagggggagcggaagaagctgaagccgcgctggctcgacgcccggatctacagcgaccccctggcgctgaaggagttcaaggagttcgccgccggccgcaagtccctcaccctgaacctgatcaccgagatgggccggctccccaccttcatgacgcagaaggcccgcaacgccctggacaacctggcggtgctccacaccgccgaggtcgggggcaaggcctacacccacgccctgagcgagctgcccgagaccctcgagacgctgctgctcctgaccctgctcgccgcggtgaccgggggcatcttcctgttcctgatgtccggcaaggggatcggcaagatgaccctcgggatgtgctgcatcatcaccgccagcatcctgctgtggtacgcccagatccagccgcactggatcgccgcctccatcatcctcgagttcttcctgatcgtcctgctcatccccgagcccgagaagcagcggacgccccaggacaaccagctgacctacgtggtgatcgcgatcctgaccgtcgtggccgccaccatggccaacgagatgggcttcctcgagaagacgaagaaggacctggggttcggcagcatcaccacccaggagagcgagtccaacatcctggacatcgacctccgcccggccagcgcgtggaccctgtacgccgtggccacgaccttcgtcacccccatgctgcggcactccatcgagaacagctccgtgaacgtgagcctcaccgccatcgcgaaccaggccacggtcctgatgggcctggggaagggctggcccctctccaagatggacatcggggtgcccctgctggccatcggctgctacagccaggtgaacccgatcaccctcaccgccgccctgctgctcctggtcgcgcactacgccatcatcgggcccggcctgcaggccaaggccacccgcgaggcccagaagcgggcggccgccggcatcatgaagaaccccacggtggacgggatcaccgtgatcgacctcgagcccatcccgtacgaccccaagttcgagaagcagctgggccaggtcatgctgctcatcctgtgcgtgacccaggtgctgatgatgcgcaccacgtgggccctctgcgaggccctgaccctggcgaccgggcccatctccaccctctgggagggcaaccccgggcggttctggaacacgaccatcgccgtcagcatggccaacatcttccgcggctcctacctggccggcgcggggctcctgttcagcatcatgaagaacaccaccaacacgcgccggggcaccgggaacgtgggcgagaccctgggcgagaagtggaagtcccgcctgaacgccctcggcaagagcgagttccagatctacaagaagtccggcatccaggaggtggaccggaccctggccaaggaggggatcaagcgcggcgagacggaccaccacgccgtcagccgggggtccgccaagctgcgctggttcgtggagcggaacatggtgaccccggagggcaaggtcgtggacctcggctgcgggcgcggcgggtggagctactactgcggcgggctgaagaacgtgcgggaggtcaagggcctgaccaagggcgggcccggccacgaggagcccatccccatgtccacctacgggtggaacctcgtgcgcctgcagagcggcgtggacgtcttcttcacgccgcccgagaagtgcgacaccctgctctgcgacatcggggagagctcccccaaccccaccatcgaggcgggccggaccctgcgcgtgctgaacctcgtggagaactggctgaacaacaacacccagttctgcatcaaggtcctgaacccgtacatgcccagcgtgatcgagaagatggagacgctccagcggaagtacggcggggccctggtgcgcaaccccctgtcccggaacagcacccacgagatgtactgggtctccaacgccaccggcaacatcgtgagctccgtgaacatgatcagccgcatgctgatcaaccggttcaccatgaagcacaagaaggccacgtacgagccggacgtcgacctcgggtccggcacccgcaacatcgggatcgagagcgagacccccaacctggacatcatcggcaagcggatcgagaagatcaagcaggagcacgagacctcctggcactacgaccaggaccacccctacaagacgtgggcctaccacggcagctacgagaccaagcagaccgggtccgcgagctccatggtgaacggcgtggtccgcctgctcaccaagccctgggacgtggtgccgatggtcacgcagatggccatgaccgacaccacccccttcgggcagcagcgcgtgttcaaggagaaggtggacacgcggacccaggagcccaaggagggcaccaagaagctgatgaagatcaccgccgagtggctgtggaaggagctcggcaaggagaagacgccccgcatgtgcacccgggaggagttcacccgcaaggtccggagcaacgccgccctgggggcggtgttcaccgacgagaacaagtggaagtccgcccgcgaggccgtggaggacggccggttctgggagctggtcgaccgcgagcggaacctccacctggaggggaagtgcgagacgtgcgtgtacaacatgatgggcaagcgcgagaagaagctgggggagttcggcaaggccaagggcagccgggcgatctggtacatgtggctcggggcccgcttcctggagttcgaggccctgggcttcctcaacgaggaccactggttctcccgggggaacagcctgagcggcgtcgagggggagggcctgcaccgcctcggctacatcctgcgggaggtggggaagaaggagggcggggccatgtacgccgacgacaccgcgggctgggacacccgcatcaccctggaggacctcaagaacgaggagatggtgacgaaccacatgaagggggagcacaagaagctggccgaggccatcttcaagctgacctaccagaacaaggtcgtgcgggtgcagcgcccgacgccccggggcaccgtcatggacatcatctcccgcaaggaccagcggggcagcggccaggtggggacgtacgggctcaacaccttcaccaacatggaggcccagctgatccgccagatggagggcgagggcatcttcaagtccatccagcacctgaccgccacggaggagaccgcggtgcagaactggctcgcccgcgtcgggcgggagcgcctgagccggatggccatctccggcgacgactgcgtggtgaagcccatcgacgaccgcttcgccagcgccctgaccgcgctcaacgacatggggaaggtccggaaggacatccagcagtgggagccctcccgcggctggaacgactggacccaggtgccgttctgcagccaccacttccacgagctggtgatgaaggacgggcgggtcctggtggtgccctgccgcaaccaggacgagctcatcggccgggcccgcatctcccagggcgccgggtggagcctgaaggagaccgcctgcctgggcaagtcctacgcccagatgtggacgctcatgtacttccaccggcgcgacctgcggctggcggccaacgccatctgcagcgccgtcccctcccactgggtgcccaccagccgcaccacctggtccatccacgcgaagcacgagtggatgacgaccgaggacatgctcgccgtgtggaaccgggtctggatccaggagaacccgtggatggaggacaagacccccgtggagagctgggaggaggtgccctacctggggaagcgcgaggaccagtggtgcggctccctgatcgggctcaccagccgggccacgtgggccaagaacatccagaccgccatcaaccaggtccgcagcctgatcggcaacgagggctacaccgactacatgccctccatgaagcggttccgccgcgaggaggaggaggcgggggtgctgtggtga

SEQ ID NO: 9026 - RNA, 9876 nt, synthetic construct
  misc_feature 1..9876: note = derived and/or modified CDS sequence (opt1) from DENV-2__KP188550__SS-prME
  source 1..9876: mol_type = other RNA
accgccggcgtgatcgtgatgctgatccccaccgtgatggccttccacctcaccacccggaacggggagccccacatgatcgtgggccggcaggagaaggggaagtccctgctgttcaagaccgaggacggcgtcaacatgtgcaccctcatggcgatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtggccctggtcccccacgtggggatgggcctcgagacccggaccgagacctggatgagcagcgagggggcctggaagcacgtgcagcggatcgagacctggatcctgcgccacccgggcttcaccatcatggccgccatcctggcgtacaccatcgggaccacgcacttccagcgggccctcatcttcatcctgctgaccgccgtcgcccccagcatgaccatgcgctgcatcggcatcagcaaccgggacttcgtggagggcgtgagcgggggcagctgggtcgacatcgtgctcgagcacgggagctgcgtgaccacgatggcgaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtcgaccggggctgggggaacggctgcgggctgttcggcaagggcgggatcgtgacctgcgccatgttcacgtgcaagaagaacatggagggcaagatcgtgcagcccgagaacctggagtacaccatcgtcatcacgccccacagcggggaggagcacgcggtgggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtcctgctgcagatggaggacaaggcctggctcgtgcaccggcagtggttcctggacctgcccctcccctggctgccgggggccgacacgcagggcagcaactggatccagaaggagaccctggtgaccttcaagaacccccacgccaagaagcaggacgtcgtggtcctcgggtcccaggagggcgcgatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacgcagcacgggaccatcgtgatccgcgtccagtacgagggcgacggctccccctgcaagatccccttcgagatcaccgacctggagaagcggcacgtgctcgggcgcctgatcaccgtgaacccgatcgtcacggagaaggacagccccgtgaacatcgaggccgagccgcccttcggcgactcctacatcatcgtgggggtcgagccgggccagctgaagctcaactggttcaagaaggggagctccatcggccagatgttcgagaccaccatgcgcggcgcgaagcggatggccatcctgggggacaccgcctgggacttcggcagcctcggcggggtgttcacgtccatcgggaaggccctccaccaggtgttcggggccatctacggcgcggccttcagcggggtctcctggaccatgaagatcctgatcggcgtgatcatcacctggatcgggatgaacagccgctccaccagcctgtccgtgagcctggtcctcgtgggcgtggtcacgctgtacctgggggccatggtgcaggccgactccggctgcatcgtgagctggaagaacaaggagctcaagtgcggctccgggatcttcatcaccgacaacgtccacacctggaccgagcagtacaagttccagcccgagagccccagcaagctggcgtccgccatccagaaggcccacgaggagggcatctgcgggatccggagcgtgacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggccaagatgctcagcaccgagtcccacaaccagaccttcctgatcgacgggcccgagacggcggagtgcccgaacaccaaccgggcctggaacagcctggaggtcgaggactacggcttcggggtgttcaccaccaacatctggctcaagctgcgcgagaagcaggacgtgttctgcgactccaagctgatgagcgccgccatcaaggacaaccgggccgtccacgcggacatgggctactggatcgagtccgccctcaacgacacctggaagatggagaaggccagcttcatcgaggtgaagtcctgccactggcccaagagccacacgctgtggtccaacggcgtgctggagagcgagatgatcatccccaagaacttcgccgggcccgtctcccagcacaactaccgcccgggctaccacacccagaccgccgggccctggcacctcggcaagctggagatggacttcgacttctgcgaggggaccacggtggtggtcaccgaggactgcggcaaccggggccccagcctgcgcaccaccacggcgagcgggaagctcatcaccgagtggtgctgccggtcctgcaccctgcccccgctgcgctaccggggcgaggacgggtgctggtacggcatggagatccgccccctcaaggagaaggaggagaacctggtgaacagcctggtgaccgccgggcacggccagatcgacaacttctccctcggcgtcctggggatggccctgttcctcgaggagatgctgcggacgcgcgtgggcaccaagcacgccatcctgctcgtggcgctgagcttcgtcaccctgatcaccgggaacatgtccttccgggacctcggccgcgtgatggtgatggtcggggccacgatgaccgacgacatcggcatgggcgtgacctacctggccctgctcgccgccttcaaggtgcgccccaccttcgcggccgggctgctgctccggaagctgacgagcaaggagctgatgatggccaccatcggcatcgccctcctgtcccagagcaccctgcccgagaccatcctcgagctgacggacgccctggcgctcgggatgatggccctgaagatcgtccgcaacatggagaagtaccagctggccgtgaccatcatggccatctcctgcgtgccgaacgccgtcatcctccagaacgcgtggaaggtgagctgcaccatcctggccgccgtgtccgtcagccccctgctcctgacctccagccagcagaaggccgactggatccccctggcgctcacgatcaagggcctgaaccccaccgccatcttcctgaccaccctctcccggacgagcaagaagcgctcctggccgctgaacgaggccatcatggccgtgggcatggtcagcatcctggcctccagcctcctgaagaacgacatccccatgaccgggcccctggtggcgggcgggctcctgaccgtgtgctacgtcctgaccggccggagcgccgacctcgagctggagcgcgccgccgacgtgaagtgggaggaccaggccgagatctccgggagctcccccatcctgagcatcacgatctccgaggacggcagcatgtccatcaagaacgaggaggaggagcagaccctcaccatcctgatccggaccggcctgctcgtgatcagcggggtcttcccggtgtccatccccatcaccgcggccgcctggtacctgtgggaggtgaagaagcagcgcgccggcgtcctgtgggacgtgcccagcccgccgcccgtggggaaggccgagctcgaggacggcgcgtaccggatcaagcagcgcgggatcctgggctactcccagatcggcgccggggtctacaaggagggcacgttccacaccatgtggcacgtgacccgcggggccgtgctgatgcaccgcggcaagcggatcgagcccagctgggccgacgtcaagaaggacctcatctcctacgggggcggctggaagctggagggggagtggaaggagggcgaggaggtccaggtgctggccctcgagcccgggaagaacccccgcgcggtccagaccaagcccggcatcttcaagacgaacaccgggaccatcggcgccgtgagcctggacttctcccccggcaccagcgggtcccccatcgtggaccggaagggcaaggtcgtggggctgtacggcaacggcgtggtcacgcgcagcggggcctacgtgtccgccatcgcgcagaccgagaagtccatcgaggacaaccccgagatcgaggacgacatcttccggaagaagcgcctcaccatcatggacctgcaccccggcgccgggaagaccaagcggtacctgcccgccatcgtgcgcgaggccatcaagcggggcctgcgcacgctcatcctggccccgacccgcgtcgtggcggccgagatggaggaggccctgcgggggctccccatccgctaccagacccccgccatccgggccgagcacaccggccgcgagatcgtggacctgatgtgccacgcgacgttcaccatgcggctgctcagccccgtccgcgtgccgaactacaacctgatcatcatggacgaggcccacttcaccgaccccgcctccatcgccgcccggggctacatcagcacccgcgtggagatgggggaggcggccggcatcttcatgacggccacgccgcccgggtcccgggacccgttcccccagagcaacgcccccatcatggacgaggagcgcgagatccccgagcggtcctggaacagcggccacgagtgggtcaccgacttcaaggggaagaccgtgtggttcgtgccgtccatcaaggcgggcaacgacatcgccgcctgcctgcgcaagaacggcaagaaggtcatccagctcagccggaagacgttcgactccgagtacgtgaagacccgcgccaacgactgggacttcgtggtcaccaccgacatcagcgagatgggggccaacttcaaggcggagcgggtgatcgacccccgccggtgcatgaagcccgtgatcctgacggacggcgaggagcgcgtcatcctggccgggcccatgccggtgacccactccagcgccgcccagcggcgcggccgcatcgggcggaaccccaagaacgagaacgaccagtacatctacatgggcgagcccctcgagaacgacgaggactgcgcccactggaaggaggcgaagatgctgctggacaacatcaacacccccgagggcatcatcccgtccatgttcgagcccgagcgcgagaaggtggacgccatcgacggggagtaccggctccgcggcgaggcccggaagaccttcgtcgacctgatgcgccgcggggacctgcccgtgtggctcgcctacaaggtggccgcggagggcatcaactacgccgaccgcaagtggtgcttcgacgggatcaagaacaaccagatcctggaggagaacgtcgaggtggagatctggacgaaggagggcgagcggaagaagctgaagccgcgctggctcgacgcccggatctacagcgaccccctggccctgaaggagttcaaggagttcgcggccggccgcaagtccctcaccctgaacctgatcaccgagatggggcggctccccaccttcatgacgcagaaggcccgcaacgccctggacaacctggccgtgctccacaccgcggaggtcggcgggcgggcccacacccacgccctgagcgagctgcccgagaccctcgagacgctgctgctcctgaccctgctcgccaccgtgaccggcggcatcttcctgttcctgatgtccgggaagggcatcgggaagatgaccctcggcatgtgctgcatcatcacggccagcatcctgctgtggtacgcgcagatccagccgcactggatcgccgcctccatcatcctcgagttcttcctgatcgtcctgctcatccccgagcccgagaagcagcgcacgccccaggacaaccagctgacctacgtggtgatcgccatcctgaccgtcgtggccgcgacgatggccaacgagatggggttcctcgagaagaccaagaaggacctgggcttcggcaccatcaccacgcaggagagcgagagcaacatcctggacatcgacctccggccggcctccgcctggaccctgtacgccgtggcgaccaccttcgtcacgcccatgctgcgccacagcatcgagaactccagcgtgaacgtgtccctcaccgccatcgccaaccaggccaccgtcctgatggggctgggcaaggggtggcccctcagcaagatggacatcggcgtgcccctgctggcgatcgggtgctactcccaggtgaacccgatcaccctcacggccgccctgctgctcctggtcgcccactacgccatcatcggccccggcctgcaggcgaaggccacccgggaggcccagaagcgcgccgccgcggggatcatgaagaaccccaccgtggacggcatcaccgtgatcgacctcgagcccatcccgtacgaccccaagttcgagaagcagctggggcaggtcatgctgctcatcctgtgcgtgacccaggtgctgatgatgcggaccacctgggccctctgcgaggccctgaccctggccacgggccccatcagcaccctctgggaggggaaccccggccgcttctggaacaccaccatcgccgtctccatggcgaacatcttccgcggcagctacctggccggggccggcctcctgttctccatcatgaagaacacgaccaacacccggcgcgggaccggcaacgtgggcgagacgctgggggagaagtggaagtcccggctgaacgccctcggcaagtccgagttccagatctacaagaagtccgggatccaggaggtggaccgcaccctggcgaaggagggcatcaagcgcggggagaccgaccaccacgccgtctcccgcggcagcgccaagctgcggtggttcgtggagcgcaacatggtgaccccggagggcaaggtcgtggacctcgggtgcggccgcgggggctggtcctactactgcgggggcctgaagaacgtgcgcgaggtcaagggcctgacgaagggcggccccgggcacgaggagcccatccccatgagcacctacggctggaacctcgtgcggctgcagtccggggtggacgtcttcttcaccccgcccgagaagtgcgacaccctgctctgcgacatcggcgagagcagccccaaccccaccatcgaggccggccgcacgctgcgggtgctgaacctcgtggagaactggctgaacaacaacacccagttctgcatcaaggtcctgaacccgtacatgccctccgtgatcgagaagatggagaccctccagcgcaagtacgggggcgccctggtgcggaaccccctgagccgcaactccacccacgagatgtactgggtcagcaacgcgacggggaacatcgtgtccagcgtgaacatgatctcccggatgctgatcaaccgcttcaccatgaagcacaagaaggccacctacgagccggacgtcgacctcggcagcgggacccggaacatcggcatcgagtccgagatccccaacctggacatcatcggcaagcgcatcgagaagatcaagcaggagcacgagacgagctggcactacgaccaggaccacccctacaagacctgggcctaccacgggtcctacgagaccaagcagaccggcagcgcctccagcatggtgaacggggtggtccgcctgctcacgaagccctgggacgtggtgccgatggtcacccagatggccatgaccgacaccacgcccttcggccagcagcgggtgttcaaggagaaggtggacacccgcacccaggagcccaaggagggcaccaagaagctgatgaagatcacggcgaagtggctgtggaaggagctcgggaaggagaagacgccccggatgtgcacccgcgaggagttcacccggaaggtccgctccaacgccgccctgggcgccatcttcacggacgagaacaagtggaagtccgcccgggaggcggtggaggacgggcgcttctgggagctggtggaccgggagcgcaacctccacctggagggcaagtgcgagacctgcgtctacaacatgatggggaagcgggagaagaagctgggcgagttcggcaaggccaaggggtcccgcgccatctggtacatgtggctcggcgcccggttcctggagttcgaggcgctggggttcctcaacgaggaccactggttcagccgcggcaactccctgagcggggtggagggcgagggcctgcaccggctcgggtacatcctgcgcgaggtcggcaagaaggagggcggcgccatgtacgccgacgacaccgccgggtgggacacccggatcacgctggaggacctcaagaacgaggagatggtgaccaaccacatgaagggcgagcacaagaagctggccgaggcgatcttcaagctgacctaccagaacaaggtggtccgcgtgcagcggccgacgccccggggcacggtgatggacatcatcagccggaaggaccagcgcgggtccggccaggtcgggacctacggcctcaacaccttcaccaacatggaggcccagctgatccgccagatggagggcgaggggatcttcaagaacatccagcacctgacggccaccgaggagatcgccgtgcagaactggctcgcccgggtgggccgcgagcggctgagccgcatggcgatctccggggacgactgcgtcgtgaagcccatcgacgaccggttcgccagcgccctgaccgccctcaacgacatgggcaaggtgcgcaaggacatccagcagtgggagccctcccgggggtggaacgactggacccaggtcccgttctgcagccaccacttccacgagctggtgatgaaggacggccgcgtgctggtcgtgccctgccggaaccaggacgagctcatcggccgcgcccggatctcccagggggcgggctggagcctgaaggagaccgcctgcctggggaagtcctacgcccagatgtggacgctcatgtacttccaccgccgggacctgcgcctggccgccaacgcgatctgcagcgccgtgccctcccactgggtccccaccagccggaccacctggtccatccacgccaagcacgagtggatgacgaccgaggacatgctcgccgtgtggaaccgcgtgtggatccaggagaacccgtggatggaggacaagacccccgtcgagagctgggaggaggtgccctacctgggcaagcgggaggaccagtggtgcgggtccctgatcggcctcaccagccgcgcgacgtgggccaagaacatccagaccgccatcaaccaggtgcggtccctgatcggcaacgaggggtacaccgactacatgcccagcatgaagcgcttccgccgggaggaggaggaggccggcgtcctgtggtga

SEQ ID NO: 9027 - RNA, 9876 nt, synthetic construct
  misc_feature 1..9876: note = derived and/or modified CDS sequence (opt1) from DENV-2__KP188553__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccaccccggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcgggggcgtcttcacgtccatcgggaaggccctccaccaggtgttcggcgcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcatcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacacgctgtggtccaacggcgtgctggagagcgagatggtgatccccaagaacttcgccgggcccgtctcccagcacaactaccgcccgggctaccacacccagaccgcggggccctggcacctcggcaagctggagatggacttcgacttctgcgaggggaccacggtggtggtcaccgaggactgcgagaagcggggccccagcctgcgcaccaccacggccagcggcaagctcatcaccgagtggtgctgccggtcctgcaccctgcccccgctgcgctaccgcggggaggacggctgctggtacgggatggagatccgccccctcaaggagaaggaggagaacctggtgaacagcctggtgaccgccggccacgggcagatcgacaacttctccctcggcgtcctgggcatggccctgttcctcgaggagatgctgcggacgcgcgtggggaccaagcacgcgatcctgctcgtggccctgagcttcgtcaccctgatcaccggcaacatgtccttccgggacctcgggcgcgtgatggtgatggtcggcgccacgatgaccgacgacatcgggatgggcgtgacctacctggccctgctcgccgcgttcaaggtgcgccccaccttcgccgccggcctgctgctccggaagctgacgagcaaggagctgatgatggccaccatcgggatcgccctcctgtcccagagcaccctgcccgagaccatcctcgagctgacggacgcgctggccctcggcatgatggccctgaagatcgtccgcaacatggagaagtaccagctggccgtgaccatcatggccatctcctgcgtgccgaacgcggtcatcctccagaacgcctggaaggtgagctgcaccatcctggccgccgtgtccgtcagccccctgctcctgacctccagccagcagaaggcggactggatccccctggccctcacgatcaaggggctgaaccccaccgccatcttcctgaccaccctctcccggacgagcaagaagcgctcctggccgctgaacgaggccatcatggccgtgggcatggtcagcatcctggcgtccagcctcctgaagaacgacatccccatgaccggccccctggtggccgggggcctcctgaccgtgtgctacgtcctgaccgggcggagcgccgacctcgagctggagcgcgccgccgacgtgaagtgggaggaccaggcggagatctccggcagctcccccatcctgagcatcacgatctccgaggacgggagcatgtccatcaagaacgaggaggaggagcagaccctcaccatcctgatccggaccggcctgctcgtgatcagcggcgtcttcccggtgtccatccccatcaccgccgccgcctggtacctgtgggaggtgaagaagcagcgcgccggggtcctgtgggacgtgcccagcccgccgcccgtgggcaaggcggagctcgaggacggggcctaccggatcaagcagcgcggcatcctggggtactcccagatcggcgccggcgtctacaaggaggggacgttccacaccatgtggcacgtgacccggggcgccgtgctgatgcaccgcgggaagcggatcgagcccagctgggccgacgtcaagaaggacctcatctcctacggcgggggctggaagctggagggcgagtggaaggagggggaggaggtccaggtgctggcgctcgagcccggcaagaacccccgcgccgtccagaccaagcccgggatcttcaagacgaacaccggcaccatcggggccgtgagcctggacttctcccccggcaccagcggctcccccatcgtggaccggaaggggaaggtcgtgggcctgtacgggaacggcgtggtcacgcgcagcggcgcctacgtgtccgcgatcgcccagaccgagaagtccatcgaggacaaccccgagatcgaggacgacatcttccggaagaagcgcctcaccatcatggacctgcaccccggggccggcaagaccaagcggtacctgcccgccatcgtgcgcgaggccatcaagcgggggctgcgcacgctcatcctggcgccgacccgcgtcgtggccgccgagatggaggaggccctgcggggcctccccatccgctaccagacccccgccatccgggcggagcacaccgggcgcgagatcgtggacctgatgtgccacgccacgttcaccatgcggctgctcagccccgtccgcgtgccgaactacaacctgatcatcatggacgaggcccacttcaccgaccccgcctccatcgccgcgcggggctacatcagcacccgcgtggagatgggcgaggccgccgggatcttcatgacggccacgccgcccggctcccgggacccgttcccccagagcaacgcgcccatcatggacgaggagcgcgagatccccgagcggtcctggaacagcgggcacgagtgggtcaccgacttcaagggcaagaccgtgtggttcgtgccgtccatcaaggccgggaacgacatcgccgcctgcctgcgcaagaacggcaagaaggtcatcccctacagccggaagacgttcgactccgagtacgtgaagacccgcgccaacgactgggacttcgtggtcaccaccgacatcagcgagatgggcgcgaacttcaaggccgagcgggtgatcgacccccgccggtgcatgaagcccgtgatcctcacggacggggaggagcgcgtcatcctggccggcccgatgcccgtgacccactccagcgccgcccagcggcgcgggcgcatcggccggaaccccaagaacgagaacgaccagtacatctacatgggggagcccctggagaacgacgaggactgcgcgcactggaaggaggccaagatgctcctggacaacatcaacaccccggagggcatcatcccctccatgttcgagcccgagcgcgagaaggtggacgccatcgacggcgagtaccggctgcgcggggaggcccggaagaccttcgtcgacctcatgcgccggggcgacctgccggtgtggctggcctacaaggtggcggccgaggggatcaactacgccgaccgcaagtggtgcttcgacggcatcaagaacaaccagatcctcgaggagaacgtcgaggtggagatctggacgaaggagggggagcggaagaagctgaagccccgctggctggacgcccggatctacagcgaccccctcgcgctgaaggagttcaaggagttcgccgccggccgcaagtccctgaccctcaacctgatcaccgagatgggccggctgcccaccttcatgacgcagaaggcccgcaacgccctcgacaacctggcggtgctgcacaccgccgaggtcgggggcaaggcctacacccacgccctcagcgagctgccggagaccctggagacgctcctgctgctcaccctgctggccgcggtgaccgggggcatcttcctcttcctgatgtccggcaaggggatcggcaagatgaccctggggatgtgctgcatcatcaccgccagcatcctcctgtggtacgcccagatccagccccactggatcgccgcctccatcatcctggagttcttcctcatcgtcctgctgatccccgagcccgagaagcagcggacgccgcaggacaaccagctcacctacgtggtgatcgcgatcctgaccgtcgtggccgccaccatggccaacgagatgggcttcctggagaagacgaagaaggacctcgggttcggcagcatcaccacccaggagagcgagtccaacatcctggacatcgacctgcgccccgccagcgcgtggaccctctacgccgtggccacgaccttcgtcacccccatgctgcggcactccatcgagaacagctccgtgaacgtgagcctgaccgccatcgcgaaccaggccacggtcctcatgggcctggggaagggctggcccctgtccaagatggacatcggggtgccgctcctggccatcggctgctacagccaggtgaaccccatcaccctgaccgccgccctcctgctgctcgtcgcgcactacgccatcatcgggcccggcctgcaggccaaggccacccgcgaggcccagaagcgggcggccgccggcatcatgaagaaccccacggtggacgggatcaccgtgatcgacctggagccgatcccctacgaccccaagttcgagaagcagctcggccaggtcatgctgctgatcctctgcgtgacccaggtgctgatgatgcgcaccacgtgggccctgtgcgaggccctcaccctggcgaccgggcccatctccaccctgtgggagggcaacccggggcggttctggaacacgaccatcgccgtcagcatggccaacatcttccgcggctcctacctcgccggcgcggggctgctgttcagcatcatgaagaacaccaccaacacgcgccggggcaccgggaacgtgggcgagaccctcggcgagaagtggaagtcccgcctgaacgccctgggcaagagcgagttccagatctacaagaagtccggcatccaggaggtggaccggaccctcgccaaggaggggatcaagcgcggcgagacggaccaccacgccgtcagccgggggtccgccaagctgcgctggttcgtggagcggaacatggtgacccccgagggcaaggtcgtggacctgggctgcgggcgcggcgggtggagctactactgcggcgggctcaagaacgtgcgggaggtcaagggcctgaccaagggcgggcccggccacgaggagcccatcccgatgtccacctacgggtggaacctggtgcgcctccagagcggcgtggacgtcttcttcacgccgcccgagaagtgcgacaccctgctgtgcgacatcggggagagctcccccaacccgaccatcgaggcgggccggaccctccgcgtgctgaacctggtggagaactggctcaacaacaacacccagttctgcatcaaggtcctgaacccctacatgcccagcgtgatcgagaagatggagacgctgcagcggaagtacggcggggccctcgtgcgcaacccgctgtcccggaacagcacccacgagatgtactgggtctccaacgccaccggcaacatcgtgagctccgtgaacatgatcagccgcatgctgatcaaccggttcaccatgaagcacaagaaggccacgtacgagcccgacgtcgacctggggtccggcacccgcaacatcgggatcgagagcgagacccccaacctcgacatcatcggcaagcggatcgagaagatcaagcaggagcacgagacctcctggcactacgaccaggaccacccctacaagacgtgggcctaccacggcagctacgagaccaagcagaccgggtccgcgagctccatggtgaacggcgtggtccgcctgctgaccaagccgtgggacgtggtgcccatggtcacgcagatggccatgaccgacaccacccccttcgggcagcagcgcgtgttcaaggagaaggtggacacgcggacccaggagcccaaggagggcaccaagaagctcatgaagatcaccgccgagtggctgtggaaggagctgggcaaggagaagacgccgcgcatgtgcacccgggaggagttcacccgcaaggtccggagcaacgccgccctcggggcggtgttcaccgacgagaacaagtggaagtccgcccgcgaggccgtggaggacggccggttctgggagctggtcgaccgcgagcggaacctgcacctcgaggggaagtgcgagacgtgcgtgtacaacatgatgggcaagcgcgagaagaagctgggggagttcggcaaggccaagggcagccgggcgatctggtacatgtggctgggggcccgcttcctcgagttcgaggccctgggcttcctgaacgaggaccactggttctcccgggggaacagcctcagcggcgtcgagggggagggcctgcaccgcctgggctacatcctccgggaggtggggaagaaggagggcggggccatgtacgccgacgacaccgcgggctgggacacccgcatcaccctggaggacctgaagaacgaggagatggtgacgaaccacatgaagggggagcacaagaagctcgccgaggccatcttcaagctgacctaccagaacaaggtcgtgcgggtgcagcgccccacgccccggggcaccgtcatggacatcatctcccgcaaggaccagcggggcagcggccaggtggggacgtacgggctgaacaccttcaccaacatggaggcccagctcatccgccagatggagggcgagggcatcttcaagtccatccagcacctgaccgccacggaggagaccgcggtgcagaactggctggcccgcgtcgggcgggagcgcctcagccggatggccatctccggcgacgactgcgtggtgaagcccatcgacgaccgcttcgccagcgccctgaccgcgctgaacgacatggggaaggtccggaaggacatccagcagtgggagccgtcccgcggctggaacgactggacccaggtgcccttctgcagccaccacttccacgagctcgtgatgaaggacgggcgggtcctggtggtgccctgccgcaaccaggacgagctgatcggccgggcccgcatctcccagggcgccgggtggagcctcaaggagaccgcctgcctgggcaagtcctacgcccagatgtggacgctgatgtacttccaccggcgcgacctccggctggcggccaacgccatctgcagcgccgtcccctcccactgggtgccgaccagccgcaccacctggtccatccacgcgaagcacgagtggatgacgaccgaggacatgctggccgtgtggaaccgggtctggatccaggagaacccctggatggaggacaagacccccgtggagagctgggaggaggtgccctacctcgggaagcgcgaggaccagtggtgcggctccctgatcgggctgaccagccgggccacgtgggccaagaacatccagaccgccatcaaccaggtccgcagcctcatcggcaacgagggctacaccgactacatgccgtccatgaagcggttccgccgcgaggaggaggaggcgggggtgctgtggtga

SEQ ID NO: 9028 - RNA, 9876 nt, synthetic construct
  misc_feature 1..9876: note = derived and/or modified CDS sequence (opt1) from DENV-2__KP188556__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcgggggcgtcttcacgtccatcgggaaggccctccaccaggtgttcggcgcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcatcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacacgctgtggtccaacggcgtgctggagagcgagatggtgatccccaagaacttcgccgggcccgtctcccagcacaactaccgcccgggctaccacacccagaccgcggggccctggcacctcggcaagctggagatggacttcgacttctgcgaggggaccacggtggtggtcaccgaggactgcgagaagcggggccccagcctgcgcaccaccacggccagcggcaagctcatcaccgagtggtgctgccggtcctgcaccctgcccccgctgcgctaccgcggggaggacggctgctggtacgggatggagatccgccccctcaaggagaaggaggagaacctggtgaacagcctggtgaccgccggccacgggcagatcgacaacttctccctcggcgtcctgggcatggccctgttcctcgaggagatgctgcggacgcgcgtggggaccaagcacgcgatcctgctcgtggccctgagcttcgtcaccctgatcaccggcaacatgtccttccgggacctcgggcgcgtgatggtgatggtcggcgccacgatgaccgacgacatcgggatgggcgtgacctacctggccctgctcgccgcgttcaaggtgcgccccaccttcgccgccggcctgctgctccggaagctgacgagcaaggagctgatgatggccaccatcgggatcgccctcctgtcccagagcaccctgcccgagaccatcctcgagctgacggacgcgctggccctcggcatgatggccctgaagatcgtccgcaacatggagaagtaccagctggccgtgaccatcatggccatctcctgcgtgccgaacgcggtcatcctccagaacgcctggaaggtgagctgcaccatcctggccgccgtgtccgtcagccccctgctcctgacctccagccagcagaaggcggactggatccccctggccctcacgatcaaggggctgaaccccaccgccatcttcctgaccaccctctcccggacgagcaagaagcgctcctggccgctgaacgaggccatcatggccgtgggcatggtcagcatcctggcgtccagcctcctgaagaacgacatccccatgaccggccccctggtggccgggggcctcctgaccgtgtgctacgtcctgaccgggcggagcgccgacctcgagctggagcgcgccgccgacgtgaagtgggaggaccaggcggagatctccggcagctcccccatcctgagcatcacgatctccgaggacgggagcatgtccatcaagaacgaggaggaggagcagaccctcaccatcctgatccggaccggcctgctcgtgatcagcggcgtcttcccggtgtccatccccatcaccgccgccgcctggtacctgtgggaggtgaagaagcagcgcgccggggtcctgtgggacgtgcccagcccgccgcccgtgggcaaggcggagctcgaggacggggcctaccggatcaagcagcgcggcatcctggggtactcccagatcggcgccggcgtctacaaggaggggacgttccacaccatgtggcacgtgacccggggcgccgtgctgatgcaccgcgggaagcggatcgagcccagctgggccgacgtcaagaaggacctcatctcctacggcgggggctggaagctggagggcgagtggaaggagggggaggaggtccaggtgctggcgctcgagcccggcaagaacccccgcgccgtccagaccaagcccgggatcttcaagacgaacaccggcaccatcggggccgtgagcctggacttctcccccggcaccagcggctcccccatcgtggaccggaaggggaaggtcgtgggcctgtacgggaacggcgtggtcacgcgcagcggcgcctacgtgtccgcgatcgcccagaccgagaagtccatcgaggacaaccccgagatcgaggacgacatcttccggaagaagcgcctcaccatcatggacctgcaccccggggccggcaagaccaagcggtacctgcccgccatcgtgcgcgaggccatcaagcgggggctgcgcacgctcatcctggcgccgacccgcgtcgtggccgccgagatggaggaggccctgcggggcctccccatccgctaccagacccccgccatccgggcggagcacaccgggcgcgagatcgtggacctgatgtgccacgccacgttcaccatgcggctgctcagccccgtccgcgtgccgaactacaacctgatcatcatggacgaggcccacttcaccgaccccgcctccatcgccgcgcggggctacatcagcacccgcgtggagatgggcgaggccgccgggatcttcatgacggccacgccgcccggctcccgggacccgttcccccagagcaacgcgcccatcatggacgaggagcgcgagatccccgagcggtcctggaacagcgggcacgagtgggtcaccgacttcaagggcaagaccgtgtggttcgtgccgtccatcaaggccgggaacgacatcgccgcctgcctgcgcaagaacggcaagaaggtcatccagctcagccggaagacgttcgactccgagtacgtgaagacccgcgccaacgactgggacttcgtggtcaccaccgacatcagcgagatgggcgcgaacttcaaggccgagcgggtgatcgacccccgccggtgcatgaagcccgtgatcctgacggacggggaggagcgcgtcatcctggccggccccatgccggtgacccactccagcgccgcccagcggcgcgggcgcatcggccggaaccccaagaacgagaacgaccagtacatctacatgggggagcccctcgagaacgacgaggactgcgcgcactggaaggaggccaagatgctgctggacaacatcaacacccccgagggcatcatcccgtccatgttcgagcccgagcgcgagaaggtggacgccatcgacggcgagtaccggctccgcggggaggcccggaagaccttcgtcgacctgatgcgccggggcgacctgcccgtgtggctcgcctacaaggtggcggccgaggggatcaactacgccgaccgcaagtggtgcttcgacggcatcaagaacaaccagatcctggaggagaacgtcgaggtggagatctggacgaaggagggggagcggaagaagctgaagccgcgctggctcgacgcccggatctacagcgaccccctggcgctgaaggagttcaaggagttcgccgccggccgcaagtccctcaccctgaacctgatcaccgagatgggccggctccccaccttcatgacgcagaaggcccgcaacgccctggacaacctggcggtgctccacaccgccgaggtcgggggcaaggcctacacccacgccctgagcgagctgcccgagaccctcgagacgctgctgctcctgaccctgctcgccgcggtgaccgggggcatcttcctgttcctgatgtccggcaaggggatcggcaagatgaccctcgggatgtgctgcatcatcaccgccagcatcctgctgtggtacgcccagatccagccgcactggatcgccgcctccatcatcctcgagttcttcctgatcgtcctgctcatccccgagcccgagaagcagcggacgccccaggacaaccagctgacctacgtggtgatcgcgatcctgaccgtcgtggccgccaccatggccaacgagatgggcttcctcgagaagacgaagaaggacctggggttcggcagcatcaccacccaggagagcgagtccaacatcctggacatcgacctccgcccggccagcgcgtggaccctgtacgccgtggccacgaccttcgtcacccccatgctgcggcactccatcgagaacagctccgtgaacgtgagcctcaccgccatcgcgaaccaggccacggtcctgatgggcctggggaagggctggcccctctccaagatggacatcggggtgcccctgctggccatcggctgctacagccaggtgaacccgatcaccctcaccgccgccctgctgctcctggtcgcgcactacgccatcatcgggcccggcctgcaggccaaggccacccgcgaggcccagaagcgggcggccgccggcatcatgaagaaccccacggtggacgggatcaccgtgatcgacctcgagcccatcccgcacgaccccaagttcgagaagcagctgggccaggtcatgctgctcatcctgtgcgtgacccaggtgctgatgatgcgcaccacgtgggccctctgcgaggccctgaccctggcgaccgggcccatctccaccctctgggagggcaaccccgggcggttctggaacacgaccatcgccgtcagcatggccaacatcttccgcggctcctacctggccggcgcggggctcctgttcagcatcatgaagaacaccaccaacacgcgccggggcaccgggaacgtgggcgagaccctgggcgagaagtggaagtcccgcctgaacgccctcggcaagagcgagttccagatctacaagaagtccggcatccaggaggtggaccggaccctggccaaggaggggatcaagcgcggcgagacggaccaccacgccgtcagccgggggtccgccaagctgcgctggttcgtggagcggaacatggtgaccccggagggcaaggtcgtggacctcggctgcgggcgcggcgggtggagctactactgcggcgggctgaagaacgtgcgggaggtcaagggcctgaccaagggcgggcccggccacgaggagcccatccccatgtccacctacgggtggaacctcgtgcgcctgcagagcggcgtggacgtcttcttcacgccgcccgagaagtgcgacaccctgctctgcgacatcggggagagctcccccaaccccaccatcgaggcgggccggaccctgcgcgtgctgaacctcgtggagaactggctgaacaacaacacccagttctgcatcaaggtcctgaacccgtacatgcccagcgtgatcgagaagatggagacgctccagcggaagtacggcggggccctggtgcgcaaccccctgtcccggaacagcacccacgagatgtactgggtctccaacgccaccggcaacatcgtgagctccgtgaacatgatcagccgcatgctgatcaaccggttcaccatgaagcacaagaaggccacgtacgagccggacgtcgacctcgggtccggcacccgcaacatcgggatcgagagcgagacccccaacctggacatcatcggcaagcggatcgagaagatcaagcaggagcacgagacctcctggcactacgaccaggaccacccctacaagacgtgggcctaccacggcagctacgagaccaagcagaccgggtccgcgagctccatggtgaacggcgtggtccgcctgctcaccaagccctgggacgtggtgccgatggtcacgcagatggccatgaccgacaccacccccttcgggcagcagcgcgtgttcaaggagaaggtggacacgcggacccaggagcccaaggagggcaccaagaagctgatgaagatcaccgccgagtggctgtggaaggagctcggcaaggagaagacgccccgcatgtgcacccgggaggagttcacccgcaaggtccggagcaacgccgccctgggggcggtgttcaccgacgagaacaagtggaagtccgcccgcgaggccgtggaggacggccggttctgggagctggtcgaccgcgagcggaacctccacctggaggggaagtgcgagacgtgcgtgtacaacatgatgggcaagcgcgagaagaagctgggggagttcggcaaggccaagggcagccgggcgatctggtacatgtggctcggggcccgcttcctggagttcgaggccctgggcttcctcaacgaggaccactggttctcccgggggaacagcctgagcggcgtcgagggggagggcctgcaccgcctcggctacatcctgcgggaggtggggaagaaggagggcggggccatgtacgccgacgacaccgcgggctgggacacccgcatcaccctggaggacctcaagaacgaggagatggtgacgaaccacatgaagggggagcacaagaagctggccgaggccatcttcaagctgacctaccagaacaaggtcgtgcgggtgcagcgcccgacgccccggggcaccgtcatggacatcatctcccgcaaggaccagcggggcagcggccaggtggggacgtacgggctcaacaccttcaccaacatggaggcccagctgatccgccagatggagggcgagggcatcttcaagtccatccagcacctgaccgccacggaggagaccgcggtgcagaactggctcgcccgcgtcgggcgggagcgcctgagccggatggccatctccggcgacgactgcgtggtgaagcccatcgacgaccgcttcgccagcgccctgaccgcgctcaacgacatggggaaggtccggaaggacatccagcagtgggagccctcccgcggctggaacgactggacccaggtgccgttctgcagccaccacttccacgagctggtgatgaaggacgggcgggtcctggtggtgccctgccgcaaccaggacgagctcatcggccgggcccgcatctcccagggcgccgggtggagcctgaaggagaccgcctgcctgggcaagtcctacgcccagatgtggacgctcatgtacttccaccggcgcgacctgcggctggcggccaacgccatctgcagcgccgtcccctcccactgggtgcccaccagccgcaccacctggtccatccacgcgaagcacgagtggatgacgaccgaggacatgctcgccgtgtggaaccgggtctggatccaggagaacccgtggatggaggacaagacccccgtggagagctgggaggaggtgccctacctggggaagcgcgaggaccagtggtgcggctccctgatcgggctcaccagccgggccacgtgggccaagaacatccagaccgccatcaaccaggtccgcagcctgatcggcaacgagggctacaccgactacatgccctccatgaagcggttccgccgcgaggaggaggaggcgggggtgctgtggtga

SEQ ID NO: 9029 - RNA, 9876 nt, synthetic construct
  misc_feature 1..9876: note = derived and/or modified CDS sequence (opt1) from DENV-2__GU369819__SS-prME
  source 1..9876: mol_type = other RNA
accgccggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacgtacgggacctgcaccaccacgggcgagcaccggcgcgagaagcggtccgtggccctggtgccccacgtcgggatgggcctcgagacccggaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgccccacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggagaacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccgggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccgcagcgtgacccggctggagaacctcatgtggaagcagatcacgcccgagctgaaccacatcctgtccgagaacgaggtgaagctcaccatcatgaccggcgacatcaaggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggagaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcttcctggaggagatgctgcgcacccggatcggcacgaagcacgcgatcctcctggtggccgtgagcttcgtcaccctgatcaccgggaacatgtccttccgcgacctcggccgcgtgatggtgatggtcggggccaccatgacggacgacatcggcatgggcgtgacctacctggccctgctcgccgcgttcaaggtgcggcccaccttcgccgccgggctgctgctccgcaagctgaccagcaaggagctgatgatggccacgatcggcatcgccctcctgtcccagagcaccatccccgagaccatcctggagctcaccgacgcgctggccctggggatgatggtcctcaagatcgtgcggaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccgcaccagcaagaagcggtcctggccgctcaacgaggccatcatggccgtcggcatggtgagcatcctggcctccagcctgctcaagaacgacatccccatgacggggcccctggtggcgggcgggctgctcaccgtctgctacgtgctgaccggccgcagcgccgacctggagctcgagcgggccgccgacgtgaagtgggaggaccaggccgagatctccgggagctcccccatcctgagcatcaccatctccgaggacggcagcatgtccatcaagaacgaggaggaggagcagacgctgaccatcctcatccgcaccggcctgctggtcatcagcggggtgttcccggtgtccatccccatcaccgcggccgcctggtacctctgggaggtcaagaagcagcgggccggcgtgctgtgggacgtgcccagcccgccgcccgtcgggaaggccgagctggaggacggcgcgtaccgcatcaagcagaaggggatcctcggctactcccagatcggcgccggggtgtacaaggagggcaccttccacacgatgtggcacgtgacccgcggggccgtcctgatgcaccgcggcaagcggatcgagcccagctgggccgacgtgaagaaggacctgatctcctacgggggcggctggaagctcgagggggagtggaaggagggcgaggaggtgcaggtcctggccctggagcccgggaagaacccccgcgcggtgcagaccaagcccggcatcttcaagaccaacacggggaccatcggcgccgtgagcctcgacttctcccccggcaccagcgggtcccccatcgtcgaccggaagggcaaggtggtggggctgtacggcaacggcgtcgtgacccgcagcggggcctacgtgtccgccatcgcgcagacggagaagtccatcgaggacaaccccgagatcgaggacgacatcttccggaagaagcgcctgaccatcatggacctccaccccggcgccgggaagaccaagcggtacctgcccgccatcgtccgcgaggccatcaagcggggcctgcgcaccctgatcctcgccccgacgcgcgtggtggcggccgagatggaggaggccctgcgggggctgcccatccgctaccagacccccgccatcaagaccgagcacaccggccgggagatcgtcgacctcatgtgccacgccacgttcaccatgcgcctgctgagccccgtgcgggtgccgaactacaacctcatcatcatggacgaggcgcacttcaccgaccccgcctccatcgccgcccgcggctacatcagcacccgggtcgagatgggggaggccgcgggcatcttcatgacggccacgccgcccgggtcccgcgacccgttcccccagagcaacgcccccatcatggacgaggagcgggagatccccgagcgctcctggaacagcggccacgagtgggtgaccgacttcaaggggaagaccgtgtggttcgtcccgtccatcaaggccggcaacgacatcgcggcctgcctgcggaagaacggcaagaaggtgatccagctgagccgcaagacgttcgactccgagtacgtgaagacccgggccaacgactgggacttcgtcgtgaccaccgacatcagcgagatgggggccaacttcaaggccgagcgcgtgatcgacccccggcgctgcatgaagcccgtcatcctcacggacggcgaggagcgggtgatcctggcggggcccatgccggtgacccactccagcgccgcccagcgccggggccgcatcgggcgcaaccccaagaacgagaacgaccagtacatctacatgggcgagcccctggagaacgacgaggactgcgcccactggaaggaggccaagatgctcctggacaacatcaacacccccgagggcatcatcccgtccatgttcgagcccgagcgggagaaggtcgacgcgatcgacggggagtaccgcctgcggggcgaggcccgcaagaccttcgtggacctcatgcggcgcggggacctgcccgtgtggctggcctacaaggtcgccgccgagggcatcaactacgcggaccggaagtggtgcttcgacgggatcaagaacaaccagatcctcgaggagaacatcgaggtggagatctggacgaaggagggcgagcgcaagaagctgaagccgcggtggctggacgcccgcatctacagcgaccccctcgccctgaaggagttcaaggagttcgccgcgggccggaagtccctgaccctcaacctgatcaccgagatggggcgcctgcccaccttcatgacgcagaaggcccggaacgccctcgacaacctggccgtgctgcacaccgccgaggcgggcgggcgcgcctacaaccacgccctcagcgagctgcccgagaccctggagaccctcctgctgctcacgctgctggccaccgtcaccggcggcatcttcctcttcctgatgtccgggcggggcatcgggaagatgaccctgggcatgtgctgcatcatcaccgccagcatcctcctgtggtacgcgcagatccagccgcactggatcgccgcctccatcatcctggagttcttcctcatcgtgctgctgatccccgagcccgagaagcagcgcacgccccaggacaaccagctcacctacgtcgtgatcgccatcctgaccgtggtcgccgcgaccatggccaacgagatggggttcctggagaagacgaagaaggacctcggcctgggcagcatcaccacccaggagagcgagtccaacatcctggacatcgacctccggccggccagcgcctggaccctgtacgccgtggcgacgaccttcgtgacccccatgctgcgccactccatcgagaacagctccgtcaacgtgagcctcaccgccatcgccaaccaggccacggtgctgatggggctgggcaaggggtggcccctctccaagatggacatcggcgtccccctgctggcgatcgggtgctacagccaggtgaacccgatcaccctcaccgccgccctgctgctcctggtggcccactacgccatcatcggccccggcctgcaggcgaaggccacccgggaggcccagaagcgcgccgccgcggggatcatgaagaaccccacggtcgacggcatcaccgtgatcgacctcgagcccatcccgtacgaccccaagttcgagaagcagctggggcaggtcatgctgctcatcctgtgcgtcacccaggtgctgatgatgcggaccacgtgggccctctgcgaggccctgaccctggccaccggccccatctccaccctctgggaggggaaccccggccgcttctggaacacgaccatcgccgtgagcatggcgaacatcttccgcggctcctacctggccggggccggcctcctgttcagcatcatgaagaacaccaccaacacgcggcgcgggaccggcaacatcggcgagaccctgggggagaagtggaagtcccggctgaacgccctcggcaagagcgagttccaggtctacaagaagtccgggatccaggaggtggaccgcaccctggcgaaggagggcatcaagcgcggggagacggaccaccacgccgtgagccgcggctccgccaagctgcggtggttcgtcgagcgcaacatggtgaccccggagggcaaggtggtcgacctcgggtgcggccgcgggggctggagctactactgcgggggcctgaagaacgtgcgcgaggtgaagggcctgaccaagggcggccccgggcacgaggagcccatccccatgtccacctacggctggaacctcgtccggctgcagagcggggtggacgtgttcttcacgccgcccgagaagtgcgacaccctgctctgcgacatcggcgagagctcccccaaccccaccatcgaggccggccgcaccctgcgggtcctgaacctcgtggagaactggctgaacaacaacacccagttctgcatcaaggtgctgaacccgtacatgcccagcgtcatcgagaagatggaggccctccagcgcaagtacgggggcgcgctggtgcggaaccccctgtcccgcaacagcacgcacgagatgtactgggtgtccaacgccaccgggaacatcgtcagctccgtgaacatgatcagccggatgctgatcaaccgcttcaccatgaagcacaagaaggccacctacgagccggacgtggacctcggctccgggacgcggaacatcggcatcgagagcgagatccccaacctggacatcatcggcaagcgcatcgagaagatcaagcaggagcacgagacctcctggcactacgaccaggaccacccctacaagacctgggcctaccacgggagctacgagaccaagcagacgggctccgccagctccatggtcaacggggtggtgcgcctgctcaccaagccctgggacgtcctgccgatggtgacccagatggcgatgaccgacacgacccccttcggccagcagcgggtgttcaaggagaaggtcgacacccgcacccaggagcccaaggagggcacgaagaagctgatgaagatcaccgccgagtggctctggaaggagctggggaagaagaagacgccccggatgtgcacccgcgaggagttcacgcggaaggtgcgcagcaacgccgccctgggcgccatcttcaccgacgagaacaagtggaagtccgcgcgggaggccgtggaggacgggcgcttctgggagctcgtcgaccgggagcgcaacctgcacctggagggcaagtgcgagacctgcgtgtacaacatgatggggaagcgggagaagaagctcggcgagttcggcaaggccaaggggagccgcgccatctggtacatgtggctgggcgcgcggttcctggagttcgaggccctcgggttcctgaacgaggaccactggttctcccgcggcaacagcctgagcggggtggagggcgagggcctccaccggctggggtacatcctgcgcgacgtcggcaagaaggagggcggcgccatgtacgccgacgacaccgccgggtgggacacgcggatcaccctcgaggacctgaagaacgaggagatggtgaccaaccacatgaagggcgagcacaagaagctggcggaggccatcttcaagctcacctaccagaacaaggtcgtgcgcgtgcagcggccgacgccccgcggcaccgtcatggacatcatctcccggcgcgaccagcgcgggagcggccaggtggggacctacggcctgaacaccttcacgaacatggaggcccagctgatccggcagatggagggcgaggggatcttcaagtccatccagcacctcaccgccaccgaggagatcgccgtgcagaactggctggcgcgcgtcggccgggagcgcctgagccggatggccatctccggggacgactgcgtggtgaagcccatcgacgaccgcttcgccagcgccctcaccgccctgaacgacatgggcaaggtccggaaggacatccagcagtgggagccctcccgcgggtggaacgactggacccaggtcccgttctgcagccaccacttccacgagctggtgatgaaggacggccgggtcctcgtggtgccctgccgcaaccaggacgagctgatcggccgggcgcgcatctcccagggggccggctggagcctgaaggagaccgcctgcctcgggaagtcctacgcccagatgtggaccctgatgtacttccaccggcgcgacctgcggctcgccgcgaacgccatctgcagcgccgtgccgccccactgggtgccgacctcccgcaccacgtggagcatccacgccaagcacgagtggatgaccaccgaggacatgctggcggtgtggaaccgggtctggatccaggagaacccctggatggaggacaagacccccgtggagtcctgggaggaggtgccctacctgggcaagcgcgaggaccagtggtgcgggagcctcatcggcctgacgtcccgggccacctgggccaagaacatccagaccgccatcaaccaggtccgcagcctgatcggcaacgaggagtacaccgactacatgccgagcatgaagcgcttccggcgcgaggaggaggaggccggggtgctctggtga

SEQ ID NO: 9030 - RNA, 9876 nt, synthetic construct
  misc_feature 1..9876: note = derived and/or modified CDS sequence (opt1) from DENV-2__JX649147__SS-prME
  source 1..9876: mol_type = other RNA
accgccggcgtgatcatcatgctgatccccaccgccatggcgttccacctcaccacccgcaacggggagccccacatgatcgtgggccggcaggagaagggcaagagcctgctgttcaagaccgaggacggcgtgaacatgtgcaccctcatggccatcgacctgggggagctgtgcgaggacaccatcacctacaagtgccccctcctgcgccagagcgagcccgaggacatcgactgctggtgcaacagcaccagcacctgggtgacctacgggacctgcaccaccacgggcgagcaccggcgcgagaagcggagcgtcgccctggtgccccacgtggggatgggcctcgagacccgcaccgagacctggatgtccagcgagggggcctggaagcacgcccagcggatcgagacctggatcctgcgccaccccggcttcaccatcatggcggccatcctggcctacaccatcgggaccacgcacttccagaaggccctcatcttcatcctgctgaccgcggtcgccccctccatgaccatgcggtgcatcggcatcagcaaccgcgacttcgtggagggcgtgtccgggggcagctgggtcgacatcgtgctcgagcacgggtcctgcgtgaccacgatggccaagaacaagcccaccctggacttcgagctgatcaagaccgaggccaaggagcccgccaccctccggaagtactgcatcgaggcgaagctgacgaacaccaccaccgagagccgctgcccgacgcagggcgagccctccctgaacgaggagcaggacaagcggttcgtctgcaagcacagcatggtggaccgcggctgggggaacggctgcgggctgttcggcaagggcgggatcgtgacctgcgccatgttcacgtgcaagaagaacatggagggcaagatcgtccagcccgagaacctggagtacaccatcgtgatcacgccccactccggggaggagcacgccgtgggcaacgacaccgggaagcacggcaaggagatcaagatcaccccgcagagctccatcaccgaggccgagctgaccgggtacggcacggtcaccatggagtgcagcccccggaccggcctcgacttcaacgagatggtgctgctgcagatggaggacaaggcctggctcgtgcaccgccagtggttcctggacctgcccctcccctggctgccgggggcggacacccagggctccaactggatccagaaggagacgctggtcaccttcaagaacccccacgccaagaagcaggacgtggtggtcctcgggagccaggagggcgccatgcacaccgccctgaccggggccacggagatccagatgagctccggcaacctcctgttcaccggccacctgaagtgccggctgcgcatggacaagctccagctgaaggggatgagctactccatgtgcaccggcaagttcaagatcgtgaaggagatcgcggagacccagcacgggacgatcgtcatccgggtgcagtacgagggcgacggcagcccctgcaagatccccttcgagatcatggacctggagaagcgccacgtgctcgggcggctgatcaccgtcaacccgatcgtgaccgagaaggactcccccgtgaacatcgaggccgagccgcccttcggcgacagctacatcatcatcggggtcgagccgggccagctgaagctcaactggttcaagaaggggtccagcatcggccagatgttcgagaccacgatgcgcggcgccaagcgcatggccatcctgggggacaccgcctgggacttcggctccctcggcggggtgttcaccagcatcgggaaggcgctccaccaggtgttcggggccatctacggcgccgccttctccggggtcagctggaccatgaagatcctgatcggcgtgatcatcacgtggatcgggatgaactcccggagcacctccctgagcgtgtccctggtcctcgtgggcgtgatcaccctgtacctgggggcgatggtccaggccgacagcggctgcgtggtgtcctggaagaacaaggagctcaagtgcggcagcgggatcttcatcaccgacaacgtccacacgtggaccgagcagtacaagttccagcccgagagcccctccaagctggccagcgccatccagaaggcccacgaggagggcatctgcgggatccgctccgtgacccggctggagaacctcatgtggaagcagatcacccccgagctgaaccacatcctgagcgagaacgaggtgaagctcacgatcatgaccggcgacatcaaggggatcatgcaggcgggcaagcgctccctgcggccgcagcccaccgagctgaagtacagctggaagacctggggcaaggccaagatgctctccacggagagccacaaccagaccttcctgatcgacgggcccgagaccgccgagtgcccgaacaagaaccgcgcctggaactccctggaggtcgaggactacggcttcggggtgttcaccacgaacatctggctcaagctgcgggagaagcaggacgtgttctgcgacagcaagctgatgtccgccgcgatcaaggacaaccgcgccgtccacgccgacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagagcttcgcggggcccgtgagccagcacaactaccggccgggctactacacccagaccgccgggccctggcacctcggcaagctggagatggacttcgacttctgcgaggggacgaccgtggtggtcaccgaggactgcggcaaccgcggcccctccctgcggaccacgaccgccagcgggaagctcatcaccgagtggtgctgccgctcctgcaccctgcccccgctgcggtaccgcggcgaggacgggtgctggtacggcatggagatccggcccctcaaggagaaggaggagaacctggtgaacagcctggtgacggccgggcacggccagatcgacaacttctccctcggcgtcctggggatggcgctgttcctcgaggagatgctgcgcacccgggtgggcaccaagcacgccatcctgctcgtggccgtcagcttcgtgaccctgatcacggggaacatgtccttccgcgacctgggccgggtgatggtcatggtgggggccaccatgaccgacgacatcggcatgggcgtgacctacctcgccctgctggcggccttcaaggtccgccccacgttcgccgccgggctcctgctgaagaagctcaccagcaaggagctgatgatggccaccatcggcatcgcgctgctctcccagagcaccatccccgagacgatcctggagctgaccgacgccctcgccctggggatgatggtgctgaagatcgtgcgcaacatggagaagtaccagctcgccgtcaccatcatggccatctcctgcgtgccgaacgcggtgatcctgcagaacgcctggaaggtcagctgcaccatcctggccgccgtgtccgtgagccccctcctgctgacgtccagccagcagaaggcggactggatccccctcgccctgaccatcaagggcctgaaccccaccgccatcttcctcaccacgctgtcccggaccagcaagaagcgctcctggccgctgaacgaggccatcatggccgtcggcatggtgagcatcctcgcgagctccctgctgaagaacgacatccccatgaccgggcccctcgtcgccggcgggctgctgaccgtgtgctacgtgctcacgggccggagcgccgacctggagctggagcgcgccaccgacgtcaagtgggaggaccaggccgagatctccgggagctcccccatcctcagcatcaccatctccgaggacggcagcatgtccatcaagaacgaggaggaggagcagaccctgacgatcctgatccggaccggcctcctggtgatcagcgggctgttcccgatgtccatccccatcaccgcggccgcctggtacctctgggaggtgaagaagcagcgcgccggcgtcctgtgggacgtgcccagcccgccgcccgtggggaaggccgagctggaggacggcgcgtaccggatcaagcagaaggggatcctcggctactcccagatcggcgccggggtctacaaggagggcaccttccacaccatgtggcacgtgacgcgcggggccgtgctgatgcaccggggcaagcgcatcgagcccagctgggccgacgtcaagaaggacctgatctcctacgggggcggctggaagctcgagggggagtggaaggagggcgaggaggtccaggtgctggccctggagcccgggaagaacccccgggcggtccagaccaagcccggcctcttcaagaccaacaccgggacgatcggcgccgtgagcctggacttctcccccggcaccagcgggtcccccatcgtggaccgcaagggcaaggtcgtggggctgtacggcaacggcgtggtcacccggagcggggcctacgtgagcgccatcgcgcagaccgagaagtccatcgaggacaaccccgagatcgaggacgacatcttccgcaagaagcggctcacgatcatggacctgcaccccggcgccgggaagaccaagcgctacctgcccgccatcgtgcgggaggccatcaagcgcggcctgcggaccctcatcctggccccgacccgcgtcgtggcggccgagatggaggaggccctgcgggggctccccatccgctaccagacgcccgccatccgcgccgagcacaccggccgggagatcgtggacctgatgtgccacgcgaccttcaccatgcgcctgctcagccccgtccgggtgccgaactacaacctgatcatcatggacgaggcccacttcacggaccccgcctccatcgccgcccgcggctacatcagcacccgggtggagatgggggaggcggccggcatcttcatgaccgccacgccgcccgggtcccgcgacccgttcccccagagcaacgcccccatcatggacgaggagcgggagatccccgagcgctcctggaacagcggccacgagtgggtcacggacttcaaggggaagaccgtgtggttcgtgccgtccatcaaggcgggcaacgacatcgccgcctgcctgcggaagaacggcaagaaggtcatccagctcagccgcaagaccttcgactccgagtacgtgaagacccggacgaacgactgggacttcgtggtcaccaccgacatcagcgagatgggggccaacttcaaggccgagcgcgtgatcgacccccggcgctgcatgaagcccgtgatcctgaccgacggcgaggagcgggtcatcctggcggggcccatgccggtgacgcactccagcgccgcccagcgccggggccgcatcgggcggaaccccaagaacgagaacgaccagtacatctacatgggcgagcccctcgagaacgacgaggactgcgcccactggaaggaggccaagatgctgctggacaacatcaacacccccgagggcatcatcccgtccatgttcgagcccgagcgcgagaaggtggacgcgatcgacggggagtaccgcctccggggcgaggcccgcaagaccttcgtcgacctgatgcggcgcggggacctgcccgtgtggctcgcctaccgggtggccgccgagggcatcaactacgcggaccgccggtggtgcttcgacggggtcaagaacaaccagatcctggaggagaacgtggaggtggagatctggaccaaggagggcgagcgcaagaagctgaagccgcggtggctcgacgcccgcatctacagcgaccccctggccctgaaggagttcaaggagttcgccgcgggccggaagtccctcacgctgaacctgatcaccgagatggggcgcctccccaccttcatgacccagaaggcccgggacgccctggacaacctggccgtcctccacacggccgaggcgggcgggcgcgcctacaaccacgccctgagcgagctgcccgagaccctcgagaccctgctgctcctgaccctgctcgccacggtgaccggcggcatcttcctgttcctgatgtccgggaagggcgtggggaagatgaccctcggcatgtgctgcatcatcaccgccagcatcctgctgtggtacgcgcagatccagccgcactggatcgccgccagcatcatcctcgagttcttcctgatcgtcctgctcatccccgagcccgagaagcagcggacgccccaggacaaccagctgacgtacgtggtcatcgccatcctgaccgtggtggccgcgaccatggccaacgagatggggttcctcgagaagaccaagaaggacctgggcctgggctccatcgccacgcaggagccggagagcaacatcctcgacatcgacctgcgccccgcctccgcctggaccctgtacgcggtcgccaccaccttcgtgacgcccatgctccggcacagcatcgagaactccagcgtgaacgtctccctgaccgccatcgccaaccaggcgaccgtgctgatggggctcggcaaggggtggcccctgagcaagatggacatcggcgtgccgctgctcgccatcgggtgctactcccaggtcaaccccatcaccctgacggccgccctgctcctgctgatcgcccactacgcgatcatcggccccggcctccaggccaaggccacccgcgaggcccagaagcgggccgcggccgggatcatgaagaaccccaccgtggacggcatcaccgtgatcgacctggacccgatcccctacgaccccaagttcgagaagcagctggggcaggtcatgctcctgatcctgtgcgtgacccaggtgctcatgatgcgcaccacctgggccctgtgcgaggccctgaccctcgccacgggccccatcagcaccctgtgggaggggaacccgggccggttctggaacaccaccatcgcggtctccatggccaacatcttccgcggcagctacctggccggggccggcctcctgttctccatcatgaagaacacgaccaacacccgccgggggaccggcaacatcggcgagacgctgggggagaagtggaagtcccgcctcaacgcgctgggcaagtccgagttccagatctacaagaagtccgggatccaggaggtggaccggaccctggccaaggagggcatcaagcgcggggagaccgaccaccacgccgtgtcccggggcagcgccaagctccgctggttcgtcgagcggaacatggtgacccccgagggcaaggtggtcgacctggggtgcggccgcgggggctggtcctactactgcgggggcctgaagaacgtgcgggaggtgaagggcctcacgaagggcggccccgggcacgaggagcccatcccgatgagcacctacggctggaacctggtccgcctgcagagcggggtggacgtgttcttcacgccgcccgagaagtgcgacaccctcctgtgcgacatcggcgagtccagccccaacccgacgatcgaggccggccggaccctgcgcgtcctctccctggtggagaactggctgaacaacgacacccagttctgcatcaaggtgctcaacccctacatgcccagcgtcatcgagaagatggagaccctgcagcggaagtacgggggcgcgctggtgcgcaacccgctgtcccggaacagcacccacgagatgtactgggtgtccaacgccacggggaacatcgtcagctccgtgaacatgatcagccgcatgctcatcaaccggttcaccatgaagcacaagaaggccacctacgagcccgacgtggacctgggctccgggacccgcaacatcggcatcgagagcgagatccccaacctggacatcatcggcaagcggatcgagaagatcaagcaggagcacgagacgtcctggcactacgaccaggaccacccctacaagacctgggcctaccacgggagctacgagaccaagcagaccggctccgccagctccatggtcaacggggtggtgcgcctcctgacgaagccgtgggacgtcgtgcccatggtgacccagatggcgatgaccgacaccacgcccttcggccagcagcgcgtcttcaaggagaaggtggacacccggacccaggagcccaaggagggcaccaagaagctgatgaagatcacggccgagtggctctggaaggagctggggaagaagaagaccccgcgcatgtgcacccgggaggagttcacccgcaaggtgcggagcaacgccgccctgggcgccatcttcacggacgagaacaagtggaagtccgcgcgcgaggccgtcgaggacagccggttctgggagctcgtggacaaggagcgcaacctgcacctggaggggaagtgcgagacctgcgtgtacaacatgatgggcaagcgggagaagaagctcggggagttcggcaaggccaagggcagccgcgccatctggtacatgtggctgggggcgcggttcctggagttcgaggccctcggcttcctgaacgaggaccactggttctcccgcgagaacagcctgtccggggtcgagggcgaggggctccacaagctgggctacatcctgcgggacgtgagcaagaaggagggcggggccatgtacgccgacgacaccgccggctgggacacccgcatcacgctcgaggacctgaagaacgaggagatggtgaccaaccacatggagggggagcacaagaagctggcggaggccatcttcaagctcacctaccagaacaaggtcgtgcgggtccagcgccccacgccccggggcacggtgatggacatcatctcccgccgggaccagcgcgggagcggccaggtgggcacctacgggctgaacaccttcaccaacatggaggcccagctgatccggcagatggagggcgaggggatcttcaagtccatccagcacctcacggtcaccgaggagatcgccgtgcaggactggctggcccgcgtgggccgcgagcggctgagccgcatggcgatctccggcgacgactgcgtcgtgaagcccctcgacgaccggttcgccagcgccctgaccgccctgaacgacatggggaaggtgcgcaaggacatccagcagtgggagccgtcccggggctggaacgactggacccaggtccccttctgcagccaccacttccacgagctcatcatgaaggacgggcgcgtgctggtggtcccctgccggaaccaggacgagctgatcggccgcgcccggatctcccagggggcgggctggagcctcaaggagacggcctgcctgggcaagtcctacgcccagatgtggagcctgatgtacttccaccgccgggacctccgcctggccgccaacgcgatctgctccgccgtgcccagccactgggtgccgaccagccggaccacctggtccatccacgccaagcacgagtggatgaccacggaggacatgctgaccgtctggaaccgcgtgtggatccaggagaacccctggatggaggacaagacccccgtggagagctgggaggaggtcccctacctcgggaagcgggaggaccagtggtgcggctccctgatcgggctgaccagccgcgccacgtgggcgaagaacatccagaccgccatcaaccaggtgcggtccctcatcggcaacgaggagtacaccgactacatgccgagcatgaagcgcttccggcgcgaggaggaggaggccggggtgctgtggtga

SEQ ID NO: 9031 - RNA, 9876 nt, synthetic construct
  misc_feature 1..9876: note = derived and/or modified CDS sequence (opt1) from DENV-2__KF704356__SS-prME
  source 1..9876: mol_type = other RNA
accgccggcatgatcatcatgctgatccccaccgtgatggccttccacctcaccacccggaacggggagccccacatgatcgtcagccggcaggagaagggcaagagcctgctgttcaacaccggggacggcgtgcacatgtgcaccctcatggcgatgcacctgggggagctgtgcgaggacaccatcacctacaagtgccccctcctgcggcagaacgagcccgaggacatcgactgctggtgcaacagcacctccacctgggtgacgtacgggacctgcaccaccacgggcgagcaccggcgcgagaagcggagcgtcgccctggtgccccacgtggggatgggcctcgagacccgcaccgagacctggatgtccagcgagggggcctggaagcacgcccagcggatcgagacgtggatcctgcgccaccccggcttcaccatcatggccgcgatcctggcctacaccatcgggaccacgcacttccagcgggccctcatcttcatcctgctgaccgccgtcgcgccctccatgaccatgcgctgcatcggcatcagcaaccgggacttcgtggagggcgtgtccgggggcagctgggtcgacatcgtgctcgagcacgggtcctgcgtgaccacgatggccaagaacaagcccaccctggacctggagctcatcaagaccgaggccaagcagcccgccaccctgcgcaagtactgcatcgaggccaagctgacgaacaccaccaccgagagccggtgcccgacgcagggcgagccctccctcaacgaggagcaggacaagcgcttcgtctgcaagcacagcatggtggaccggggctgggggaacggctgcgggctgttcggcaaggggtccatcgtgacctgcgcgatgttcacgtgcaagaagatcatgaagggcaaggtcgtgcagcccgagaacctggagtacaccatcgtgatcacgccccacagcggcgaggagcacgccgtcgggaacgacaccggcaagcacgggaaggagatcaagatcaccccgcagtccagcatcaccgaggccgagctcaccggctacgggacggtgaccatggagtgcagcccccggaccggcctggacttcaacgagatggtgctgctccagatggaggacaaggcctggctggtccaccggcagtggttcctggacctccccctgccctggctgccgggcgccgacacccaggggagcaactggatccagaaggagacgctcgtgaccttcaagaacccccacgcgaagaagcaggacgtggtcgtgctgggcagccaggagggggccatgcacaccgccctgaccggcgccacggagatccagatgtccagcgggaacgtcctcttcaccggccacctgaagtgccgcctgcggatggacaagctccagctgaagggcatgtcctacagcatgtgcaccgggaagttcaaggtggtgaaggagatcgccgagacccagcacggcacgatcgtcatccgcgtgcagtacgagggggacggctccccctgcaagatccccttcgagatcatggacctggagaagcggcacgtgctcggccgcctgatcaccgtcaacccgatcgtgaccgggaaggacagccccgtgaacatcgaggcggagccgcccttcggcgactcctacatcatcatcggggtcgagccgggccagctgaagctcaactggttcaagaaggggagctccatcggccagatgttcgccaccacgatgcgcggcgccaagcggatggccatcctgggggacaccgcctgggacttcggcagcctcgggggcgtgttcacctccatcgggaaggcgctccaccaggtgttcggcgccatctacggcgccgccttcagcggggtctcctggaccatgaagatcctgatcggcgtgatcatcacgtggatcgggatgaacagccgctccaccagcctgtccgtgagcctggtcctcgtgggcgtggtcaccctgtacctgggggtgatggtgcaggcggactccggctgcgtcgtgagctggaagaacaaggagctcaagtgcggcagcgggatcttcatcaccgacaacgtgcacacgtggaccgagcagtacaagttccagcccgagtcccccagcaagctggcctccgccatccagaaggcccacgaggagggcatctgcgggatccggagcgtcacccgcctggagaacctcatgtggaagcagatcacccccgagctgaaccacatcctgtccgagaacgaggtgaagctcacgatcatgaccggcgacatcaaggggatcatgcaggccggcaagcggagcctgcgcccgcagcccaccgagctgaagtactcctggaagacctggggcaaggcgaagatgctcagcacggagtcccacaaccagaccttcctgatcgacgggcccgagaccgccgagtgcccgaacaccaaccgggcctggaacagcctggaggtggaggactacggcttcggggtcttcacgaccaacatctggctcaagctgcgcgaggagcaggacgtgttctgcgactccaagctgatgagcgccgccatcaaggacaaccgggcggtgcacgccgacatgggctactggatcgagtccgccctcaacgacacctggaagatcgagaaggccagcttcatcgaggtcaagtcctgccactggcccaagagccacaccctgtggtccaacggcgtgctggagagcgagatgatcatccccaagaacttcgccgggcccgtgagccagcacaactaccgcccgggctaccacacccagacggcggggccctggcacctcggcaagctggagatggacttcgacttctgcgaggggaccaccgtcgtggtgaccgaggactgcggcaaccggggcccctccctgcgcacgaccaccgccagcgggaagctcatcaccgagtggtgctgccggtcctgcacgctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcgtcggcaccaagcacgcgatcctgctcgtggccgtgagcttcgtcacgctgatcaccgggaacatgtccttccgggacctgggccgcgtgatggtgatggtcggggccaccatgaccgacgacatcggcatgggcgtgacgtacctcgccctgctggccgcgttcaaggtgcgccccaccttcgccgccgggctcctgctgcggaagctcaccagcaaggagctgatgatgaccacgatcggcatcgtcctgctctcccagagcaccatccccgagaccatcctggagctgaccgacgccctcgccctggggatgatggtgctgaagatggtgcgcaagatggagaagtaccagctcgcggtcacgatcatggccatcctgtgcgtgccgaacgccgtcatcctgcagaacacctggaaggtgtcctgcaccatcctcgccgtggtcagcgtgagccccctgttcctgaccagctcccagcagaaggccgactggatccccctcgcgctgacgatcaagggcctgaaccccaccgccatcttcctcaccaccctgagccggacgaacaagaagcgctcctggccgctgaacgaggccatcatggccgtgggcatggtcagcatcctcgcgtccagcctgctgaagaacgacatccccatgaccgggcccctcgtggccggcgggctgctgaccgtgtgctacgtcctcaccggccggagcgccgacctggagctggagcgcgccgccgacgtgaagtgggaggaccaggcggagatctccgggagctcccccatcctcagcatcacgatctccgaggacggcagcatgtccatcaagaacgaggaggaggagcagaccctgaccatcctgatccggaccggcctcctggtgatcagcgggctgttcccggtctccatccccatcaccgccgccgcctggtacctctgggaggtgaagaagcagcgcgccggcgtgctgtgggacgtcccctccccgccgcccgtggggaaggcggagctggaggacggcgcctaccggatcaagcagaaggggatcctcggctactcccagatcggcgccggggtgtacaaggagggcacgttccacaccatgtggcacgtcacccgcggggccgtgctgatgcacaagggcaagcggatcgagcccagctgggccgacgtgaagaaggacctgatctcctacgggggcggctggaagctcgagggggagtggaaggagggcgaggaggtccaggtgctggcgctggagcccgggaagaacccccgcgccgtgcagaccaagcccggcctcttcaagacgaacgccgggaccatcggcgccgtcagcctggacttctcccccggcaccagcgggtcccccatcatcgaccggaagggcaaggtggtggggctgtacggcaacggcgtcgtgacccgcagcggggcctacgtgtccgcgatcgcccagacggagaagtccatcgaggacaaccccgagatcgaggacgacatcttccggaagcgcaagctcaccatcatggacctgcaccccggcgccgggaagaccaagcggtacctgcccgccatcgtccgcgaggcgatcaagcggggcctgcgcaccctcatcctggccccgacgcgggtggtggccgccgagatggaggaggccctgcgcgggctccccatccgctaccagacccccgcgatccgggccgagcacaccggccgcgagatcgtcgacctgatgtgccacgccaccttcacgatgcggctgctcagccccgtgcgcgtgccgaactacaacctgatcatcatggacgaggcccacttcaccgaccccgcctccatcgcggcccggggctacatcagcacccgcgtcgagatgggggaggccgccggcatcttcatgaccgccacgccgcccgggtcccgggacccgttcccccagagcaacgcgcccatcatggacgaggagcgcgagatccccgagcggtcctggagctccggccacgagtgggtgaccgacttcaaggggaagaccgtgtggttcgtcccgagcatccgcgccggcaacgacatcgccgcctgcctgcggaagaacggcaagaaggtgatccagctctcccgcaagaccttcgacagcgagtacgtgaagacgcggaccaacgactgggacttcgtcgtgaccaccgacatctccgagatgggggcgaacttcaaggccgagcgcgtgatcgacccccggcgctgcatgaagcccgtcatcctgacggacggcgaggagcgggtgatcctggccgggcccatgccggtgacccacagctccgccgcccagcgccggggccgcatcgggcgcaaccccaagaacgagaacgaccagtacatctacatgggcgagcccctcgagaacgacgaggactgcgcgcactggaaggaggccaagatgctgctggacaacatcaacacccccgagggcatcatcccgagcatgttcgagcccgagcgggagaaggtcgacgccatcgacggggagtaccgcctccggggcgaggcccgcaagaccttcgtggacctgatgcggcgcggggacctgcccgtgtggctcgcctaccgggtcgcggccgagggcatcaactacgccgaccgccggtggtgcttcgacgggatcaagaacaaccagatcctggaggagaacgtggaggtcgagatctggacgaaggagggcgagcgcaagaagctgaagccgcggtggctcgacgcccgcatctactccgaccccctggccctgaaggagttcaaggagttcgcggccggccgcaagagcctcaccctgaacctgatcaccgagatggggcgcctccccaccttcatgacgcagaaggcccgggacgccctggacaacctggcggtgctccacaccgccgaggccggcgggcgcgcctacaaccacgccctgtccgagctgcccgagaccctcgagaccctgctgctcctgacgctgctcgcgaccgtgaccggcggcatcttcctgttcctgatgagcgggcggggcatcgggaagatgaccctcggcatgtgctgcatcatcaccgcctccatcctgctgtggtacgcccagatccagccgcactggatcgccgccagcatcatcctcgagttcttcctgatcgtcctgctcatccccgagcccgagaagcagcgcacgccccaggacaaccagctgacctacgtggtgatcgcgatcctgaccgtcgtggccgccaccatggccaacgagatggggttcctcgagaagacgaagaaggacctgggcctgggcagcatcaccacccagcagccggagtccaacatcctcgacatcgacctgcggcccgccagcgcgtggaccctgtacgccgtggccacgaccttcgtcacccccatgctccgccactccatcgagaacagctccgtgaacgtgagcctgaccgccatcgccaaccaggcgacggtcctgatggggctcggcaaggggtggcccctgtccaagatggacatcggcgtgccgctgctcgccatcgggtgctacagccaggtgaaccccatcaccctgaccgccgccctgttcctcctggtcgcgcactacgccatcatcggccccggcctgcaggccaaggccacccgggaggcccagaagcgcgcggccgccgggatcatgaagaaccccacggtggacggcatcaccgtgatcgacctcgacccgatcccctacgaccccaagttcgagaagcagctggggcaggtcatgctgctcgtgctgtgcgtgacccaggtcctgatgatgcgcaccacgtgggccctctgcgaggccctgaccctggcgaccggccccatctccaccctctgggaggggaacccgggccggttctggaacacgaccatcgccgtgagcatggccaacatcttccgcggctcctacctggccggggccggcctgctgttcagcatcatgaagaacaccaccaacacgcggcgcgggaccggcaacatgggcgagaccctgggggagaagtggaagtcccggctgaacgcgctcggcaagagcgagttccagatctacaagaagtccgggatccaggaggtggaccgcaccctggccaaggagggcatcaagcgcggggagacggaccaccacgccgtcagccgcggctccgccaagctgcggtggttcgtggagcgcaacatggtgacccccgagggcaaggtcgtggacctcgggtgcggccgcgggggctggagctactactgcgggggcctgaagaacgtgcgcgaggtcaagggcctgaccaagggcggccccgggcacgaggagcccatcccgatgtccacctacggctggaacctcgtgcggctgcagagcggggtggacgtcttcttcacgccgcccgagaagtgcgacaccctgctctgcgacatcggcgagagctcccccaacccgaccgtggaggcgggccgcaccctgcgggtgctgaacctcgtcgagaactggctgaacaacaacacccagttctgcatcaaggtgctgaacccctacatgcccagcgtgatcgagaagatggaggccctccagcgcaagtacgggggcgccctggtccggaacccgctgtcccgcaacagcacgcacgagatgtactgggtgtccaacgccagcgggaacatcgtgtccagcgtcaacatgatctcccggatgctgatcaaccgcttcaccatgcgccacaagaaggccaccttcgagcccgacgtggacctcggcagcgggacccggaacatcggcatcgagtccgagatccccaacctggacatcatcggcaagcgcatcgagaagatcaagcaggagtacgagacgagctggcactacgaccaggaccacccctacaagacctgggcgtaccacgggtcctacgagaccaagcagaccggcagcgcctccagcatggtgaacggggtcgtgcggctgctcacgaagccgtgggacgtggtccccatggtgacccagatggccatgaccgacaccacgcccttcggccagcagcgcgtgttcaaggagaaggtcgacacccggacccaggagcccaaggagggcaccaagaagctgatgaagatcacggccgagtggctgtggaaggagctcgggaagaagaagaccccgcgcatgtgcacccgggaggagttcacccgcaaggtgcggtccaacgccgcgctgggcgccatcttcacggacgagaacaagtggaagtccgcccgcgaggccgtcgaggactcccggttctgggagctggtggacaaggagcgcaacctccacctggaggggaagtgcgagacctgcgtgtacaacatgatgggcaagcgggagaagaagctgggggagttcggcaaggccaagggcagccgcgcgatctggtacatgtggctcggggcccggttcctggagttcgaggccctgggcttcctcaacgaggaccactggttcagccgcgagaactccctgagcggggtcgagggcgaggggctgcacaagctcggctacatcctgcgggacgtgtccaagaaggagggcggggccatgtacgcggacgacaccgccggctgggacacccgcatcacgctggaggacctcaagaacgaggagatggtgaccaaccacatggagggggagcacaagaagctggccgaggccatcttcaagctgacctaccagaacaaggtcgtgcgggtgcagcgccccacgccccggggcacggtcatggacatcatcagccgccgcgaccagcgggggtccggccaggtgggcacctacgggctcaacaccttcaccaacatggaggcccagctgatccgccagatggagggcgagggggtgttcaagaacatccagcacctgacggtcaccgaggagatcgcggtgcagaactggctcgcccgggtgggccgcgagcggctgagccgcatggccatctccggcgacgactgcgtcgtgaagcccctggacgaccggttcgccagcgccctcaccgcgctgaacgacatggggaaggtgcgcaaggacatccagcagtgggagccgtcccggggctggaacgactggacccaggtccccttctgcagccaccacttccacgagctgatcatgaaggacgggcgcgtgctcgtggtcccctgccggaaccaggacgagctgatcggccgcgcccggatctcccagggggccggctggagcctgcgcgagacggcctgcctcggcaagtcctacgcccagatgtggagcctgatgtacttccaccggcgcgacctgcggctcgcggccaacgccatctgctccgccgtgcccagccactgggtgccgacctcccgcaccacctggagcatccacgccaagcacgagtggatgaccacggaggacatgctgaccgtctggaaccgggtgtggatccaggagaacccctggatggaggacaagacccccgtggagagctgggaggagatcccctacctggggaagcgcgaggaccagtggtgcggctccctcatcgggctgaccagccgcgcgacgtgggccaagaacatccagaccgccatcaaccaggtccggtccctgatcggcaacgaggagtacaccgactacatgccgagcatgaagcgcttccggcgcgaggaggaggaggccggggtgctctggtga

SEQ ID NO: 9032 - RNA, 9876 nt, synthetic construct
  misc_feature 1..9876: note = derived and/or modified CDS sequence (opt1) from DENV-2__KF704355__SS-prME
  source 1..9876: mol_type = other RNA
accgccgggatgatcatcatgctgatccccaccgtgatggccttccacctcaccacccggaacggggagccccacatgatcgtcagccggcaggagaagggcaagagcctgctgttcaagaccggggacggcgtgaacatgtgcaccctcatggcgatggacctgggggagctgtgcgaggacacgatcacctacaagtgccccttcctccggcagaacgagcccgaggacatcgactgctggtgcaacagcacctccacctgggtgacgtacgggacctgcaccaccacgggcgagcaccggcgcgagaagcggagcgtcgccctggtgccccacgtggggatgggcctggagacccgcaccgagacctggatgtccagcgagggggcctggaagcacgcccagcggatcgagacgtggatcctccgccacccgggcttcaccatcatggccgcgatcctggcctacaccatcgggaccacgcacttccagcgggccctgatcttcatcctcctgaccgccgtcgcgccctccatgaccatgcgctgcatcggcatcagcaaccgggacttcgtggagggcgtgtccgggggcagctgggtcgacatcgtgctggagcacgggtcctgcgtgaccacgatggccaagaacaagcccaccctcgacctggagctgatcaagaccgaggccaagcagcccgccaccctccgcaagtactgcatcgaggccaagctgacgaacaccaccaccgagagccggtgcccgacgcagggcgagccctccctgaacgaggagcaggacaagcgcttcgtctgcaagcacagcatggtggaccggggctgggggaacggctgcggcctcttcggcaaggggtccatcgtgacctgcgcgatgttcacgtgcaagaagatcatgaagggcaaggtcgtgcagcccgagaacctggagtacaccatcgtgatcacgccccacagcggcgaggagcacgccgtcgggaacgacaccggcaagtacgggaaggagatcaagatcaccccgcagtccagcatcaccgaggccgagctgaccggctacgggacggtgaccatggagtgcagcccccggaccggcctcgacttcaacgagatggtgctgctgcagatggaggacaaggcctggctcgtccaccggcagtggttcctggacctgcccctcccctggctgccgggcgccgacacccaggggagcaactggatccagaaggagacgctggtgaccttcaagaacccccacgcgaagaagcaggacgtggtcgtgctcggcagccaggagggggccatgcacaccgccctgaccggcgccacggagatccagatgtccagcgggaacgtcctgttcaccggccacctcaagtgccgcctgcggatggacaagctgcagctcaagggcatgtcctacagcatgtgcaccgggaagttcaaggtggtgaaggagatcgccgagacccagcacggcacgatcgtcatccgcgtgcagtacgagggggacggctccccctgcaagatccccttcgagatcatggacctggagaagcggcacgtgctgggccgcctcatcaccgtcaacccgatcgtgaccgggaaggacagccccgtgaacatcgaggcggagccgcccttcggcgactcctacatcatcatcggggtcgagccgggccagctgaagctgaactggttcaagaaggggagctccatcggccagatgttcggcaccacgatgcgcggggccaagcggatggccatcctcggcgacaccgcctgggacttcgggagcctgggcggggtgttcacctccatcggcaaggccctgcaccaggtgttcggcgcgatctacggggccgccttcagcggcgtctcctggaccatgaagatcctcacgggggtgatcatcacctggatcggcatgaacagccgctccaccagcctgtccgtgagcctggtcctggtgggggtggtcaccctctacctgggcgtgatggtgcaggccgactccggctgcgtcgtgagctggaagaacaaggagctgaagtgcgggagcggcatcttcatcacggacaacgtgcacacctggaccgagcagtacaagttccagcccgagtcccccagcaagctcgcgtccgccatccagaaggcccacgaggaggggatctgcggcatccggagcgtcacccgcctggagaacctgatgtggaagcagatcacgcccgagctcaaccacatcctgtccgagaacgaggtgaagctgaccatcatgaccggggacatcaagggcatcatgcaggccggcaagcggagcctccgcccgcagcccaccgagctgaagtactcctggaagacgtgggggaaggccaagatgctgagcaccgagtcccacaaccagaccttcctcatcgacggccccgagaccgcggagtgcccgaacacgaaccgggcctggaacagcctggaggtggaggactacgggttcggcgtcttcaccaccaacatctggctgaagctccgcgagaagcaggacgtgttctgcgactccaagctgatgagcgccgccatcaaggacaaccgggccgtgcacgcggacatgggctactggatcgagtccgccctgaacgacacctggaagatcgagaaggccagcttcatcgaggtcaagtcctgccactggcccaagagccacaccctctggtccaacggggtgctggagagcgagatgatcatccccaagaacttcgccggccccgtgagccagcacaactaccgcccggggtaccacacgcagaccgccggcccctggcacctggggaagctcgagatggacttcgacttctgcgagggcaccaccgtcgtggtgacggaggactgcggcaaccgggggccctccctgcgcaccaccaccgcgagcggcaagctgatcacggagtggtgctgccggtcctgcaccctcccgcccctgcgctaccgcggggaggacggctgctggtacgggatggagatccgccccctgaaggagaaggaggagaacctcgtcaacagcctggtgaccgccggccacggccagatcgacaacttctccctgggggtgctcggcatggccctgttcctggaggagatgctccggacccgcgtcgggacgaagcacgccatcctgctggtggcggtgagcttcgtcaccctcatcaccggcaacatgtccttccgggacctggggcgcgtgatggtgatggtcggcgccaccatgacggacgacatcggcatgggggtgacctacctggccctcctggccgccttcaaggtgcgccccaccttcgcggccggcctgctcctgcggaagctgaccagcaaggagctcatgatgacgaccatcgggatcgtcctgctgtcccagagcaccatccccgagaccatcctcgagctgacggacgccctggccctcggcatgatggtgctgaagatggtgcgcaagatggagaagtaccagctggccgtcaccatcatggcgatcctctgcgtgcccaacgccgtcatcctgcagaacgcctggaaggtgtcctgcaccatcctggccgtggtcagcgtgagccccctcttcctgaccagctcccagcagaaggccgactggatccccctggcgctcacgatcaagggcctgaaccccaccgccatcttcctgaccaccctcagccggacgaacaagaagcgctcctggccgctgaacgaggccatcatggccgtggggatggtcagcatcctggcgtccagcctcctgaagaacgacatccccatgaccggccccctggtggccgggggcctcctgaccgtgtgctacgtcctgaccgggcggagcgccgacctcgagctggagcgcgccgccgacgtgaagtgggaggaccaggcggagatctccggcagctcccccatcctgagcatcacgatctccgaggacggcagcatgtccatcaagaacgaggaggaggagcagaccctcaccatcctgatccggaccgggctgctcgtgatcagcggcctgttcccggtctccatccccatcaccgccgccgcctggtacctgtgggaggtgaagaagcagcgcgccggggtgctctgggacgtcccctccccgccgcccgtgggcaaggcggagctggaggacggggcctaccggatcaagcagaagggcatcctgggctactcccagatcggggccggcgtgtacaaggaggggacgttccacaccatgtggcacgtcacccgcggcgccgtgctcatgcacaaggggaagcggatcgagcccagctgggccgacgtgaagaaggacctgatctcctacggcggcgggtggaagctggagggcgagtggaaggagggggaggaggtccaggtgctcgcgctggagcccggcaagaacccccgcgccgtgcagaccaagcccgggctgttcaagacgaacgccggcaccatcggcgccgtcagcctcgacttctcccccgggaccagcggctcccccatcatcgaccggaaggggaaggtggtgggcctgtacggcaacggggtcgtgacccgcagcggcgcctacgtgtccgcgatcgcccagacggagaagtccatcgaggacaaccccgagatcgaggacgacatcttccggaagcgcaagctgaccatcatggacctccaccccggggccggcaagaccaagcggtacctgcccgccatcgtccgcgaggcgatcaagcgggggctgcgcaccctgatcctcgccccgacgcgggtggtggccgccgagatggaggaggccctgcgcggcctgcccatccgctaccagacccccgcgatccgggccgagcacaccggccgcgagatcgtcgacctcatgtgccacgccaccttcacgatgcggctgctgagccccgtgcgcgtgccgaactacaacctcatcatcatggacgaggcccacttcaccgaccccgcctccatcgcggcccgggggtacatcagcacccgcgtcgagatgggcgaggccgccgggatcttcatgaccgccacgccgcccggctcccgggacccgttcccccagagcaacgcgcccatcatggacgaggagcgcgagatccccgagcggtcctggagctccgggcacgagtgggtgaccgacttcaagggcaagaccgtgtggttcgtcccgagcatccgcgccggcaacgacatcgccgcctgcctgcggaagaacgggaagaaggtgatccagctgtcccgcaagaccttcgacagcgagtacgtgaagacgcggaccaacgactgggacttcgtcgtgaccaccgacatctccgagatgggcgcgaacttcaaggccgagcgcgtgatcgacccccggcgctgcatgaagcccgtcatcctcacggacggggaggagcgggtgatcctggccggccccatgccggtgacccacagctccgccgcccagcgccgggggcgcatcggccgcaaccccaagaacgagaacgaccagtacatctacatgggcgagcccctggagaacgacgaggactgcgcgcactggaaggaggccaagatgctcctggacaacatcaacacccccgaggggatcatcccgagcatgttcgagcccgagcgggagaaggtcgacgccatcgacggcgagtaccgcctgcgcggggaggcccgcaagaccttcgtggacctcatgcggcgcggcgacctgcccgtgtggctggcctaccgggtcgcggccgaggggatcaactacgccgaccgccggtggtgcttcgacggcatcaagaacaaccagatcctcgaggagaacgtggaggtcgagatctggacgaaggagggcgagcgcaagaagctgaagccgcggtggctggacgcccgcatctactccgaccccctcgccctgaaggagttcaaggagttcgcggccgggcgcaagagcctgaccctcaacctgatcaccgagatgggccgcctgcccaccttcatgacgcagaaggcccgggacgccctcgacaacctggcggtgctgcacaccgccgaggccgggggccgcgcctacaaccacgccctctccgagctgcccgagaccctggagaccctcctgctgctcacgctgctggcgaccgtgaccggcgggatcttcctcttcctgatgagcggccgggggatcggcaagatgaccctggggatgtgctgcatcatcaccgcctccatcctcctgtggtacgcccagatccagccgcactggatcgccgccagcatcatcctggagttcttcctcatcgtcctgctgatccccgagcccgagaagcagcgcacgccccaggacaaccagctcacctacgtggtgatcgcgatcctgaccgtcgtggccgccaccatggccaacgagatgggcttcctggagaagacgaagaaggacctcggcctggggagcatcaccacccagcagccggagtccaacatcctggacatcgacctccggcccgccagcgcgtggaccctgtacgccgtggccacgaccttcgtcacccccatgctgcgccactccatcgagaacagctccgtgaacgtgagcctcaccgccatcgccaaccaggcgacggtcctgatgggcctggggaagggctggcccctctccaagatggacatcggggtgccgctgctggccatcggctgctacagccaggtgaaccccatcaccctcaccgccgccctgttcctgctcgtcgcgcactacgccatcatcggccccgggctgcaggccaaggccacccgggaggcccagaagcgcgcggccgccggcatcatgaagaaccccacggtggacgggatcaccgtgatcgacctggacccgatcccctacgaccccaagttcgagaagcagctcggccaggtcatgctgctggtgctctgcgtgacccaggtcctgatgatgcgcaccacgtgggccctgtgcgaggccctcaccctggcgaccgggcccatctccaccctgtgggagggcaacccgggccggttctggaacacgaccatcgccgtgagcatggccaacatcttccgcgggtcctacctcgccggcgccgggctgctgttcagcatcatgaagaacaccaccaacacgcggcgcggcaccggcaacatcggggagaccctcggcgagaagtggaagtcccggctgaacgcgctgggcaagagcgagttccagatctacaagaagtccggcatccaggaggtggaccgcaccctcgccaaggaggggatcaagcggggcgagacggaccaccacgccgtcagccgcggctccgccaagctgcggtggttcgtggagcgcaacatggtgacccccgaggggaaggtcgtggacctgggctgcgggcggggcgggtggagctactactgcggcggcctcaagaacgtgcgcgaggtcaaggggctgaccaagggcgggcccggccacgaggagcccatcccgatgtccacctacgggtggaacctggtgcggctccagagcggcgtggacgtcttcttcacgccgcccgagaagtgcgacaccctgctgtgcgacatcggcgagagctcccccaacccgaccgtggaggcggggcgcaccctccgggtgctgaacctggtcgagaactggctcaacaacaacacccagttctgcatcaaggtgctgaacccctacatgcccagcgtgatcgagaagatggaggccctgcagcgcaagtacggcggggccctcgtccggaacccgctgtcccgcaacagcacgcacgagatgtactgggtgtccaacgccagcggcaacatcgtgtccagcgtcaacatgatctcccggatgctgatcaaccgcttcaccatgcgccacaagaaggccacctacgagcccgacgtggacctggggagcggcacccggaacatcggcatcgagtccgagatccccaacctcgacatcatcgggaagcgcatcgagaagatcaagcaggagtacgagacgagctggcactacgaccaggaccacccctacaagacctgggcgtaccacggctcctacgagaccaagcagaccgggagcgcctccagcatggtgaacggcgtcgtgcggctgctgacgaagccgtgggacgtggtccccatggtgacccagatggccatgaccgacaccacgcccttcggccagcagcgcgtgttcaaggagaaggtcgacacccggacccaggagcccaaggaggggaccaagaagctcatgaagatcacggccgagtggctgtggaaggagctgggcaagaagaagaccccgcgcatgtgcacccgggaggagttcacccgcaaggtgcggtccaacgccgcgctcggggccatcttcacggacgagaacaagtggaagtccgcccgcgaggccgtcgaggactcccggttctgggagctggtggacaaggagcgcaacctgcacctcgagggcaagtgcgagacctgcgtgtacaacatgatggggaagcgggagaagaagctgggcgagttcggcaaggccaaggggagccgcgcgatctggtacatgtggctgggcgcccggttcctcgagttcgaggccctggggttcctgaacgaggaccactggttcagccgcgagaactccctcagcggcgtcgagggggagggcctgcacaagctgggctacatcctccgggacgtgtccaagaaggagggcggggccatgtacgcggacgacaccgccgggtgggacacccgcatcacgctggaggacctgaagaacgaggagatggtgaccaaccacatggagggcgagcacaagaagctcgccgaggccatcttcaagctgacctaccagaacaaggtcgtgcgggtgcagcgccccacgccccgggggaccgtcatggacatcatcagccgccgcgaccagcggggctccggccaggtggggacctacggcctgaacaccttcaccaacatggaggcccagctcatccgccagatggagggggagggcgtgttcaagaacatccagcacctgacggtcaccgaggagatcgcggtgcagaactggctggcccgggtgggccgcgagcggctcagccgcatggccatctccggggacgactgcgtcgtgaagcccctggacgaccggttcgccagcgccctgaccgcgctcaacgacatgggcaaggtgcgcaaggacatccagcagtgggagccgtcccgggggtggaacgactggacccaggtccccttctgcagccaccacttccacgagctgatcatgaaggacggccgcgtgctggtggtcccctgccggaaccaggacgagctcatcgggcgcgcccggatctcccagggcgccggctggagcctgcgcgagacggcctgcctggggaagtcctacgcccagatgtggagcctcatgtacttccaccggcgcgacctgcggctggcggccaacgccatctgctccgccgtgcccagccactgggtgccgacctcccgcaccacctggagcatccacgccaagcacgagtggatgaccacggaggacatgctcaccgtctggaaccgggtgtggatccaggagaacccctggatggaggacaagacccccgtggagagctgggaggagatcccctacctgggcaagcgcgaggaccagtggtgcgggtccctgatcggcctcaccagccgcgcgacgtgggccaagaacatccagaccgccatcaaccaggtccggtccctgatcgggaacgaggagtacaccgactacatgccgagcatgaagcgcttccggcgcgaggaggaggaggccggcgtgctgtggtga

SEQ ID NO: 9033 - RNA, 9876 nt, synthetic construct
  misc_feature 1..9876: note = derived and/or modified CDS sequence (opt1) from DENV-2__KF704354__SS-prME
  source 1..9876: mol_type = other RNA
accgccgggatgatcatcatgctgatccccaccgtgatggccttccacctcaccacccgcaacggggagccccacatgatcgtcagccggcaggagaagggcaagagcctgctgttcaagaccgaggacggggtgaacatgtgcaccctcatggcgatggacctgggcgagctgtgcgaggacaccatcacctacaagtgccccttcctccgccagaacgagcccgaggacatcgactgctggtgcaacagcacctccacctgggtgacgtacgggacctgcaccaccacgggcgagcaccggcgcgagaagcggagcgtcgccctggtgccccacgtgggcatggggctggagacccgcaccgagacctggatgtccagcgagggcgcctggaagcacgcccagcggatcgagacgtggatcctccgccaccccgggttcaccatcatggccgcgatcctggcctacaccatcggcaccacgcacttccagcgggccctgatcttcatcctcctgaccgccgtcgcgccctccatgaccatgcgctgcatcgggatcagcaaccgggacttcgtggagggcgtgtccggcgggagctgggtcgacatcgtgctggagcacggctcctgcgtgaccacgatggccaagaacaagcccaccctcgacttcgagctgatcaagaccgaggccaagcagcccgccaccctgcgcaagtactgcatcgaggccaagctcacgaacaccaccaccgagagccggtgcccgacgcagggggagccctccctgaacgaggagcaggacaagcgcttcgtctgcaagcacagcatggtggaccggggctggggcaacgggtgcggcctgttcgggaagggcgggatcgtgacctgcgcgatgttcacgtgcaagaagatcatgaagggcaaggtcgtgcagcccgagaacctcgagtacaccatcgtgatcacgccccactccggcgaggagcacgccgtcgggaacgacaccggcaagcacgggaaggagatcaagatcaccccgcagagctccatcaccgaggccgagctgaccggctacgggacggtgaccatggagtgcagcccccgcaccggcctggacttcaacgagatggtgctcctgcagatggagaacaaggcctggctggtccaccggcagtggttcctcgacctgcccctgccctggctcccgggcgccgacacccaggggtccaactggatccagaaggagacgctggtgaccttcaagaacccccacgcgaagaagcaggacgtggtcgtgctgggcagccaggagggggccatgcacaccgccctcaccggcgccacggagatccagatgagctccgggaacgtcctgttcaccggccacctgaagtgccgcctccggatggacaagctgcagctgaagggcatgagctactccatgtgcaccgggaagttcaaggtggtgaaggagatcgccgagacccagcacggcacgatcgtcatccgcgtgcagtacgagggggacggcagcccctgcaagatccccttcgagatcatggacctcgagaagcggcacgtgctgggccgcctgatcaccgtcaacccgatcgtgaccgggaaggactcccccgtgaacatcgaggcggagccgcccttcggcgacagctacatcatcatcggggtcgagccgggccagctcaagctgaactggttcaagaaggggtccagcatcggccagatgttcgccaccacgatgcgcggcgccaagcggatggccatcctgggggacaccgcctgggacttcggctccctcgggggcgtgttcaccagcatcgggaaggcgctgcaccaggtgttcggcgccatctacggcgccgccttctccggggtcagctggaccatgaagatcctgatcggcgtgatcatcacgtggatcgggatgaactcccgcagcacctccctcagcgtgtccctggtcctggtgggcgtggtcaccctgtacctcggggtgatggtgcaggcggacagcggctgcgtcgtgtcctggaagaacaaggagctgaagtgcggcagcgggatcttcatcaccgacaacgtgcacacgtggaccgagcagtacaagttccagcccgagagcccctccaagctggccagcgccatccagaaggcccacgaggagggcatctgcgggatccggtccgtcacccgcctcgagaacctgatgtggaagcagatcacccccgagctgaaccacatcctcagcgagaacgaggtgaagctgacgatcatgaccggcgacatcaaggggatcatgcaggccggcaagcggtccctgcgcccgcagcccaccgagctcaagtacagctggaagacctggggcaaggcgaagatgctgtccacggagagccacaaccagaccttcctgatcgacgggcccgagaccgccgagtgcccgaacaccaaccgggcctggaactccctcgaggtggaggactacggcttcggggtcttcacgaccaacatctggctgaagctgcgcgaggagcaggacgtgttctgcgacagcaagctcatgtccgccgccatcaaggacaaccgggcggtgcacgccgacatgggctactggatcgagagcgccctgaacgacacctggaagatcgagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagacggcggggccctggcacctgggcaagctggagatggacttcgacttctgcgaggggaccaccgtcgtggtgaccgaggactgcggcaaccggggccccagcctccgcacgaccaccgcctccgggaagctgatcaccgagtggtgctgccggagctgcacgctgcccccgctccgctaccggggcgaggacgggtgctggtacggcatggagatccgccccctgaaggagaaggaggagaacctggtcaactccctcgtgaccgccgggcacggccagatcgacaacttcagcctgggcgtgctggggatggccctcttcctggaggagatgctgcggacccgcgtcggcaccaagcacgcgatcctcctggtggccgtgtccttcgtcacgctgatcaccgggaacatgagcttccgggacctcggccgcgtgatggtgatggtcggggccaccatgaccgacgacatcggcatgggcgtgacgtacctggccctgctcgccgcgttcaaggtgcgccccaccttcgccgccgggctgctgctccggaagctgacctccaaggagctgatgatgaccacgatcggcatcgtcctcctgagccagtccaccatccccgagaccatcctggagctcaccgacgccctggccctggggatgatggtgctcaagatggtgcgcaagatggagaagtaccagctggcggtcacgatcatggccatcctgtgcgtgccgaacgccgtcatcctccagaacacctggaaggtgagctgcaccatcctggccgtggtctccgtgagccccctgttcctcacctccagccagcagaaggccgactggatccccctggcgctgacgatcaagggcctcaaccccaccgccatcttcctgaccaccctgtcccggacgaacaagaagcgcagctggccgctcaacgaggccatcatggccgtgggcatggtctccatcctggcgagctccctgctcaagaacgacatccccatgaccgggcccctggtggccggcgggctgctcaccgtgtgctacgtcctgaccggccggagcgccgacctggagctcgagcgcgccgccgacgtgaagtgggaggaccaggcggagatcagcgggtccagccccatcctgtccatcacgatcagcgaggacggctccatgagcatcaagaacgaggaggaggagcagaccctgaccatcctcatccggaccggcctgctggtgatctccggcctgttcccggtcagcatccccatcaccgccgccgcctggtacctgtgggaggtgaagaagcagcgcgccggcgtgctgtgggacgtccccagcccgccgcccgtggggaaggcggagctcgaggacggcgcctaccggatcaagcagaaggggatcctgggctacagccagatcggcgccggggtgtacaaggagggcacgttccacaccatgtggcacgtcacccgcggggccgtgctgatgcacaagggcaagcggatcgagccctcctgggccgacgtgaagaaggacctcatcagctacgggggcggctggcgcctggagggggagtggaaggagggcgaggaggtccaggtgctggcgctcgagcccgggaagaacccccgggccgtgcagaccaagcccggcctgttcaagacgaacgccgggaccatcggcgccgtctccctggacttcagccccggcacctccgggagccccatcatcgacaagaagggcaaggtggtggggctctacggcaacggcgtcgtgacccgctccggggcctacgtgagcgcgatcgcccagacggagaagtccatcgaggacaaccccgagatcgaggacgacatcttccggaagcgcaagctgaccatcatggacctgcaccccggcgccgggaagaccaagcggtacctccccgccatcgtccgcgaggcgatcaagcggggcctgcgcaccctgatcctggccccgacgcgggtggtggccgccgagatggaggaggccctccgcgggctgcccatccgctaccagacccccgcgatccgggccgagcacaccggccgcgagatcgtcgacctgatgtgccacgccaccttcacgatgcggctcctgagccccgtgcgcgtgccgaactacaacctgatcatcatggacgaggcccacttcaccgaccccgccagcatcgcggcccggggctacatctccacccgcgtcgagatgggggaggccgccggcatcttcatgaccgccacgccgcccgggagccgggacccgttcccccagtccaacgcgcccatcatggacgaggagcgcgagatccccgagcggagctggtccagcggccacgagtgggtgaccgacttcaaggggaagaccgtgtggttcgtcccgtccatcaaggccggcaacgacatcgccgcctgcctccgcaagaacggcaagaaggtgatccagctgagccggaagaccttcgactccgagtacgtgaagacgcgcaccaacgactgggacttcgtcgtgaccaccgacatcagcgagatgggggcgaacttcaaggccgagcgggtgatcgacccccgccggtgcatgaagcccgtcatcctgacggacggcgaggagcgcgtgatcctcgccgggcccatgccggtgacccactccagcgccgcccagcggcgcggccggatcgggcgcaaccccaagaacgagaacgaccagtacatctacatgggcgagcccctggagaacgacgaggactgcgcgcactggaaggaggccaagatgctgctcgacaacatcaacacccccgagggcatcatcccgtccatgttcgagcccgagcgcgagaaggtcgacgccatcgacggggagtaccggctgcgcggcgaggcccggaagaccttcgtggacctgatgcgccgcggggacctccccgtgtggctggcctaccgcgtcgcggccgagggcatcaactacgccgaccggcgctggtgcttcgacgggatcaagaacaaccagatcctggaggagaacgtggaggtcgagatctggacgaaggagggcgagcggaagaagctcaagccgcgctggctggacgcccggatctacagcgaccccctggccctcaaggagttcaaggagttcgcggccggccgcaagtccctgaccctgaacctcatcaccgagatggggcggctgcccaccttcatgacgcagaaggcccgcgacgccctggacaacctcgcggtgctgcacaccgccgaggccggcgggcgggcctacaaccacgccctgagcgagctccccgagaccctggagaccctgctcctgctgacgctcctggcgaccgtgaccggcggcatcttcctgttcctcatgtccgggcgcggcatcgggaagatgaccctgggcatgtgctgcatcatcaccgccagcatcctgctctggtacgcccagatccagccgcactggatcgccgcctccatcatcctggagttcttcctgatcgtcctcctgatccccgagcccgagaagcagcggacgccccaggacaaccagctgacctacgtggtgatcgcgatcctcaccgtcgtggccgccaccatggccaacgagatggggttcctggagaagacgaagaaggacctgggctggggcagcatcaccacccagcagccggagagcaacatcctcgacatcgacctgcgccccgcctccgcgtggaccctgtacgccgtggccacgaccttcgtcacccccatgctccggcacagcatcgagaactccagcgtgaacgtgtccctgaccgccatcgccaaccaggcgacggtcctgatggggctcggcaaggggtggcccctgagcaagatggacatcggcgtgccgctgctcgccatcgggtgctactcccaggtgaaccccatcaccctgaccgccgccctgttcctcctggtcgcgcactacgccatcatcggccccggcctgcaggccaaggccacccgcgaggcccagaagcgggcggccgccgggatcatgaagaaccccacggtggacggcatcaccgtgatcgacctcgacccgatcccctacgaccccaagttcgagaagcagctggggcaggtcatgctgctcgtgctgtgcgtgacccaggtcctgatgatgcgcaccacgtgggccctctgcgaggccctgaccctggcgaccggccccatcagcaccctctgggaggggaacccgggccgcttctggaacacgaccatcgccgtgtccatggccaacatcttccggggcagctacctggccggggccggcctcctcttctccatcatgaagaacaccaccaacacgcgccgggggaccggcaacatgggcgagaccctgggggagaagtggaagtcccgcctgaacgcgctcggcaagtccgagttccagatctacaagaagtccgggatccaggaggtggaccggaccctggccaaggagggcatcaagcgcggggagacggaccaccacgccgtctcccggggcagcgccaagctgcgctggttcgtggagcggaacatggtgacccccgagggcaaggtcgtggacctcgggtgcggccgcgggggctggtcctactactgcgggggcctgaagaacgtgcgggaggtcaagggcctgaccaagggcgggcccgggcacgaggagcccatcccgatgagcacctacggctggaacctcgtgcgcctgcagtccggggtggacgtcttcttcacgccgcccgagaagtgcgacaccctgctctgcgacatcggcgagagcagccccaacccgaccgtggaggcgggccggaccctgcgcgtgctgaacctcgtcgagaactggctgaacaacaacacccagttctgcatcaaggtgctgaacccctacatgccctccgtgatcgagaagatggaggccctccagcggaagtacgggggcgccctggtccgcaacccgctgagccggaactccacgcacgagatgtactgggtgagcaacgcctccgggaacatcgtgagctccgtcaacatgatcagccgcatgctcatcaaccggttcaccatgcgccacaagaaggccaccttcgagcccgacgtggacctgggctccgggacccgcaacatcggcatcgagagcgagatccccaacctggacatcatcggcaagcggatcgagaagatcaagcaggagtacgagacgtcctggcactacgaccaggaccacccctacaagacctgggcgtaccacgggagctacgagaccaagcagaccggctccgccagctccatggtgaacggggtcgtgcgcctgctcacgaagccgtgggacgtggtccccatggtgacccagatggccatgaccgacaccacgcccttcggccagcagcgggtgttcaaggagaaggtcgacacccgcacccaggagcccaaggagggcaccaagaagctgatgaagatcacggccgagtggctgtggaaggagctcgggaagaagaagaccccgcggatgtgcacccgcgaggagttcacccggaaggtgcgcagcaacgccgcgctgggcgccatcttcacggacgagaacaagtggaagtccgcccgggaggccgtcgaggacagccgcttctgggagctggtggacaaggagcggaacctccacctggaggggaagtgcgagacctgcgtgtacaacatgatgggcaagcgcgagaagaagctgggggagttcggcaaggccaagggctcccgggcgatctggtacatgtggctcggggcccgcttcctggagttcgaggccctgggcttcctcaacgaggaccactggttcagccgggagaacagcctgtccggggtcgagggcgaggggctgcacaagctcggctacatcctgcgcgacgtgagcaagaaggagggcggggccatgtacgcggacgacaccgccggctgggacacccggatcacgctggaggacctcaagaacgaggagatggtgaccaaccacatggagggggagcacaagaagctggccgaggccatcttcaagctgacctaccagaacaaggtcgtgcgcgtgcagcggcccacgccccggggcacggtcatggacatcatctcccggcgcgaccagcgcgggagcggccaggtgggcacctacgggctcaacaccttcaccaacatggaggcccagctgatccggcagatggagggcgagggggtgttcaagaacatccagcacctgacggtcaccgaggagatcgcggtgcagaactggctcgcccgcgtgggccgggagcgcctgtcccggatggccatcagcggcgacgactgcgtcgtgaagcccctggacgaccgcttcgcctccgccctcaccgcgctgaacgacatggggaaggtgcggaaggacatccagcagtgggagccgagccgcggctggaacgactggacccaggtccccttctgctcccaccacttccacgagctgatcatgaaggacgggcgggtgctcgtggtcccctgccgcaaccaggacgagctgatcggccgggcccgcatcagccagggggccggctggtccctgcgggagacggcctgcctcggcaagagctacgcccagatgtggtccctgatgtacttccaccgccgggacctgcgcctcgcggccaacgccatctgcagcgccgtgccctcccactgggtgccgaccagccggaccacctggtccatccacgccaagcacgagtggatgaccacggaggacatgctgaccgtctggaaccgcgtgtggatccaggagaacccctggatggaggacaagacccccgtggagagctgggaggagatcccctacctggggaagcgggaggaccagtggtgcggcagcctcatcgggctgacctcccgcgcgacgtgggccaagaacatccagaccgccatcaaccaggtccgcagcctgatcggcaacgaggagtacaccgactacatgccgtccatgaagcggttccgccgggaggaggaggaggccggggtgctctggtga

SEQ ID NO: 9034 - RNA, 9876 nt, synthetic construct
  misc_feature 1..9876: note = derived and/or modified CDS sequence (opt1) from DENV-2__KF704357__SS-prME
  source 1..9876: mol_type = other RNA
accgccggcatgatcatcatgctgatccccaccgtgatggccttccacctcaccacccggaacggggagccccacatgatcgtcagccggcaggagaagggcaagagcctgctgttcaagaccggggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacgtacgggacctgcaccaccacgggcgagcaccggcgcgagaagcggagcgtcgccctggtgccccacgtggggatgggcctcgagacccgcaccgagacctggatgtccagcgagggggcctggaagcacgcccagcggatcgagacgtggatcctgcgccaccccggcttcaccatcatggccgcgatcctggcctacaccatcgggaccacgcacttccagcgggccctcatcttcatcctgctgaccgccgtcgcgccctccatgaccatgcgctgcatcggcatcagcaaccgggacttcgtggagggcgtgtccgggggcagctgggtcgacatcgtgctcgagcacgggtcctgcgtgaccacgatggccaagaacaagcccaccctggacctggagctcatcaagaccgaggccaagcagcccgccaccctgcgcaagtactgcatcgaggccaagctgacgaacaccaccaccgagagccggtgcccgacgcagggcgagccctccctcaacgaggagcaggacaagcgcttcgtctgcaagcacagcatggtggaccggggctgggggaacggctgcgggctgttcggcaaggggtccatcgtgacctgcgcgatgttcacgtgcaagaagatcatgaagggcaaggtcgtgcagcccgagaacctggagtacaccatcgtgatcacgccccacagcggcgaggagcacgccgtcgggaacgacaccggcaagcacgggaaggagatcaagatcaccccgcagtccagcatcaccgaggccgagctcaccggctacgggacggtgaccatggagtgcagcccccggaccggcctggacttcaacgagatggtgctgctccagatggaggacaaggcctggctggtccaccggcagtggttcctggacctccccctgccctggctgccgggcgccgacacccaggggagcaactggatccagaaggagacgctcgtgaccttcaagaacccccacgcgaagaagcaggacgtggtcgtgctgggcagccaggagggggccatgcacaccgccctgaccggcgccacggagatccagatgtccagcgggaacgtcctcttcaccggccacctgaagtgccgcctgcggatggacaagctccagctgaagggcatgtcctacagcatgtgcaccgggaagttcaaggtggtgaaggagatcgccgagacccagcacggcacgatcgtcatccgcgtgcagtacgagggggacggctccccctgcaagatccccttcgagatcatggacctggagaagcggcacgtgctcggccgcctgatcaccgtcaacccgatcgtgaccgggaaggacagccccgtgaacatcgaggcggagccgcccttcggcgactcctacatcatcatcggggtcgagccgggccagctgaagctcaactggttcaagaaggggagctccatcggccagatgttcgccaccacgatgcgcggcgccaagcggatggccatcctgggggacaccgcctgggacttcggcagcctcgggggcgtgttcacctccatcgggaaggcgctccaccaggtgttcggcgccatctacggcgccgccttcagcggggtctcctggaccatgaagatcctgatcggcgtgatcatcacgtggatcgggatgaacagccgctccaccagcctgtccgtgagcctggtcctcgtgggcgtggtcaccctgtacctgggggtgatggtgcaggcggactccggctgcgtcgtgagctggaagaacaaggagctcaagtgcggcagcgggatcttcatcaccgacaacgtgcacacgtggaccgagcagtacaagttccagcccgagtcccccagcaagctggcctccgccatccagaaggcccacgaggagggcatctgcgggatccggagcgtcacccgcctggagaacctcatgtggaagcagatcacccccgagctgaaccacatcctgtccgagaacgaggtgaagctcacgatcatgaccggcgacatcaaggggatcatgcaggccggcaagcggagcctgcgcccgcagcccaccgagctgaagtactcctggaagacctggggcaaggcgaagatgctcagcacggagtcccacaaccagaccttcctgatcgacgggcccgagaccgccgagtgcccgaacaccaaccgggcctggaacagcctggaggtggaggactacggcttcggggtcttcacgaccaacatctggctcaagctgcgcgaggagcaggacgtgttctgcgactccaagctgatgagcgccgccatcaaggacaaccgggcggtgcacgccgacatgggctactggatcgagtccgccctcaacgacacctggaagatcgagaaggccagcttcatcgaggtcaagtcctgccactggcccaagagccacaccctgtggtccaacggcgtgctggagagcgagatgatcatccccaagaacttcgccgggcccgtgagccagcacaactaccgcccgggctaccacacccagacggcggggccctggcacctcggcaagctggagatggacttcgacttctgcgaggggaccaccgtcgtggtgaccgaggactgcggcaaccggggcccctccctgcgcacgaccaccgccagcgggaagctcatcaccgagtggtgctgccggtcctgcacgctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcgtcggcaccaagcacgcgatcctgctcgtggccgtgagcttcgtcacgctgatcaccgggaacatgtccttccgggacctgggccgcgtgatggtgatggtcggggccaccatgaccgacgacatcggcatgggcgtgacgtacctcgccctgctggccgcgttcaaggtgcgccccaccttcgccgccgggctcctgctgcggaagctcaccagcaaggagctgatgatgaccacgatcggcatcgtcctgctctcccagagcaccatccccgagaccatcctggagctgaccgacgccctcgccctggggatgatggtgctgaagatggtgcgcaagatggagaagtaccagctcgcggtcacgatcatggccatcctgtgcgtgccgaacgccgtcatcctgcagaacacctggaaggtgtcctgcaccatcctcgccgtggtcagcgtgagccccctgttcctgaccagctcccagcagaaggccgactggatccccctcgcgctgacgatcaagggcctgaaccccaccgccatcttcctcaccaccctgagccggacgaacaagaagcgctcctggccgctgaacgaggccatcatggccgtgggcatggtcagcatcctcgcgtccagcctgctgaagaacgacatccccatgaccgggcccctcgtggccggcgggctgctgaccgtgtgctacgtcctcaccggccggagcgccgacctggagctggagcgcgccgccgacgtgaagtgggaggaccaggcggagatctccgggagctcccccatcctcagcatcacgatctccgaggacggcagcatgtccatcaagaacgaggaggaggagcagaccctgaccatcctgatccggaccggcctcctggtgatcagcgggctgttcccggtctccatccccatcaccgccgccgcctggtacctctgggaggtgaagaagcagcgcgccggcgtgctgtgggacgtcccctccccgccgcccgtggggaaggcggagctggaggacggcgcctaccggatcaagcagaaggggatcctcggctactcccagatcggcgccggggtgtacaaggagggcacgttccacaccatgtggcacgtcacccgcggggccgtgctgatgcacaagggcaagcggatcgagcccagctgggccgacgtgaagaaggacctgatctcctacgggggcggctggaagctcgagggggagtggaaggagggcgaggaggtccaggtgctggcgctggagcccgggaagaacccccgcgccgtgcagaccaagcccggcctcttcaagacgaacgccgggaccatcggcgccgtcagcctggacttctcccccggcaccagcgggtcccccatcatcgaccggaagggcaaggtggtggggctgtacggcaacggcgtcgtgacccgcagcggggcctacgtgtccgcgatcgcccagacggagaagtccatcgaggacaaccccgagatcgaggacgacatcttccggaagcgcaagctcaccatcatggacctgcaccccggcgccgggaagaccaagcggtacctgcccgccatcgtccgcgaggcgatcaagcggggcctgcgcaccctcatcctggccccgacgcgggtggtggccgccgagatggaggaggccctgcgcgggctccccatccgctaccagacccccgcgatccgggccgagcacaccggccgcgagatcgtcgacctgatgtgccacgccaccttcacgatgcggctgctcagccccgtgcgcgtgccgaactacaacctgatcatcatggacgaggcccacttcaccgaccccgcctccatcgcggcccggggctacatcagcacccgcgtcgagatgggggaggccgccggcatcttcatgaccgccacgccgcccgggtcccgggacccgttcccccagagcaacgcgcccatcatggacgaggagcgcgagatccccgagcggtcctggagctccggccacgagtgggtgaccgacttcaaggggaagaccgtgtggttcgtcccgagcatccgcgccggcaacgacatcgccgcctgcctgcggaagaacggcaagaaggtgatccagctctcccgcaagaccttcgacagcgagtacgtgaagacgcggaccaacgactgggacttcgtcgtgaccaccgacatctccgagatgggggcgaacttcaaggccgagcgcgtgatcgacccccggcgctgcatgaagcccgtcatcctgacggacggcgaggagcgggtgatcctggccgggcccatgccggtgacccacagctccgccgcccagcgccggggccgcatcgggcgcaaccccaagaacgagaacgaccagtacatctacatgggcgagcccctcgagaacgacgaggactgcgcgcactggaaggaggccaagatgctgctggacaacatcaacacccccgagggcatcatcccgagcatgttcgagcccgagcgggagaaggtcgacgccatcgacggggagtaccgcctccggggcgaggcccgcaagaccttcgtggacctgatgcggcgcggggacctgcccgtgtggctcgcctaccgggtcgcggccgagggcatcaactacgccgaccgccggtggtgcttcgacgggatcaagaacaaccagatcctggaggagaacgtggaggtcgagatctggacgaaggagggcgagcgcaagaagctgaagccgcggtggctcgacgcccgcatctactccgaccccctggccctgaaggagttcaaggagttcgcggccggccgcaagagcctcaccctgaacctgatcaccgagatggggcgcctccccaccttcatgacgcagaaggcccgggacgccctggacaacctggcggtgctccacaccgccgaggccggcgggcgcgcctacaaccacgccctgtccgagctgcccgagaccctcgagaccctgctgctcctgacgctgctcgcgaccgtgaccggcggcatcttcctgttcctgatgagcgggcggggcatcgggaagatgaccctcggcatgtgctgcatcatcaccgcctccatcctgctgtggtacgcccagatccagccgcactggatcgccgccagcatcatcctcgagttcttcctgatcgtcctgctcatccccgagcccgagaagcagcgcacgccccaggacaaccagctgacctacgtggtgatcgcgatcctgaccgtcgtggccgccaccatggccaacgagatggggttcctcgagaagacgaagaaggacctgggcctgggcagcatcaccacccagcagccggagtccaacatcctcgacatcgacctgcggcccgccagcgcgtggaccctgtacgccgtggccacgaccttcgtcacccccatgctccgccactccatcgagaacagctccgtgaacgtgagcctgaccgccatcgccaaccaggcgacggtcctgatggggctcggcaaggggtggcccctgtccaagatggacatcggcgtgccgctgctcgccatcgggtgctacagccaggtgaaccccatcaccctgaccgccgccctgttcctcctggtcgcgcactacgccatcatcggccccggcctgcaggccaaggccacccgggaggcccagaagcgcgcggccgccgggatcatgaagaaccccacggtggacggcatcaccgtgatcgacctcgacccgatcccctacgaccccaagttcgagaagcagctggggcaggtcatgctgctcgtgctgtgcgtgacccaggtcctgatgatgcgcaccacgtgggccctctgcgaggccctgaccctggcgaccggccccatctccaccctctgggaggggaacccgggccggttctggaacacgaccatcgccgtgagcatggccaacatcttccgcggctcctacctggccggggccggcctgctgttcagcatcatgaagaacaccaccaacacgcggcgcgggaccggcaacatgggcgagaccctgggggagaagtggaagtcccggctgaacgcgctcggcaagagcgagttccagatctacaagaagtccgggatccaggaggtggaccgcaccctggccaaggagggcatcaagcgcggggagacggaccaccacgccgtcagccgcggctccgccaagctgcggtggttcgtggagcgcaacatggtgacccccgagggcaaggtcgtggacctcgggtgcggccgcgggggctggagctactactgcgggggcctgaagaacgtgcgcgaggtcaagggcctgaccaagggcggccccgggcacgaggagcccatcccgatgtccacctacggctggaacctcgtgcggctgcagagcggggtggacgtcttcttcacgccgcccgagaagtgcgacaccctgctctgcgacatcggcgagagctcccccaacccgaccgtggaggcgggccgcaccctgcgggtgctgaacctcgtcgagaactggctgaacaacaacacccagttctgcatcaaggtgctgaacccctacatgcccagcgtgatcgagaagatggaggccctccagcgcaagtacgggggcgccctggtccggaacccgctgtcccgcaacagcacgcacgagatgtactgggtgtccaacgccagcgggaacatcgtgtccagcgtcaacatgatctcccggatgctgatcaaccgcttcaccatgcgccacaagaaggccaccttcgagcccgacgtggacctcggcagcgggacccggaacatcggcatcgagtccgagatccccaacctggacatcatcggcaagcgcatcgagaagatcaagcaggagtacgagacgagctggcactacgaccaggaccacccctacaagacctgggcgtaccacgggtcctacgagaccaagcagaccggcagcgcctccagcatggtgaacggggtcgtgcggctgctcacgaagccgtgggacgtggtccccatggtgacccagatggccatgaccgacaccacgcccttcggccagcagcgcgtgttcaaggagaaggtcgacacccggacccaggagcccaaggagggcaccaagaagctgatgaagatcacggccgagtggctgtggaaggagctcgggaagaagaagaccccgcgcatgtgcacccgggaggagttcacccgcaaggtgcggtccaacgccgcgctgggcgccatcttcacggacgagaacaagtggaagtccgcccgcgaggccgtcgaggactcccggttctgggagctggtggacaaggagcgcaacctccacctggaggggaagtgcgagacctgcgtgtacaacatgatgggcaagcgggagaagaagctgggggagttcggcaaggccaagggcagccgcgcgatctggtacatgtggctcggggcccggttcctggagttcgaggccctgggcttcctcaacgaggaccactggttcagccgcgagaactccctgagcggggtcgagggcgaggggctgcacaagctcggctacatcctgcgggacgtgtccaagaaggagggcggggccatgtacgcggacgacaccgccggctgggacacccgcatcacgctggaggacctcaagaacgaggagatggtgaccaaccacatggagggggagcacaagaagctggccgaggccatcttcaagctgacctaccagaacaaggtcgtgcgggtgcagcgccccacgccccggggcacggtcatggacatcatcagccgccgcgaccagcgggggtccggccaggtgggcacctacgggctcaacaccttcaccaacatggaggcccagctgatccgccagatggagggcgagggggtgttcaagaacatccagcacctgacggtcaccgaggagatcgcggtgcagaactggctcgcccgggtgggccgcgagcggctgagccgcatggccatctccggcgacgactgcgtcgtgaagcccctggacgaccggttcgccagcgccctcaccgcgctgaacgacatggggaaggtgcgcaaggacatccagcagtgggagccgtcccggggctggaacgactggacccaggtccccttctgcagccaccacttccacgagctgatcatgaaggacgggcgcgtgctcgtggtcccctgccggaaccaggacgagctgatcggccgcgcccggatctcccagggggccggctggagcctgcgcgagacggcctgcctcggcaagtcctacgcccagatgtggagcctgatgtacttccaccggcgcgacctgcggctcgcggccaacgccatctgctccgccgtgcccagccactgggtgccgacctcccgcaccacctggagcatccacgccaagcacgagtggatgaccacggaggacatgctgaccgtctggaaccgggtgtggatccaggagaacccctggatggaggacaagacccccgtggagagctgggaggagatcccctacctggggaagcgcgaggaccagtggtgcggctccctcatcgggctgaccagccgcgcgacgtgggccaagaacatccagaccgccatcaaccaggtccggtccctgatcggcaacgaggagtacaccgactacatgccgagcatgaagcgcttccggcgcgaggaggaggaggccggggtgctctggtga

SEQ ID NO: 9035 - RNA, 9876 nt, synthetic construct
  misc_feature 1..9876: note = derived and/or modified CDS sequence (opt1) from DENV-2__KF704358__SS-prME
  source 1..9876: mol_type = other RNA
accgccggcatgatcatcatgctgatccccaccgtgatggccttccacctcaccacccgcaacggggagccccacatgatcgtcagccggcaggagaagggcaagagcctgctgttcaacaccggggacggcgtgcacatgtgcaccctcatggcgatgcacctgggggagctgtgcgaggacaccatcacctacaagtgccccctcctgcgccagaacgagcccgaggacatcgactgctggtgcaacagcacctccacctgggtgacctacgggacctgcaccaccaccggcgagcaccggcgcgagaagcggagcgtcgccctggtgccccacgtggggatgggcctcgagacccgcaccgagacctggatgtccagcgagggggcctggaagcacgcccagcggatcgagacgtggatcctgcgccaccccggcttcaccatcatggccgcgatcctggcctacaccatcgggaccacgcacttccagcgggccctcatcttcatcctgctgaccgccgtcgcgccctccatgaccatgcgctgcatcggcatcagcaaccgggacttcgtggagggcgtgtccgggggcagctgggtcgacatcgtgctcgagcacgggtcctgcgtgaccacgatggccaagaacaagcccaccctggacctggagctcatcaagaccgaggccaagcagcccgccaccctgcgcaagtactgcatcgaggccaagctgacgaacaccaccaccgagagccggtgcccgacgcagggcgagccctccctcaacgaggagcaggacaagcgcttcgtctgcaagcacagcatggtggaccggggctgggggaacggctgcgggctgttcggcaaggggtccatcgtgacctgcgcgatgttcacgtgcaagaagatcatgaagggcaaggtcgtgcagcccgagaacctggagtacaccatcgtgatcacgccccacagcggcgaggagcacgccgtcgggaacgacaccggcaagcacgggaaggagatcaagatcaccccgcagtccagcatcaccgaggccgagctcaccggctacgggacggtgaccatggagtgcagcccccggaccggcctggacttcaacgagatggtgctgctccagatggaggacaaggcctggctggtccaccggcagtggttcctggacctccccctgccctggctgccgggcgccgacacccaggggagcaactggatccagaaggagacgctcgtgaccttcaagaacccccacgcgaagaagcaggacgtggtcgtgctgggcagccaggagggggccatgcacaccgccctgaccggcgccacggagatccagatgtccagcgggaacgtcctcttcaccggccacctgaagtgccgcctgcggatggacaagctccagctgaagggcatgtcctacagcatgtgcaccgggaagttcaaggtggtgaaggagatcgccgagacccagcacggcacgatcgtcatccgcgtgcagtacgagggggacggctccccctgcaagatccccttcgagatcatggacctggagaagcggcacgtgctcggccgcctgatcaccgtcaacccgatcgtgaccgggaaggacagccccgtgaacatcgaggcggagccgcccttcggcgactcctacatcatcatcggggtcgagccgggccagctgaagctcaactggttcaagaaggggagctccatcggccagatgttcgccaccacgatgcgcggcgccaagcggatggccatcctgggggacaccgcctgggacttcggcagcctcgggggcgtgttcacctccatcgggaaggcgctccaccaggtgttcggcgccatctacggcgccgccttcagcggggtctcctggaccatgaagatcctgacgggcgtgatcatcacctggatcgggatgaacagccgctccaccagcctgtccgtgagcctggtcctcgtgggcgtggtcaccctgtacctgggggtgatggtgcaggcggactccggctgcgtcgtgagctggaagaacaaggagctcaagtgcggcagcgggatcttcatcacggacaacgtgcacacctggaccgagcagtacaagttccagcccgagtcccccagcaagctggcctccgccatccagaaggcccacgaggagggcatctgcgggatccggagcgtcacccgcctggagaacctcatgtggaagcagatcacgcccgagctgaaccacatcctgtccgagaacgaggtgaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatcgagaaggccagcttcatcgaggtcaagtcctgccactggcccaagagccacaccctgtggtccaacggcgtgctggagagcgagatgatcatccccaagaacttcgccgggcccgtgagccagcacaactaccgcccgggctaccacacgcagaccgcggggccctggcacctcggcaagctggagatggacttcgacttctgcgaggggaccaccgtcgtggtgacggaggactgcggcaaccggggcccctccctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcgtcggcacgaagcacgcgatcctgctcgtggccgtgagcttcgtcaccctgatcaccgggaacatgtccttccgggacctgggccgcgtgatggtgatggtcggggccaccatgacggacgacatcggcatgggcgtgacctacctcgccctgctggccgcgttcaaggtgcgccccaccttcgccgccgggctcctgctgcggaagctcaccagcaaggagctgatgatgacgaccatcggcatcgtcctgctctcccagagcaccatccccgagaccatcctggagctgacggacgccctcgccctggggatgatggtgctgaagatggtgcgcaagatggagaagtaccagctcgcggtcaccatcatggccatcctgtgcgtgccgaacgccgtcatcctgcagaacacctggaaggtgtcctgcaccatcctcgccgtggtcagcgtgagccccctgttcctgacgagctcccagcagaaggccgactggatccccctcgcgctgaccatcaagggcctgaaccccaccgccatcttcctcaccacgctgagccggaccaacaagaagcgctcctggccgctgaacgaggccatcatggccgtgggcatggtcagcatcctcgcgtccagcctgctgaagaacgacatccccatgaccgggcccctcgtggccggcgggctgctgaccgtgtgctacgtcctcacgggccggagcgccgacctggagctggagcgcgccgccgacgtgaagtgggaggaccaggcggagatctccgggagctcccccatcctcagcatcaccatctccgaggacggcagcatgtccatcaagaacgaggaggaggagcagaccctgaccatcctgatccggaccggcctcctggtgatcagcgggctgttcccggtctccatccccatcacggccgccgcctggtacctctgggaggtgaagaagcagcgcgccggcgtgctgtgggacgtcccctccccgccgcccgtggggaaggcggagctggaggacggcgcctaccggatcaagcagaaggggatcctcggctactcccagatcggcgccggggtgtacaaggagggcaccttccacaccatgtggcacgtcacccgcggggccgtgctgatgcacaagggcaagcggatcgagcccagctgggccgacgtgaagaaggacctgatctcctacgggggcggctggaagctcgagggggagtggaaggagggcgaggaggtccaggtgctggcgctggagcccgggaagaacccccgcgccgtgcagacgaagcccggcctcttcaagaccaacgccgggaccatcggcgccgtcagcctggacttctcccccggcaccagcgggtcccccatcatcgacaagaagggcaaggtggtggggctgtacggcaacggcgtcgtgacgcggagcggggcctacgtgtccgcgatcgcccagaccgagaagtccatcgaggacaaccccgagatcgaggacgacatcttccgcaagcggaagctcaccatcatggacctgcaccccggcgccgggaagaccaagcgctacctgcccgccatcgtccgggaggcgatcaagcgcggcctgcggacgctcatcctggccccgacccgcgtggtggccgccgagatggaggaggccctgcgggggctccccatccgctaccagacccccgcgatccgcgccgagcacaccggccgggagatcgtcgacctgatgtgccacgccacgttcaccatgcgcctgctcagccccgtgcgggtgccgaactacaacctgatcatcatggacgaggcccacttcaccgaccccgcctccatcgcggcccgcggctacatcagcacccgggtcgagatgggggaggccgccggcatcttcatgacggccacgccgcccgggtcccgcgacccgttcccccagagcaacgcgcccatcatggacgaggagcgggagatccccgagcgctcctggagctccggccacgagtgggtgaccgacttcaaggggaagaccgtgtggttcgtcccgagcatccgggccggcaacgacatcgccgcctgcctgcgcaagaacggcaagaaggtgatccagctctcccggaagacgttcgacagcgagtacgtgaagacccgcaccaacgactgggacttcgtcgtgaccacggacatctccgagatgggggcgaacttcaaggccgagcgggtgatcgacccccgccggtgcatgaagcccgtcatcctgaccgacggcgaggagcgcgtgatcctggccgggcccatgccggtgacccacagctccgccgcccagcggcgcggccggatcgggcgcaaccccaagaacgagaacgaccagtacatctacatgggcgagcccctcgagaacgacgaggactgcgcgcactggaaggaggccaagatgctgctggacaacatcaacacccccgagggcatcatcccgagcatgttcgagcccgagcgcgagaaggtcgacgccatcgacggggagtaccggctccgcggcgaggcccggaagacgttcgtggacctgatgcgccgcggggacctgcccgtgtggctcgcctaccgcgtcgcggccgagggcatcaactacgccgaccggcgctggtgcttcgacgggatcaagaacaaccagatcctggaggagaacgtggaggtcgagatctggaccaaggagggcgagcggaagaagctgaagccgcgctggctcgacgcccggatctactccgaccccctggccctgaaggagttcaaggagttcgcggccggccgcaagagcctcaccctgaacctgatcaccgagatggggcggctccccacgttcatgacccagaaggcccgcgacgccctggacaacctggcggtgctccacaccgccgaggccggcgggcgggcctacaaccacgccctgtccgagctgcccgagaccctcgagacgctgctgctcctgaccctgctcgcgaccgtgaccggcggcatcttcctgttcctgatgagcgggcgcggcatcgggaagatgaccctcggcatgtgctgcatcatcacggcctccatcctgctgtggtacgcccagatccagccgcactggatcgccgccagcatcatcctcgagttcttcctgatcgtcctgctcatccccgagcccgagaagcagcggacgccccaggacaaccagctgacctacgtggtgatcgcgatcctgaccgtcgtggccgccacgatggccaacgagatggggttcctcgagaagaccaagaaggacctgggcctgggcagcatcaccacccagcagccggagtccaacatcctcgacatcgacctgcgccccgccagcgcgtggacgctgtacgccgtggccaccaccttcgtcacccccatgctccggcactccatcgagaacagctccgtgaacgtgagcctgacggccatcgccaaccaggcgaccgtcctgatggggctcggcaaggggtggcccctgtccaagatggacatcggcgtgccgctgctcgccatcgggtgctacagccaggtgaaccccatcaccctgaccgccgccctgttcctcctggtcgcgcactacgccatcatcggccccggcctgcaggccaaggccacgcgcgaggcccagaagcgggcggccgccgggatcatgaagaaccccaccgtggacggcatcaccgtgatcgacctcgacccgatcccctacgaccccaagttcgagaagcagctggggcaggtcatgctgctcgtgctgtgcgtgacccaggtcctgatgatgcgcacgacctgggccctctgcgaggccctgaccctggcgaccggccccatctccacgctctgggaggggaacccgggccgcttctggaacaccaccatcgccgtgagcatggccaacatcttccggggctcctacctggccggggccggcctgctgttcagcatcatgaagaacaccacgaacacccgccgggggaccggcaacatgggcgagaccctgggggagaagtggaagtcccgcctgaacgcgctcggcaagagcgagttccagatctacaagaagtccgggatccaggaggtggaccggacgctggccaaggagggcatcaagcgcggggagaccgaccaccacgccgtcagccggggctccgccaagctgcgctggttcgtggagcggaacatggtgacccccgagggcaaggtcgtggacctcgggtgcggccgcgggggctggagctactactgcgggggcctgaagaacgtgcgggaggtcaagggcctgaccaagggcggccccgggcacgaggagcccatcccgatgtccacgtacggctggaacctcgtgcgcctgcagagcggggtggacgtcttcttcacgccgcccgagaagtgcgacaccctgctctgcgacatcggcgagagctcccccaacccgaccgtggaggcgggccggaccctgcgcgtgctgaacctcgtcgagaactggctgaacaacaacacgcagttctgcatcaaggtgctgaacccctacatgcccagcgtgatcgagaagatggaggccctccagcggaagtacgggggcgccctggtccgcaacccgctgtcccggaacagcacccacgagatgtactgggtgtccaacgccagcgggaacatcgtgtccagcgtcaacatgatctcccgcatgctgatcaaccggttcaccatgcgccacaagaaggccaccttcgagcccgacgtggacctcggcagcgggacgcgcaacatcggcatcgagtccgagatccccaacctggacatcatcggcaagcggatcgagaagatcaagcaggagtacgagaccagctggcactacgaccaggaccacccctacaagacctgggcgtaccacgggtcctacgagaccaagcagacgggcagcgcctccagcatggtgaacggggtcgtgcgcctgctcaccaagccgtgggacgtggtccccatggtgacccagatggccatgaccgacacgacccccttcggccagcagcgggtgttcaaggagaaggtcgacacccgcacccaggagcccaaggagggcacgaagaagctgatgaagatcaccgccgagtggctgtggaaggagctcgggaagaagaagaccccgcggatgtgcacccgcgaggagttcacgcggaaggtgcgctccaacgccgcgctgggcgccatcttcaccgacgagaacaagtggaagtccgcccgggaggccgtcgaggactcccgcttctgggagctggtggacaaggagcggaacctccacctggaggggaagtgcgagacctgcgtgtacaacatgatgggcaagcgcgagaagaagctgggggagttcggcaaggccaagggcagccgggcgatctggtacatgtggctcggggcccgcttcctggagttcgaggccctgggcttcctcaacgaggaccactggttcagccgggagaactccctgagcggggtcgagggcgaggggctgcacaagctcggctacatcctgcgcgacgtgtccaagaaggagggcggggccatgtacgcggacgacaccgccggctgggacacgcggatcaccctggaggacctcaagaacgaggagatggtgaccaaccacatggagggggagcacaagaagctggccgaggccatcttcaagctgacctaccagaacaaggtcgtgcgcgtgcagcggcccacgccccgcggcaccgtcatggacatcatcagccggcgcgaccagcgcgggtccggccaggtgggcacctacgggctcaacaccttcacgaacatggaggcccagctgatccggcagatggagggcgagggggtgttcaagaacatccagcacctgaccgtcaccgaggagatcgcggtgcagaactggctcgcccgcgtgggccgggagcgcctgagccggatggccatctccggcgacgactgcgtcgtgaagcccctggacgaccgcttcgccagcgccctcaccgcgctgaacgacatggggaaggtgcggaaggacatccagcagtgggagccgtcccgcggctggaacgactggacgcaggtccccttctgcagccaccacttccacgagctgatcatgaaggacgggcgggtgctcgtggtcccctgccgcaaccaggacgagctgatcggccgggcccgcatctcccagggggccggctggagcctgcgggagaccgcctgcctcggcaagtcctacgcccagatgtggagcctgatgtacttccaccgccgggacctgcgcctcgcggccaacgccatctgctccgccgtgcccagccactgggtgccgacctcccggaccacctggagcatccacgccaagcacgagtggatgacgaccgaggacatgctgaccgtctggaaccgcgtgtggatccaggagaacccctggatggaggacaagacccccgtggagagctgggaggagatcccctacctggggaagcgggaggaccagtggtgcggctccctcatcgggctgacgagccgcgcgacctgggccaagaacatccagaccgccatcaaccaggtccgctccctgatcggcaacgaggagtacaccgactacatgccgagcatgaagcggttccgccgggaggaggaggaggccggggtgctctggtga

SEQ ID NO: 9036 - RNA, 9876 nt, synthetic construct
  misc_feature 1..9876: note = derived and/or modified CDS sequence (opt1) from DENV-2__KF041232__SS-prME
  source 1..9876: mol_type = other RNA
accgccggggtgatcatcatgctgatccccaccgccatggcgttccacctcaccacccgcaacggggagccccacatgatcgtcagcaagcaggagaagggcaagagcctgctgttcaagaccgaggacggggtgaacatgtgcaccctcatggccatggacctgggcgagctgtgcgaggacaccatcacctacaactgccccctcctgcggcagaacgagcccgaggacatcgactgctggtgcaacgccaccagcacctgggtgacctacgggacctgcaccgccaccggcgagcaccgccgggagaagcgctccgtcgccctggtgccccacgtgggcatggggctcgagacccggaccgagacctggatgagctccgagggcgcgtggaagcacgcccagcgcatcgagacctggatcctgcggcaccccgggttcaccatcatggccgccatcctggcgtacaccatcggcaccacctacttccagcgcgtcctcatcttcatcctgctgacggccgtggcccccagcatgaccatgcggtgcatcgggatctccaaccgcgacttcgtggagggcgtcagcggcgggtcctgggtggacatcgtgctcgagcacggcagctgcgtcaccaccatggccaagaacaagcccacgctggacttcgagctgatcaagaccgaggccaagcagcccgcgaccctccggaagtactgcatcgaggccaagctgaccaacacgaccaccgcctcccgctgcccgacccagggggagcccagcctgaacgaggagcaggacaagcggttcgtgtgcaagcactccatggtggaccgcggctggggcaacgggtgcggcctcttcgggaagggcgggatcgtcacgtgcgccatgttcacgtgcaagaagaacatggagggcaagatcgtgcagcccgagaacctggagtacaccatcgtggtcacgccccacagcggcgaggagaacgccgtggggaacgacacgggcaagcacgggaaggagatcaaggtgaccccgcagtccagcatcaccgaggcggagctgaccggctacgggaccgtcacgatggagtgcagcccccggaccggcctcgacttcaacgagatggtgctgctgcagatggagaacaaggcctggctcgtgcaccgccagtggttcctggacctgcccctcccctggctgccgggcgccgacatccaggggagcaactggatccagaaggagaccctggtcaccttcaagaacccccacgccaagaagcaggacgtggtcgtgctcggctcccaggagggggccatgcacacggcgctgaccggcgccaccgagatccagatgagcagcgggaacctcctgttcaccggccacctgaagtgccggctgcgcatggacaagctccagctgaagggcatgtcctacagcatgtgcacggggaagttcaaggtggtcaaggagatcgccgagacccagcacggcaccatcgtggtgcgggtccagtacgagggggacggctccccctgcaagatccccttcgagatcatggacctggagaagcgccacgtgctcggccggctgatcaccgtgaacccgatcgtcacggagaaggacagccccgtgaacatcgaggccgagccgcccttcggggactcctacatcatcatcggcgtggagccggggcagctgaagctcagctggttcaagaagggctccagcatcgggcagatgttcgagaccaccatgcgcggcgccaagcgcatggcgatcctgggcgacaccgcctgggacttcgggtccctgggcggggtcttcacgagcatcggcaaggccctccaccaggtgttcggggccatctacggcgcggccttctccggcgtgagctggaccatgaagatcctgatcggggtcgtgatcacctggatcggcatgaactcccggagcacctccctgagcgtgtccctggtcctcgtgggggtggtcacgctgtacctgggcgccatggtgcaggccgacagcgggtgcgtggtctcctggaagaacaaggagctcaagtgcggcagcggcatcttcatcaccgacaacgtgcacacctggaccgagcagtacaagttccagcccgagagcccctccaagctggccagcgcgatccagaaggcccacgaggaggggatctgcggcatccgctccgtgacgcggctggagaacctcatgtggaagcagatcacccccgagctgaaccacatcctgagcgagaacgaggtcaagctctccatcatgaccggggacatcaagggcatcatgcaggccgggaagcgcagcctgcggccgcagcccaccgagctgaagtactcctggaagacgtggggcaaggccaagatgctcagcaccgagccccacaaccagaccttcctgatcgacggcccggagaccgccgagtgccccaacacgaaccgcgcgtggaactccctggaggtggaggactacgggttcggcgtgttcaccaccaacatctggctcaagctgaaggagcggcaggacgtcttctgcgacagcaagctgatgtccgccgccatcaaggacaaccgcgccgtgcacgccgacatggggtactggatcgagagcgcgctcaacgacacctggaagatcgagaaggcctccttcatcgaggtcaagagctgccactggcccaagtcccacacgctgtggagcaacggcgtgctggagtccgagatgatcatccccaagaacttcgccggcccggtgagccagcacaactaccggcccgggtaccacacccagaccgccggcccctggcacctcgggaagctggagatggacttcgacttctgcgagggcaccaccgtggtcgtgacggaggactgcgggaaccgcggccccagcctgcggaccaccaccgcgtccggcaagctcatcacggagtggtgctgccgcagctgcaccctgccgcccctgcggtaccgcggggaggacggctgctggtacgggatggagatccggcccctcaaggagaaggaggagaacctggtgaactccctggtcaccgccggccacgggcagatcgacaacttcagcctcggcgtgctgggcatggccctgttcctcgaggagatgctgcgcacccgggtggggacgaagcacgccgtcctgctcgtggccgtgtccttcatgaccctgatcaccggcaacatgagcttccgcgacctggggcgggtcatggtgatggtgggcgcggccatgaccgacgacatcgggatgggcgtcacgtacctcgccctgctggccgccttcaaggtgcgccccaccttcgcggccggcctcctgctgcgcaagctcacctccaaggagctgatgatgaccacgatcgggatcgtgctgctcagccagtccaccaccccggagaccatcctggagctgacggacgccctcgccctgggcatgatgatcctgaagatcgtccggaacatggagaagtaccagctcgccgtgaccatcatggcgatcctgtgcgtccccaacgccgtgatcctgcagaacgcctggaaggtgagctgcaccatcctcgccgcggtctccgtgagccccctgctgctcacctccagccagcagaaggccgactggatccccctggccctgacgatcaaggggctcaacccgaccgccatcttcctgaccaccctgtcccgcacgaacaagaagcggagctggcccctcaacgaggccatcatggcggtgggcatggtctccatcctggccagctccctgctcaagaacgacatccccatgaccggccccctggtggccgggggcctgctcaccgtgtgctacgtcctgaccgggcgcagcgccgacctggagctcgagcgggccgcggacgtgcgctgggaggaccaggccgagatcagcggctccagcccgatcctgtccatcacgatcagcgaggacgggtccatgagcatcaagaacgaggaggaggagcagaccctgaccatcctcatccggaccggcctgctggtgatctccggcctcttccccgtcagcatccccatcacggccgccgcctggtacctgtgggaggtgaagaagcagcgcgcgggggtgctgtgggacgtcccctccccgccgcccgtgggcaaggccgagctcgaggacggggcctaccggatcaagcagaagggcatcctggggtacagccagatcggcgccggcgtgtacaaggaggggaccttccacaccatgtggcacgtcacccgcggcgccgtgctgatgcacaaggggaagcggatcgagccgtcctgggcggacgtgcgcaaggacctcatcagctacggcgggggctggaagctggagggcgagtggaaggagggggaggaggtccaggtgctggccctcgagcccggcaagaacccccgggccgtgcagaccaagcccgggctgttcaagacgaacaccggcaccatcggggccgtctccctggacttcagcccgggcacctccggcagccccatcgtggacaagaaggggaaggtggtcggcctctacgggaacggcgtggtgacgcgctccggcacctacgtcagcgcgatcgcccagaccgagaagtccatcgaggacaaccccgagatcgaggacgacatcttccggaagaagcgcctgaccatcatggacctgcaccccggggccggcaagacgaagcggtacctgccggccatcgtgcgcgaggccatcaagcgggggctccgcaccctgatcctggcgcccacccgggtggtcgccgccgagatggaggaggccctccgcggcctgcccatccgctaccagacccccgccatccgggcggagcacacggggcgcgagatcgtggacctgatgtgccacgccaccttcaccatgcggctcctgagcccggtgcgcgtccccaactacaacctgatcatcatggacgaggcccacttcaccgaccccgccagcatcgccgcgcggggctacatctccacgcgcgtggagatgggcgaggccgccgggatcttcatgaccgccacgccgcccggcagccgggaccccttcccccagtccaacgcgcccatcatggacgaggagcgcgagatccccgagcggagctggaactccgggcacgagtgggtgaccgacttcaagggcaagacggtctggttcgtgcccagcatcaaggccgggaacgacatcgccgcctgcctccgcaagaacggcaagaaggtgatccagctgtcccggaagaccttcgacagcgagtacatcaagacccgcaccaacgactgggacttcgtcgtgacgaccgacatctccgagatgggcgccaacttcaaggcggagcgggtgatcgacccccgccggtgcatgaagcccgtcatcctgaccgacggggaggagcgcgtgatcctcgccggcccgatgcccgtgacccacagctccgccgcccagcggcgcgggcggatcggccgcaaccccaagaacgagaacgaccagtacatctacatgggggagcccctggagaacgacgaggactgcgcccactggaaggaggcgaagatgctgctcgacaacatcaacacgccggagggcatcatccccagcatgttcgagcccgagcgcgagaaggtcgacgccatcgacggcgagtaccggctgcgcggggaggcccggaagaccttcgtggacctgatgcgccggggcgacctcccggtgtggctggcctaccgcgtcgccgcggaggggatcaactacgccgaccggcgctggtgcttcgacggcatcaagaacaaccagatcctggaggagaacgtggaggtcgagatctggaccaaggagggggagcggaagaagctcaagccccgctggctggacgcccggatctactccgaccccctggccctcaaggagttcaaggagttcgcggccggccgcaagagcctgaccctgaacctcatcacggagatgggccggctgcccaccttcatgacccagaaggcccgcaacgccctggacaacctcgccgtgctgcacaccgcggaggccgggggccgggcctacaaccacgccctgtccgagctcccggagacgctggagaccctgctcctgctgaccctcctggccaccgtgaccggcgggatcttcctgttcctcatgagcgggaaggggatcggcaagatgaccctggggatgtgctgcatcatcaccgcgtccatcctgctctggtacgcccagatccagccccactggatcgccgccagcatcatcctggagttcttcctgatcgtcctcctgatccccgagcccgagaagcagcgcaccccgcaggacaaccagctgacctacgtggtgatcgccatcctcacggtcgtggcggccaccatggccaacgagatgggcttcctggagaagaccaagaaggacttcgggctgggctccatcgccacccagcagcccgagagcaacatcctcgacatcgacctgcggcccgccagcgcgtggacgctgtacgccgtggccaccaccttcatcacccccatgctccgccactccatcgagaacagctccgtcaacgtgagcctgacggccatcgcgaaccaggccaccgtgctgatgggcctcgggaagggctggccgctgtccaagatggacatcggggtccccctgctcgccatcggctgctacagccaggtgaaccccatcaccctgaccgccgccctgctcctgctggtggcgcactacgccatcatcgggcccggcctccaggccaaggccacgcgggaggcccagaagcgcgcggccgccggcatcatgaagaacccgaccgtcgacgggatcaccgtgatcgacctggaccccatcccctacgaccccaagttcgagaagcagctgggccaggtgatgctcctggtcctgtgcgtgacccaggtgctcatgatgcggacgacctgggccctgtgcgaggccctgaccctcgcgaccgggccgatctccacgctgtgggagggcaaccccgggcgcttctggaacaccaccatcgccgtcagcatggccaacatcttccgcggctcctacctggccggcgcggggctcctgttcagcatcatgaagaacaccacgaacacccggcgcggcaccgggaacaccggcgagacgctgggcgagaagtggaagaaccggctcaactccctggggaagtccgagttccagatctacaagcgctccggcatccaggaggtggaccggaccctggccaaggaggggatcaagcgcggcgagaccgaccaccacgccgtgagccgggggtccgccaagctccgctggttcgtcgagcggaacctggtgacccccgagggcaaggtggtcgacctgggctgcgggcgcggcgggtggagctactactgcggcgggctcaagaacgtgcgggaggtgaagggcctgacgaagggcgggcccggccacgaggagccgatccccatgtccacctacgggtggaacctggtccgcctccagagcggcgtggacgtgttcttcacgccgcccgagaagtgcgacaccctgctgtgcgacatcggggagtccagcccgaaccccacggtcgaggccggccggaccctccgcgtgctgaacctggtggagaactggctcaacaacaacacccagttctgcatcaaggtcctgaacccctacatgccgagcgtgatcgagaagatggagaccctgcagcggaagtacggcggggcgctggtgcgcaaccccctctcccggaacagcacccacgagatgtactgggtctccaacgccagcggcaacatcgtgtccagcgtgaacatgatctcccgcatgctgatcaaccggttcacgatgcgccacaagaaggccacctacgagcccgacgtcgacctggggagcggcacccgcaacatcgggatcgagtccgagacccccaacctcgacatcatcggcaagcggatcgagaagatcaagcaggagcacgagacgagctggcactacgaccaggaccacccgtacaagacctgggcctaccacggctcctacgagaccaagcagaccgggagcgcctccagcatggtgaacggcgtggtccgcctgctgacgaagccctgggacgtgatccccatggtgacccagatggcgatgaccgacaccacgcccttcgggcagcagcgggtcttcaaggagaaggtggacacccgcacccaggagccgaaggagggcaccaagaagctcatgaagatcacggccgagtggctgtggaaggagctgggcaagaagaagacgccccggatgtgcacccgcgaggagttcgcccggaaggtgcgctccaacgccgccctcggggcgatcttcaccgacgagaacaagtggaagtccgcccgggaggccgtcgaggactcccgcttctgggagctggtggacaaggagcggaacctgcacctcgagggcaagtgcgagacgtgcgtctacaacatgatggggaagcgcgagaagaagatcggcgagttcgggaaggccaagggcagccgggcgatctggtacatgtggctgggcgcccgcttcctggagttcgaggccctcgggttcctgaacgaggaccactggttctcccgggagaacagcctgagcggcgtggagggggagggcctccacaagctggggtacatcctgcgcgaggtgtccaagaaggagggcggcgccatgtacgccgacgacaccgcggggtgggacacccggatcaccctcgaggacctgaagaacgaggagatggtcacgaaccacatggagggcgagcacaagaagctggccgaggccatcttcaagctcacctaccagaacaaggtggtgcgcgtccagcggcccacgccccgcgggaccgtgatggacatcatcagccggcgcgaccagcgcggctccggccaggtgggcacgtacggcctgaacaccttcaccaacatgggggcccagctgatccggcagatggagggcgagggggtcttcaagggcatccagcacctcaccgccacggaggaggtggcggtgcaggactggctggcccgcgtcggccgggagcgcctgagccggatggccatctccggggacgactgcgtggtgaagccgctcgacgaccgcttcgccaacgccctgaccgcgctgaacgacatgggcaaggtccggaaggacatccagcagtgggagcccagccgcgggtggaacgactggacccaggtgcccttctgctcccaccacttccacgagctcatcatgaaggacggccgggtgctggtcgtgccctgccgcaaccaggacgagctgatcgggcgggcccgcatcagccagggcgccggctggtccctccgggagaccgcctgcctgggcaagagctacgcccagatgtggtccctgatgtacttccaccgccgggacctccgcctggcggccaacgccatctgcagcgccgtgccgtcccactgggtccccacgagccggaccacctggtccatccacgcgcgccacgagtggatgaccaccgaggacatgctgacggtgtggaaccgggtgtggatccaggagaacccctggatggaggacaagacccccgtcgagagctgggaggagatcccgtacctcggcaagcgcgaggaccagtggtgcgggtccctgatcggcctgaccagccgcgccacctgggcccggaacatccagacggccatcaaccaggtgcgcagcctcatcgggtccgaggagtacaccgactacatgcccagcatgaagcggttccgccgggaggaggaggaggccggcgtgctgtggtga

SEQ ID NO: 9037 - RNA, 9876 nt, synthetic construct
  misc_feature 1..9876: note = derived and/or modified CDS sequence (opt1) from DENV-2__KF041233__SS-prME
  source 1..9876: mol_type = other RNA
accgcgggcgtgatcatcatgctgatccccaccgccatggcgttccacctcaccacccggaacggggagccccacatgatcgtcagcaagcaggagaagggcaagagcctgctgttcaagaccgaggacggggtgaacatgtgcaccctcatggccatggacctgggcgagctgtgcgaggacaccatcacctacaactgccccctcctgcggcagaacgagcccgaggacatcgactgctggtgcaacagcacctccacctgggtgacctacgggacctgcaccgccaccggcgagcaccgccgggagaagcgcagcgtcgccctggtgccccacgtgggcatggggctcgagacccggaccgagacctggatgtccagcgagggcgcctggaagcacgcgcagcgcatcgagacctggatcctgcggcaccccgggttcaccatcatggccgccatcctggcctacaccatcggcaccacctacttccagcgcgtcctcatcttcatcctgctgacggcggtggccccctccatgaccatgcggtgcatcgggatcagcaaccgcgacttcgtggagggcgtctccggcgggagctgggtggacatcgtgctcgagcacggctcctgcgtcaccaccatggccaagaacaagcccacgctggacttcgagctgatcaagaccgaggccaagcagcccgccaccctccggaagtactgcatcgaggcgaagctgaccaacacgaccaccgccagccgctgcccgacccagggggagccctccctgaacgaggagcaggacaagcggttcgtgtgcaagcacagcatggtggaccgcggctggggcaacgggtgcggcctcttcgggaagggcgggatcgtcacgtgcgccatgttcacgtgcaagaagaacatggagggcaagatcgtgcagcccgagaacctggagtacaccatcgtggtcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccggaccggcctcgacttcaacgagatggtgctgctgcagatggagaacaaggcgtggctcgtgcaccgccagtggttcctggacctgcccctcccctggctgccgggcgccgacatccaggggtccaactggatccagaaggagaccctggtcaccttcaagaacccccacgccaagaagcaggacgtggtcgtgctcggcagccaggagggggccatgcacacggccctgaccggcgcgaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtggtgcgggtccagtacgagggggacggcagcccctgcaagatccccttcgagatcatggacctggagaagcgccacgtgctcggccggctgatcaccgtgaacccgatcgtcacggagaaggactcccccgtgaacatcgaggccgagccgcccttcggggacagctacatcatcatcggcgtggagccggggcagctgaagctctcctggttcaagaagggcagctccatcgggcagatgttcgagaccaccatgcgcggcgccaagcgcatggccatcctgggcgacaccgcgtgggacttcgggagcctgggcggggtcttcacgtccatcggcaaggccctccaccaggtgttcggggccatctacggcgccgcgttcagcggcgtgtcctggaccatgaagatcctgatcggggtcgtgatcacctggatcggcatgaacagccggtccaccagcctgtccgtgagcctggtcctcgtgggggtggtcacgctgtacctgggcgtgatggtgcaggccgactccgggtgcgtcgtgagctggaagaacaaggagctcaagtgcggcagcggcatcttcatcaccgacaacgtgcacacctggaccgagcagtacaagttccagcccgagtcccccagcaagctggccgccgccatccagaaggcgcacgaggaggggatctgcggcatccgctccgtcacgcggctggagaacctcatgtggaagcagatcacccccgagctgaaccacatcctgagcgagaacgaggtgaagctctccatcatgaccggggacatcaagggcatcatgcaggccgggaagcgcagcctgcggccgcagcccaccgagctgaagtactcctggaagacgtggggcaaggccaagatgctcagcaccgagccccacaaccagaccttcctgatcgacggcccggagaccgccgagtgccccaacacgaaccgcgcctggaactccctggaggtggaggactacgggttcggcgtcttcaccaccaacatctggctcaagctgaaggagcggcaggacgtgttctgcgacagcaagctgatgtccgcggccatcaaggacaaccgcgccgtgcacgccgacatggggtactggatcgagagcgccctcaacgacacctggaagatcgagaaggcgtccttcatcgaggtcaagagctgccactggcccaagtcccacacgctgtggagcaacggcgtgctggagtccgagatgatcatccccaagaacttcgccggcccggtgagccagcacaactaccggcccgggtaccacacccagaccgccggcccctggcacctcgggaagctggagatggacttcgacttctgcgagggcaccaccgtcgtggtgacggaggactgcgggaaccgcggccccagcctgcggaccaccaccgcctccggcaagctcatcacggagtggtgctgccgcagctgcaccctgccgcccctgcggtaccgcggggaggacggctgctggtacgggatggagatccggcccctcaaggagaaggaggagaacctggtcaactccctggtgaccgcgggccacgggcagatcgacaacttcagcctcggcgtgctgggcatggccctgttcctcgaggagatgctgcgcacccgggtcgggacgaagcacgccgtgctgctcatcgccgtgtccttcatgaccctgatcaccggcaacatgagcttccgcgacctggggcgggtcatggtgatggtgggcgccgcgatgaccgacgacatcgggatgggcgtcacgtacctcgccctgctggccgccttcaaggtgcgccccaccttcgccgcgggcctcctgctgcgcaagctcacctccaaggagctgatgatgaccacgatcgggatcgtgctgctcagccagtccaccaccccggagaccatcctggagctgacggacgccctcgccctgggcatgatgatcctgaagatcgtccggaacatggagaagtaccagctcgccgtgaccatcatggccatcctgtgcgtccccaacgcggtgatcctgcagaacgcctggaaggtgagctgcaccatcctcgccgccgtctccgtgagccccctgctgctcacctccagccagcagaaggcggactggatccccctggccctgacgatcaaggggctcaacccgaccgccatcttcctgaccaccctgtcccgcacgaacaagaagcggagctggcccctcaacgaggccatcatggccgtgggcatggtctccatcctggcgagctccctgctcaagaacgacatccccatgaccggccccctggtggccgggggcctgctcaccgtgtgctacgtcctgaccgggcgcagcgccgacctggagctcgagcgggccgccgacgtgcgctgggaggaccaggcggagatcagcggctccagcccgatcctgtccatcacgatcagcgaggacgggtccatgagcatcaagaacgaggaggaggagcagaccctgaccatcctcatccggaccggcctgctggtgatctccggcctcttccccgtcagcatccccatcacggccgccgcctggtacctgtgggaggtgaagaagcagcgcgccggggtgctgtgggacgtcccctccccgccgcccgtgggcaaggcggagctcgaggacggggcctaccggatcaagcagaagggcatcctggggtacagccagatcggcgccggcgtgtacaaggaggggaccttccacaccatgtggcacgtcacccgcggcgccgtgctgatgcacaaggggaagcggatcgagccgtcctgggccgacgtgcgcaaggacctcatcagctacggcgggggctggaagctggagggcgagtggaaggagggggaggaggtccaggtgctggcgctcgagcccggcaagaacccccgggccgtgcagaccaagcccgggctgttcaagacgaacaccggcaccatcggggccgtctccctggacttcagcccgggcacctccggcagccccatcgtggacaagaaggggaaggtggtcggcctctacgggaacggcgtggtgacgcgctccggcacctacgtcagcgccatcgcgcagaccgagaagtccatcgaggacaaccccgagatcgaggacgacatcttccggaagaagaagctgaccatcatggacctgcaccccggggccggcaagacgaagcgctacctgccggccatcgtgcgggaggccatcaagcgcgggctccggaccctgatcctggcccccacccgcgtggtcgcggccgagatggaggaggccctccggggcctgcccatccgctaccagacccccgccatccgcgccgagcacacggggcgggagatcgtggacctgatgtgccacgcgaccttcaccatgcgcctcctgagcccggtgcgggtccccaactacaacctgatcatcatggacgaggcccacttcaccgaccccgccagcatcgccgcccgcggctacatctccacgcgggtggagatgggcgaggcggccgggatcttcatgaccgccacgccgcccggcagccgcgaccccttcccccagtccaacgcccccatcatggacgaggagcgggagatccccgagcgcagctggaactccgggcacgagtgggtgaccgacttcaagggcaagacggtctggttcgtgcccagcatcaaggcggggaacgacatcgccgcctgcctccggaagaacggcaagaaggtgatccagctgtcccgcaagaccttcgacagcgagtacatcaagacccggaccaacgactgggacttcgtcgtgacgaccgacatctccgagatgggcgccaacttcaaggccgagcgcgtgatcgacccccggcgctgcatgaagcccgtcatcctgaccgacggggaggagcgggtgatcctcgcgggcccgatgcccgtgacccacagctccgccgcccagcgccgggggcgcatcggccggaaccccaagaacgagaacgaccagtacatctacatgggggagcccctggagaacgacgaggactgcgcccactggaaggaggccaagatgctgctcgacaacatcaacacgccggagggcatcatccccagcatgttcgagcccgagcgcgagaaggtcgacgcgatcgacggcgagtaccgcctgcgcggggaggcccgcaagaccttcgtggacctgatgcggcgcggcgacctcccggtgtggctggcctaccgggtcgccgccgaggggatcaactacgcggaccgccggtggtgcttcgacggcatcaagaacaaccagatcctggaggagaacgtggaggtcgagatctggaccaaggagggggagcgcaagaagctcaagccccggtggctggacgcccgcatctactccgaccccctggccctcaaggagttcaaggagttcgccgcgggccgcaagagcctgaccctgaacctcatcacggagatgggccgcctgcccaccttcatgacccagaaggcccggaacgccctggacaacctcgccgtgctgcacaccgccgaggccggcgggcgcgcctacaaccacgccctgtccgagctcccggagacgctggagaccctgctcctgctgaccctcctggccaccgtgaccggcgggatcttcctgttcctcatgagcgggaaggggatcgggaagatgaccctggggatgtgctgcatcatcaccgcctccatcctgctctggtacgcgcagatccagccccactggatcgccgccagcatcatcctggagttcttcctgatcgtcctcctgatccccgagcccgagaagcagcggaccccgcaggacaaccagctgacctacgtggtgatcgccatcctcacggtcgtggccgcgaccatggccaacgagatgggcttcctggagaagaccaagaaggacttcgggctgggctccatcgccacccagcagcccgagagcaacatcctcgacatcgacctgcgccccgccagcgcctggacgctgtacgcggtggccaccaccttcatcacccccatgctccggcactccatcgagaacagctccgtcaacgtgagcctgacggccatcgccaaccaggcgaccgtgctgatgggcctcgggaagggctggccgctgtccaagatggacatcggggtccccctgctcgccatcggctgctacagccaggtgaaccccatcaccctgaccgccgccctgctcctgctggtggcccactacgcgatcatcgggcccggcctccaggccaaggccacgcgcgaggcccagaagcgggccgcggccggcatcatgaagaacccgaccgtcgacgggatcaccgtgatcgacctggaccccatcccctacgaccccaagttcgagaagcagctgggccaggtgatgctcctggtcctgtgcgtgacccaggtgctcatgatgcgcacgacctgggccctgtgcgaggccctgaccctcgccaccgggccgatctccacgctgtgggagggcaaccccgggcggttctggaacaccaccatcgcggtcagcatggccaacatcttccgcggctcctacctggccggcgccgggctcctgttcagcatcatgaagaacaccacgaacacccgccggggcaccgggaacaccggcgagacgctgggcgagaagtggaagaaccgcctcaactccctgggcaagagcgagttccagatctacaagcggtccggcatccaggaggtggaccgcaccctggcgaaggaggggatcaagcggggcgagaccgaccaccacgccgtgagccgcgggtccgccaagctccggtggttcgtcgagcgcaacctggtgacccccgagggcaaggtggtcgacctgggctgcgggcggggcgggtggagctactactgcggcgggctcaagaacgtgcgcgaggtgaagggcctgacgaagggcgggcccggccacgaggagccgatccccatgtccacctacgggtggaacctggtccggctccagagcggcgtggacgtgttcttcacgccgcccgagaagtgcgacaccctgctgtgcgacatcggggagtccagcccgaaccccacggtcgaggccggccgcaccctccgggtgctgaacctggtggagaactggctcaacaacaacacccagttctgcatcaaggtcctgaacccctacatgccgagcgtgatcgagaagatggagaccctgcagcgcaagtacggcggggccctggtgcggaaccccctctcccgcaacagcacccacgagatgtactgggtctccaacgcgagcggcaacatcgtgtccagcgtgaacatgatctcccggatgctgatcaaccgcttcacgatgcggcacaagaaggccacctacgagcccgacgtcgacctggggagcggcacccgcaacatcgggatcgagtccgagacccccaacctcgacatcatcggcaagcgcatcgagaagatcaagcaggagcacgagacgagctggcactacgaccaggaccacccgtacaagacctgggcctaccacggctcctacgagaccaagcagaccgggagcgcctccagcatggtgaacggcgtggtccggctgctgacgaagccctgggacgtgatccccatggtgacccagatggccatgaccgacaccacgcccttcgggcagcagcgcgtcttcaaggagaaggtggacacccggacccaggagccgaaggagggcaccaagaagctcatgaagatcacggcggagtggctgtggaaggagctgggcaagaagaagacgccccggatgtgcacccgggaggagttcgcccgcaaggtgcggtccaacgccgccctcggggccatcttcaccgacgagaacaagtggaagtccgcgcgcgaggccgtcgaggactcccggttctgggagctggtggacaaggagcgcaacctgcacctcgagggcaagtgcgagacgtgcgtctacaacatgatggggaagcgggagaagaagatcggcgagttcgggaaggccaagggcagccgcgccatctggtacatgtggctgggcgcgcggttcctggagttcgaggccctcgggttcctgaacgaggaccactggttctcccgcgagaacagcctgagcggcgtggagggggagggcctccacaagctggggtacatcctgcgggaggtgtccaagaaggagggcggcgccatgtacgccgacgacaccgccgggtgggacacccgcatcaccctcgaggacctgaagaacgaggagatggtcacgaaccacatggagggcgagcacaagaagctggcggaggccatcttcaagctcacctaccagaacaaggtggtgcgggtccagcgccccacgccccgggggaccgtgatggacatcatcagccgccgggaccagcgcggctccggccaggtgggcacgtacggcctgaacaccttcaccaacatgggggcccagctgatccgccagatggagggcgagggggtcttcaagggcatccagcacctcaccgccacggaggaggtggccgtgcaggactggctggcgcgggtcggccgcgagcggctgagccgcatggccatctccggggacgactgcgtggtgaagccgctcgacgaccggttcgccagcgccctgaccgccctgaacgacatgggcaaggtccgcaaggacatccagcagtgggagccctcccgggggtggaacgactggacccaggtgcccttctgcagccaccacttccacgagctcatcatgaaggacggccgcgtgctggtcgtgccctgccggaaccaggacgagctgatcgggcgcgcgcggatctcccagggcgccggctggagcctccgcgagaccgcctgcctggggaagtcctacgcccagatgtggagcctgatgtacttccaccggcgcgacctccggctggccgcgaacgccatctgctccgccgtgccgagccactgggtccccacgtcccgcaccacctggagcatccacgcccggcacgagtggatgaccaccgaggacatgctgacggtgtggaaccgcgtgtggatccaggagaacccctggatggaggacaagaccctcgtcgagtcctgggaggagatcccctacctgggcaagcgggaggaccagtggtgcgggagcctgatcggcctcaccagccgcgcgacctgggcccgcaacatccagacggccatcaaccaggtgcggtccctgatcgggagcgaggagtacaccgactacatgccgtccatgaagcgcttccggcgcgaggaggaggaggccggcgtgctgtggtga

SEQ ID NO: 9038 - RNA, 9876 nt, synthetic construct
  misc_feature 1..9876: note = derived and/or modified CDS sequence (opt1) from DENV-2__KF041234__SS-prME
  source 1..9876: mol_type = other RNA
accgcgggcgtgatcatcatgctgatccccaccgccatggcgttccacctcaccacccgcaacggggagccccacatgatcgtcagcaagcaggagaagggcaagagcctgctgttcaagaccgaggacggggtgaacatgtgcaccctcatggccatggacctgggcgagctgtgcgaggacaccatcacctacaactgccccctcctgcggcagaacgagcccgaggacatcgactgctggtgcaacgccaccagcacctgggtgacctacgggacctgcaccgccaccggcgagcaccgccgggagaagcgctccgtcgccctggtgccccacgtgggcatggggctcgagacccggaccgagacctggatgagctccgagggcgcgtggaagcacgcccagcgcatcgagacctggatcctgcggcaccccgggttcaccatcatggccgccatcctggcgtacaccatcggcaccacctacttccagcgcgtcctcatcttcatcctgctgacggccgtggcccccagcatgaccatgcggtgcatcgggatctccaaccgcgacttcgtggagggcgtcagcggcgggtcctgggtggacatcgtgctcgagcacggcagctgcgtcaccaccatggccaagaacaagcccacgctggacttcgagctgatcaagaccgaggccaagcagcccgcgaccctccggaagtactgcatcgaggccaagctgaccaacacgaccaccgcctcccgctgcccgacccagggggagcccagcctgaacgaggagcaggacaagcggttcgtgtgcaagcactccatggtggaccgcggctggggcaacgggtgcggcctcttcgggaagggcgggatcgtcacgtgcgccatgttcacgtgcaagaagaacatggagggcaagatcgtgcagcccgagaacctggagtacaccatcgtggtcacgccccacagcggcgaggagaacgccgtggggaacgacacgggcaagcacgggaaggagatcaaggtgaccccgcagtccagcatcaccgaggcggagctgaccggctacgggaccgtcacgatggagtgcagcccccggaccggcctcgacttcaacgagatggtgctgctgcagatggagaacaaggcctggctcgtgcaccgccagtggttcctggacctgcccctcccctggctgccgggcgccgacatccaggggagcaactggatccagaaggagaccctggtcaccttcaagaacccccacgccaagaagcaggacgtggtcgtgctcggctcccaggagggggccatgcacacggcgctgaccggcgccaccgagatccagatgagcagcgggaacctcctgttcaccggccacctgaagtgccggctgcgcatggacaagctccagctgaagggcatgtcctacagcatgtgcacggggaagttcaaggtgatcaaggagatcgccgagacccagcacggcaccatcgtcgtgcgggtgcagtacgagggggacggctccccctgcaagatccccttcgagatcatggacctggagaagcgccacgtcctcggccggctgatcaccgtgaacccgatcgtgacggagaaggacagccccgtcaacatcgaggccgagccgcccttcggggactcctacatcatcatcggcgtggagccggggcagctgaagctcagctggttcaagaagggctccagcatcgggcagatgttcgagaccaccatgcgcggcgccaagcgcatggcgatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtggtcatcacctggatcggcatgaactcccggagcacctccctgagcgtgtccctggtgctcgtcggggtggtgacgctgtacctgggcgtcatggtgcaggccgacagcgggtgcgtggtctcctggaagaacaaggagctcaagtgcggcagcggcatcttcatcaccgacaacgtgcacacctggaccgagcagtacaagttccagcccgagagcccctccaagctggccagcgccatccagaaggcgcacgaggaggggatctgcggcatccgctccgtgacgcggctggagaacctcatgtggaagcagatcacccccgagctgaaccacatcctgagcgagaacgaggtcaagctctccatcatgaccggggacatcaagggcatcatgcaggccgggaagcgcagcctgcggccgcagcccaccgagctgaagtactcctggaagacgtggggcaaggccaagatgctcagcaccgagccccacaaccagaccttcctgatcgacggcccggagaccgccgagtgccccaacacgaaccgcgcctggaactccctggaggtggaggactacgggttcggcgtgttcaccaccaacatctggctcaagctgaaggagcggcaggacgtcttctgcgacagcaagctgatgtccgcggccatcaaggacaaccgcgccgtgcacgccgacatggggtactggatcgagagcgccctcaacgacacctggaagatcgagaaggcgtccttcatcgaggtcaagagctgccactggcccaagtcccacacgctgtggagcaacggcgtgctggagtccgagatgatcatccccaagaacttcgccggcccggtgagccagcacaactaccggcccgggtaccacacccagaccgccggcccctggcacctcgggaagctggagatggacttcgacttctgcgagggcaccaccgtggtcgtgacggaggactgcgggaaccgcggccccagcctgcggaccaccaccgcctccggcaagctcatcacggagtggtgctgccgcagctgcaccctgccgcccctgcggtaccgcggggaggacggctgctggtacgggatggagatccggcccctcaaggagaaggaggagaacctggtgaactccctggtcaccgcgggccacgggcagatcgacaacttcagcctcggcgtgctgggcatggccctgttcctcgaggagatgctgcgcacccgggtggggacgaagcacgccgtcctgctcgtggccgtgtccttcatgaccctgatcaccggcaacatgagcttccgcgacctggggcgggtcatggtgatggtgggcgccgcgatgaccgacgacatcgggatgggcgtcacgtacctcgccctgctggccgccttcaaggtgcgccccaccttcgccgcgggcctcctgctgcgcaagctcacctccaaggagctgatgatgaccacgatcgggatcgtgctgctcagccagtccaccaccccggagaccatcctggagctgacggacgccctcgccctgggcatgatgatcctgaagatcgtccggaacatggagaagtaccagctcgccgtgaccatcatggccatcctgtgcgtccccaacgcggtgatcctgcagaacgcctggaaggtgagctgcaccatcctcgccgccgtctccgtgagccccctgctgctcacctccagccagcagaaggcggactggatccccctggccctgacgatcaaggggctcaacccgaccgccatcttcctgaccaccctgtcccgcacgaacaagaagcggagctggcccctcaacgaggccatcatggccgtgggcatggtctccatcctggcgagctccctgctcaagaacgacatccccatgaccggccccctggtggccgggggcctgctcaccgtgtgctacgtcctgaccgggcgcagcgccgacctggagctcgagcgggccgccgacgtgcgctgggaggaccaggcggagatcagcggctccagcccgatcctgtccatcacgatcagcgaggacgggtccatgagcatcaagaacgaggaggaggagcagaccctgaccatcctcatccggaccggcctgctggtgatctccggcctcttccccgtcagcatccccatcacggccgccgcctggtacctgtgggaggtgaagaagcagcgcgccggggtgctgtgggacgtcccctccccgccgcccgtgggcaaggcggagctcgaggacggggcctaccggatcaagcagaagggcatcctggggtacagccagatcggcgccggcgtgtacaaggaggggaccttccacaccatgtggcacgtcacccgcggcgccgtgctgatgcacaaggggaagcggatcgagccgtcctgggccgacgtgcgcaaggacctcatcagctacggcgggggctggaagctggagggcgagtggaaggagggggaggaggtccaggtgctggcgctcgagcccggcaagaacccccgggccgtgcagaccaagcccgggctgttcaagacgaacaccggcaccatcggggccgtctccctggacttcagcccgggcacctccggcagccccatcgtggacaagaaggggaaggtggtcggcctctacgggaacggcgtggtgacgcgctccggcacctacgtcagcgccatcgcgcagaccgagaagtccatcgaggacaaccccgagatcgaggacgacatcttccggaagaagcgcctgaccatcatggacctgcaccccggggccggcaagacgaagcggtacctgccggccatcgtgcgcgaggccatcaagcgggggctccgcaccctgatcctggcccccacccgggtggtcgcggccgagatggaggaggccctccgcggcctgcccatccgctaccagacccccgccatccgggccgagcacacggggcgcgagatcgtggacctgatgtgccacgcgaccttcaccatgcggctcctgagcccggtgcgcgtccccaactacaacctgatcatcatggacgaggcccacttcaccgaccccgccagcatcgccgcccggggctacatctccacgcgcgtggagatgggcgaggcggccgggatcttcatgaccgccacgccgcccggcagccgggaccccttcccccagtccaacgcccccatcatggacgaggagcgcgagatccccgagcggagctggaactccgggcacgagtgggtgaccgacttcaagggcaagacggtctggttcgtgcccagcatcaaggcggggaacgacatcgccgcctgcctccgcaagaacggcaagaaggtgatccagctgtcccggaagaccttcgacagcgagtacatcaagacccgcaccaacgactgggacttcgtcgtgacgaccgacatctccgagatgggcgccaacttcaaggccgagcgggtgatcgacccccgccggtgcatgaagcccgtcatcctgaccgacggggaggagcgcgtgatcctcgcgggcccgatgcccgtgacccacagctccgccgcccagcggcgcgggcggatcggccgcaaccccaagaacgagaacgaccagtacatctacatgggggagcccctggagaacgacgaggactgcgcccactggaaggaggccaagatgctgctcgacaacatcaacacgccggagggcatcatccccagcatgttcgagcccgagcgcgagaaggtcgacgcgatcgacggcgagtaccggctgcgcggggaggcccggaagaccttcgtggacctgatgcgccggggcgacctcccggtgtggctggcctaccgcgtcgccgccgaggggatcaactacgcggaccggcgctggtgcttcgacggcatcaagaacaaccagatcctggaggagaacgtggaggtcgagatctggaccaaggagggggagcggaagaagctcaagccccgctggctggacgcccggatctactccgaccccctggccctcaaggagttcaaggagttcgccgcgggccgcaagagcctgaccctgaacctcatcacggagatgggccggctgcccaccttcatgacccagaaggcccgcaacgccctggacaacctcgccgtgctgcacaccgccgaggccggcgggcgggcctacaaccacgccctgtccgagctcccggagacgctggagaccctgctcctgctgaccctcctggccaccgtgaccggcgggatcttcctgttcctcatgagcgggaaggggatcggcaagatgaccctggggatgtgctgcatcatcaccgcctccatcctgctctggtacgcgcagatccagccccactggatcgccgccagcatcatcctggagttcttcctgatcgtcctcctgatccccgagcccgagaagcagcgcaccccgcaggacaaccagctgacctacgtggtgatcgccatcctcacggtcgtggccgcgaccatggccaacgagatgggcttcctggagaagaccaagaaggacttcgggctgggctccatcgccacccagcagcccgagagcaacatcctcgacatcgacctgcggcccgccagcgcctggacgctgtacgcggtggccaccaccttcatcacccccatgctccgccactccatcgagaacagctccgtcaacgtgagcctgacggccatcgccaaccaggcgaccgtgctgatgggcctcgggaagggctggccgctgtccaagatggacatcggggtccccctgctcgccatcggctgctacagccaggtgaaccccatcaccctgaccgccgccctgctcctgctggtggcccactacgcgatcatcgggcccggcctccaggccaaggccacgcgggaggcccagaagcgcgccgcggccggcatcatgaagaacccgaccgtcgacgggatcaccgtgatcgacctggaccccatcccctacgaccccaagttcgagaagcagctgggccaggtgatgctcctggtcctgtgcgtgacccaggtgctcatgatgcggacgacctgggccctgtgcgaggccctgaccctcgccaccgggccgatctccacgctgtgggagggcaaccccgggcgcttctggaacaccaccatcgcggtcagcatggccaacatcttccgcggctcctacctggccggcgccgggctcctgttcagcatcatgaagaacaccacgaacacccggcgcggcaccgggaacaccggcgagacgctgggcgagaagtggaagaaccggctcaactccctggggaagtccgagttccagatctacaagcgctccggcatccaggaggtggaccggaccctggcgaaggaggggatcaagcgcggcgagaccgaccaccacgccgtgagccgggggtccgccaagctccgctggttcgtcgagcggaacctggtgacccccgagggcaaggtggtcgacctgggctgcgggcgcggcgggtggagctactactgcggcgggctcaagaacgtgcgggaggtgaagggcctgacgaagggcgggcccggccacgaggagccgatccccatgtccacctacgggtggaacctggtccgcctccagagcggcgtggacgtgttcttcacgccgcccgagaagtgcgacaccctgctgtgcgacatcggggagtccagcccgaaccccacggtcgaggccggccggaccctccgcgtgctgaacctggtggagaactggctcaacaacaacacccagttctgcatcaaggtcctgaacccctacatgccgagcgtgatcgagaagatggagaccctgcagcggaagtacggcggggccctggtgcgcaaccccctctcccggaacagcacccacgagatgtactgggtctccaacgcgagcggcaacatcgtgtccagcgtgaacatgatctcccgcatgctgatcaaccggttcacgatgcgccacaagaaggccacctacgagcccgacgtcgacctggggagcggcacccgcaacatcgggatcgagtccgagacccccaacctcgacatcatcggcaagcggatcgagaagatcaagcaggagcacgagacgagctggcactacgaccaggaccacccgtacaagacctgggcctaccacggctcctacgagaccaagcagaccgggagcgcctccagcatggtgaacggcgtggtccgcctgctgacgaagccctgggacgtgatccccatggtgacccagatggccatgaccgacaccacgcccttcgggcagcagcgggtcttcaaggagaaggtggacacccgcacccaggagccgaaggagggcaccaagaagctcatgaagatcacggcggagtggctgtggaaggagctgggcaagaagaagacgccccggatgtgcacccgcgaggagttcgcccggaaggtgcgctccaacgccgccctcggggccatcttcaccgacgagaacaagtggaagtccgcgcgggaggccgtcgaggactcccgcttctgggagctggtggacaaggagcgggacctgcacctcgagggcaagtgcgagacgtgcgtctacaacatgatggggaagcgcgagaagaagatcggcgagttcgggaaggccaagggcagccgggccatctggtacatgtggctgggcgcgcgcttcctggagttcgaggccctcgggttcctgaacgaggaccactggttctcccgggagaacagcctgagcggcgtggagggggagggcctccacaagctggggtacatcctgcgcgaggtgtccaagaaggagggcggcgccatgtacgccgacgacaccgccgggtgggacacccggatcaccctcgaggacctgaagaacgaggagatggtcacgaaccacatggagggcgagcacaagaagctggcggaggccatcttcaagctcacctaccagaacaaggtggtgcgcgtccagcggcccacgccccgcgggaccgtgatggacatcatcagccggcgcgaccagcgcggctccggccaggtgggcacgtacggcctgaacaccttcaccaacatgggggcccagctgatccggcagatggagggcgagggggtcttcaagggcatccagcacctcaccgccacggaggaggtggccgtgcaggactggctggcgcgcgtcggccgggagcgcctgagccggatggccatctccggggacgactgcgtggtgaagccgctcgacgaccgcttcgccaacgccctgaccgccctgaacgacatgggcaaggtccggaaggacatccagcagtgggagcccagccgcgggtggtccgactggacccaggtgcccttctgcagccaccacttccacgagctcatcatgaaggacggccgggtgctggtcgtgccctgccgcaaccaggacgagctgatcgggcgggcgcgcatctcccagggcgccggctggagcctccgggagaccgcctgcctggggaagtcctacgcccagatgtggagcctgatgtacttccaccgccgggacctccgcctggccgcgaacgccatctgctccgccgtgccgagccactgggtccccacgtcccggaccacctggagcatccacgcccgccacgagtggatgaccaccgaggacatgctgacggtgtggaaccgggtgtggatccaggagaacccctggatggaggacaagacccccgtcgagtcctgggaggagatcccgtacctcggcaagcgcgaggaccagtggtgcgggagcctgatcggcctgaccagccgcgcgacctgggcccggaacatccagacggccatcaaccaggtgcgctccctcatcgggagcgaggagtacaccgactacatgccctccatgaagcggttccgccgggaggaggaggaggccggcgtgctgtggtga

SEQ ID NO: 9039 - RNA, 9876 nt, synthetic construct
  misc_feature 1..9876: note = derived and/or modified CDS sequence (opt1) from DENV-2__KF041235__SS-prME
  source 1..9876: mol_type = other RNA
accgcgggcgtgatcatcatgctgatccccaccgccatggcgttccacctcaccacccgcaacggggagccccacatgatcgtgagcaagcaggagaagggcaagtccctgctgttcaagaccgaggacggggtgaacatgtgcaccctcatggccatggacctgggcgagctgtgcgaggacaccatcacctacaactgccccctcctgcggcagaacgagcccgaggacatcgactgctggtgcaacagcacctccacctgggtgacctacgggacctgcaccgccaccggcgagcaccgccgggagaagcgcagcgtcgccctggtgccccacgtgggcatggggctcgagacccggaccgagacctggatgtccagcgagggcgcctggaagcacgcgcagcgcatcgagacctggatcctgcggcaccccgggttcaccatcatggccgccatcctggcctacaccatcggcaccacctacttccagcgcgtcctcatcttcatcctgctgacggcggtggccccctccatgaccatgcggtgcatcgggatcagcaaccgcgacttcgtggagggcgtctccggcgggagctgggtggacatcgtgctcgagcacggctcctgcgtcaccaccatggccaagaacaagcccacgctggacttcgagctgatcaagaccgaggccaagcagcccgccaccctccggaagtactgcatcgaggcgaagctgaccaacacgaccaccgccagccgctgcccgacccagggggagccctccctgaacgaggagcaggacaagcggttcgtgtgcaagcacagcatggtggaccgcggctggggcaacgggtgcggcctcttcgggaagggcgggatcgtcacgtgcgccatgttcacgtgcaagaagaacatggagggcaagatcgtgcagcccgagaacctggagtacaccatcgtggtcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccggaccggcctcgacttcaacgagatggtgctgctgcagatggagaacaaggcgtggctcgtgcaccgccagtggttcctggacctgcccctcccctggctgccgggcgccgacatccaggggtccaactggatccagaaggagaccctggtcaccttcaagaacccccacgccaagaagcaggacgtggtcgtgctcggcagccaggagggggccatgcacacggccctgaccggcgcgaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtggtgcgggtccagtacgagggggacggcagcccctgcaagatccccttcgagatcatggacctggagaagcgccacgtgctcggccggctgatcaccgtgaacccgatcgtcacggagaaggactcccccgtgaacatcgaggccgagccgcccttcggggacagctacatcatcatcggcgtggagccggggcagctgaagctctcctggttcaagaagggcagctccatcgggcagatgttcgagaccaccatgcgcggcgccaagcgcatggccatcctgggcgacaccgcgtgggacttcgggagcctgggcggggtcttcacgtccatcggcaaggccctccaccaggtgttcggggccatctacggcgccgcgttcagcggcgtgtcctggaccatgaagatcctgatcggggtcgtgatcacctggatcggcatgaacagccggtccaccagcctgtccgtgagcctggtcctcgtgggggtggtcacgctgtacctgggcgtgatggtgcaggccgactccgggtgcgtcgtgagctggaagaacaaggagctcaagtgcggcagcggcatcttcatcaccgacaacgtgcacacctggaccgagcagtacaagttccagcccgagtcccccagcaagctggcctccgccatccagaaggcccacgaggaggggatctgcggcatccgcagcgtcacgcggctggagaacctcatgtggaagcagatcacccccgagctgaaccacatcctgtccgagaacgaggtgaagctcagcatcatgaccggggacatcaagggcatcatgcaggcggggaagcgctccctgcggccgcagcccaccgagctgaagtacagctggaagacgtggggcaaggccaagatgctctccaccgagccccacaaccagaccttcctgatcgacggcccggagaccgccgagtgccccaacacgaaccgcgcctggaacagcctggaggtggaggactacgggttcggcgtcttcaccaccaacatctggctcaagctgaaggagcggcaggacgtgttctgcgactccaagctgatgagcgccgcgatcaaggacaaccgcgccgtgcacgccgacatggggtactggatcgagtccgccctcaacgacacctggaagatcgagaaggccagcttcatcgaggtcaagtcctgccactggcccaagagccacacgctgtggtccaacggcgtgctggagagcgagatgatcatccccaagaacttcgcgggcccggtgagccagcacaactaccggcccgggtaccacacccagaccgccggcccctggcacctcgggaagctggagatggacttcgacttctgcgagggcaccaccgtcgtggtgacggaggactgcgggaaccgcggcccctccctgcggaccaccaccgccagcggcaagctcatcacggagtggtgctgccgctcctgcaccctgccgcccctgcggtaccgcggggaggacggctgctggtacgggatggagatccggcccctcaaggagaaggaggagaacctggtcaacagcctggtgaccgccggccacgggcagatcgacaacttctccctcggcgtgctgggcatggcgctgttcctcgaggagatgctgcgcacccgggtcgggacgaagcacgccgtgctgctcgtggccgtcagcttcatgaccctgatcaccggcaacatgtccttccgcgacctggggcgggtgatggtgatggtcggcgccgccatgaccgacgacatcgggatgggcgtgacgtacctcgcgctgctggccgccttcaaggtgcgccccaccttcgccgccggcctcctgctgcgcaagctcaccagcaaggagctgatgatgaccacgatcgggatcgtcctgctctcccagagcaccaccccggagaccatcctggagctgacggacgcgctcgccctgggcatgatgatcctgaagatcgtgcggaacatggagaagtaccagctcgccgtcaccatcatggccatcctgtgcgtgcccaacgccgtgatcctgcagaacgcgtggaaggtctcctgcaccatcctcgccgccgtgagcgtgagccccctgctgctcaccagctcccagcagaaggccgactggatccccctggcgctgacgatcaaggggctcaacccgaccgccatcttcctgaccaccctgagccgcacgaacaagaagcggtcctggcccctcaacgaggccatcatggccgtcggcatggtgagcatcctggcctccagcctgctcaagaacgacatccccatgaccggccccctggtggccggcgggctgctcaccgtctgctacgtgctgaccgggcgcagcgccgacctggagctcgagcgggccgccgacgtgcgctgggaggaccaggccgagatctccgggagctccccgatcctgagcatcacgatctccgaggacgggagcatgtccatcaagaacgaggaggaggagcagaccctgaccatcctcatccggaccggcctgctggtcatcagcggcctcttccccgtgtccatccccatcacggcggccgcctggtacctgtgggaggtgaagaagcagcgcgccggggtcctgtgggacgtgcccagcccgccgcccgtgggcaaggccgagctcgaggacggggcgtaccggatcaagcagaagggcatcctggggtactcccagatcggcgccggcgtctacaaggaggggaccttccacaccatgtggcacgtgacccgcggcgccgtgctgatgcacaaggggaagcggatcgagccgagctgggccgacgtccgcaaggacctcatctcctacggcgggggctggaagctggagggcgagtggaaggagggggaggaggtccaggtgctggccctcgagcccggcaagaacccccgggcggtccagaccaagcccgggctgttcaagacgaacaccggcaccatcggggccgtgagcctggacttctccccgggcaccagcggctcccccatcgtggacaagaaggggaaggtcgtgggcctctacgggaacggcgtggtcacgcgcagcggcacctacgtgtccgccatcgcccagaccgagaagtccatcgaggacaaccccgagatcgaggacgacatcttccggaagaagcgcctgaccatcatggacctgcaccccggggcgggcaagacgaagcggtacctgccggccatcgtgcgcgaggccatcaagcgggggctccgcaccctgatcctggcccccacccgggtcgtggccgcggagatggaggaggccctccgcggcctgcccatccgctaccagacccccgccatccgggccgagcacacggggcgcgagatcgtggacctgatgtgccacgccaccttcaccatgcggctcctgagcccggtccgcgtgcccaactacaacctgatcatcatggacgaggcgcacttcaccgaccccgcctccatcgccgcccggggctacatcagcacgcgcgtggagatgggcgaggccgcggggatcttcatgaccgccacgccgcccggctcccgggaccccttcccccagagcaacgcccccatcatggacgaggagcgcgagatccccgagcggtcctggaacagcgggcacgagtgggtcaccgacttcaagggcaagacggtgtggttcgtgccctccatcaaggccgggaacgacatcgcggcctgcctccgcaagaacggcaagaaggtcatccagctgagccggaagaccttcgactccgagtacatcaagacccgcaccaacgactgggacttcgtggtgacgaccgacatcagcgagatgggcgccaacttcaaggccgagcgggtcatcgacccccgccggtgcatgaagcccgtgatcctgaccgacggggaggagcgcgtgatcctcgccggcccgatgcccgtcacccactccagcgcggcccagcggcgcgggcggatcggccgcaaccccaagaacgagaacgaccagtacatctacatgggggagcccctggagaacgacgaggactgcgcccactggaaggaggccaagatgctgctcgacaacatcaacacgccggagggcatcatcccctccatgttcgagcccgagcgcgagaaggtggacgccatcgacggcgagtaccggctgcgcggggaggcgcggaagaccttcgtggacctgatgcgccggggcgacctcccggtctggctggcctaccgcgtggccgccgaggggatcaactacgccgaccggcgctggtgcttcgacggcatcaagaacaaccagatcctggaggagaacgtcgaggtggagatctggaccaaggagggggagcggaagaagctcaagccccgctggctggacgcgcggatctacagcgaccccctggccctcaaggagttcaaggagttcgccgccggccgcaagtccctgaccctgaacctcatcacggagatgggccggctgcccaccttcatgacccagaaggcgcgcaacgccctggacaacctcgccgtgctgcacaccgccgaggccgggggccgggcgtacaaccacgccctgagcgagctcccggagacgctggagaccctgctcctgctgaccctcctggccaccgtcaccgggggcatcttcctgttcctcatgtccggcaaggggatcggcaagatgaccctggggatgtgctgcatcatcaccgccagcatcctgctctggtacgcccagatccagccccactggatcgcggcctccatcatcctggagttcttcctgatcgtgctcctgatccccgagcccgagaagcagcgcaccccgcaggacaaccagctgacctacgtggtcatcgccatcctcacggtggtggccgccaccatggcgaacgagatgggcttcctggagaagaccaagaaggacttcgggctgggcagcatcgccacccagcagcccgagagcaacatcctcgacatcgacctgcggcccgcctccgcctggacgctgtacgccgtcgcgaccaccttcatcacccccatgctccgccacagcatcgagaactccagcgtgaacgtgtccctgacggccatcgccaaccaggccaccgtcctgatgggcctcgggaagggctggccgctgagcaagatggacatcggggtgcccctgctcgcgatcggctgctactcccaggtgaaccccatcaccctgaccgccgccctgctcctgctggtcgcccactacgccatcatcgggcccggcctccaggcgaaggccacgcgggaggcccagaagcgcgccgccgcgggcatcatgaagaacccgaccgtggacgggatcaccgtgatcgacctggaccccatcccctacgaccccaagttcgagaagcagctgggccaggtcatgctcctggtgctgtgcgtgacccaggtcctcatgatgcggacgacctgggccctgtgcgaggccctgaccctcgccaccgggccgatcagcacgctgtgggagggcaaccccgggcgcttctggaacaccaccatcgccgtgtccatggcgaacatcttccgcggcagctacctggccggcgccgggctcctgttctccatcatgaagaacaccacgaacacccggcgcggcaccgggaacaccggcgagacgctgggcgagaagtggaagaaccggctcaacagcctggggaagtccgagttccagatctacaagcgcagcggcatccaggaggtggaccggaccctggccaaggaggggatcaagcgcggcgagaccgaccaccacgcggtctcccgggggagcgccaagctccgctggttcgtggagcggaacctggtgacccccgagggcaaggtcgtggacctgggctgcgggcgcggcgggtggtcctactactgcggcgggctcaagaacgtgcgggaggtcaagggcctgacgaagggcgggcccggccacgaggagccgatccccatgagcacctacgggtggaacctggtgcgcctccagtccggcgtggacgtcttcttcacgccgcccgagaagtgcgacaccctgctgtgcgacatcggggagagcagcccgaaccccacggtggaggccggccggaccctccgcgtgctgaacctggtcgagaactggctcaacaacaacacccagttctgcatcaaggtgctgaacccctacatgccgtccgtgatcgagaagatggagaccctgcagcggaagtacggcggggccctggtccgcaaccccctcagccggaactccacccacgagatgtactgggtgagcaacgcctccggcaacatcgtgagctccgtcaacatgatcagccgcatgctgatcaaccggttcacgatgcgccacaagaaggcgacctacgagcccgacgtggacctggggtccggcacccgcaacatcgggatcgagagcgagacccccaacctcgacatcatcggcaagcggatcgagaagatcaagcaggagcacgagacgtcctggcactacgaccaggaccacccgtacaagacctgggcctaccacggcagctacgagaccaagcagaccgggtccgccagctccatggtgaacggcgtcgtgcgcctgctgacgaagccctgggacgtgatccccatggtcacccagatggccatgaccgacaccacgcccttcgggcagcagcgggtgttcaaggagaaggtggacacccgcacccaggagccgaaggagggcaccaagaagctcatgaagatcacggccgagtggctgtggaaggagctgggcaagaagaagacgccccggatgtgcacccgcgaggagttcgcgcggaaggtccgcagcaacgccgccctcggggccatcttcaccgacgagaacaagtggaagtccgcccgggaggcggtggaggacagccgcttctgggagctggtcgacaaggagcggaacctgcacctcgagggcaagtgcgagacgtgcgtgtacaacatgatggggaagcgcgagaagaagatcggcgagttcgggaaggccaagggctcccgggccatctggtacatgtggctgggcgcccgcttcctggagttcgaggcgctcgggttcctgaacgaggaccactggttcagccgggagaacagcctgtccggcgtggagggggagggcctccacaagctggggtacatcctgcgcgaggtcagcaagaaggagggcggcgccatgtacgccgacgacaccgccgggtgggacacccggatcaccctcgaggacctgaagaacgaggagatggtgacgaaccacatggagggcgagcacaagaagctggccgaggcgatcttcaagctcacctaccagaacaaggtggtccgcgtgcagcggcccacgccccgcgggaccgtgatggacatcatctcccggcgcgaccagcgcggcagcgggcaggtcggcacgtacggcctgaacaccttcaccaacatgggggcccagctgatccggcagatggagggcgagggggtgttcaagggcatccagcacctcaccgccacggaggaggtggccgtccaggactggctggcccgcgtgggccgggagcgcctgtcccggatggcgatcagcggggacgactgcgtggtcaagccgctcgacgaccgcttcgcctccgccctgaccgccctgaacgacatgggcaaggtgcggaaggacatccagcagtgggagcccagccgcgggtggaacgactggacccaggtgcccttctgctcccaccacttccacgagctcatcatgaaggacggccgggtcctggtggtgccctgccgcaaccaggacgagctgatcgggcgggcccgcatcagccagggcgcgggctggtccctccgggagaccgcctgcctgggcaagagctacgcccagatgtggtccctgatgtacttccaccgccgggacctccgcctggccgccaacgcgatctgcagcgccgtcccgtcccactgggtgcccacgagccggaccacctggtccatccacgcccgccacgagtggatgaccaccgaggacatgctgacggtgtggaaccgggtctggatccaggagaacccctggatggaggacaagacccccgtggagagctgggaggagatcccgtacctcggcaagcgcgaggaccagtggtgcgggagcctgatcggcctgacctcccgcgccacctgggcgcggaacatccagacggccatcaaccaggtgcgcagcctcatcgggtccgaggagtacaccgactacatgcccagcatgaagcggttccgccgggaggaggaggaggccggcgtcctgtggtga

SEQ ID NO: 9040 - RNA, 9876 nt, synthetic construct
  misc_feature 1..9876: note = derived and/or modified CDS sequence (opt1) from DENV-2__KF041237__SS-prME
  source 1..9876: mol_type = other RNA
accgcgggcgtgatcatcatgctgatccccaccgccatggcgttccacctcaccacccgcaacggggagccccacatgatcgtgagcaagcaggagaagggcaagtccctgctgttcaagaccgaggacggggtgaacatgtgcaccctcatggccatggacctgggcgagctgtgcgaggacaccatcacctacaactgccccctcctgcggcagaacgagcccgaggacatcgactgctggtgcaacagcacctccacctgggtgacctacgggacctgcaccgccaccggcgagcaccgccgggagaagcgcagcgtcgccctggtgccccacgtgggcatggggctcgagacccggaccgagacctggatgtccagcgagggcgcctggaagcacgcgcagcgcatcgagacctggatcctgcggcaccccgggttcaccatcatggccgccatcctggcctacaccatcggcaccacctacttccagcgcgtcctcatcttcatcctgctgacggcggtggccccctccatgaccatgcggtgcatcgggatcagcaaccgcgacttcgtggagggcgtctccggcgggagctgggtggacatcgtgctcgagcacggctcctgcgtcaccaccatggccaagaacaagcccacgctggacttcgagctgatcaagaccgaggccaagcagcccgccaccctccggaagtactgcatcgaggcgaagctgaccaacacgaccaccgccagccgctgcccgacccagggggagccctccctgaacgaggagcaggacaagcggttcgtgtgcaagcacagcatggtggaccgcggctggggcaacgggtgcggcctcttcgggaagggcgggatcgtcacgtgcgccatgttcacgtgcaagaagaacatggagggcaagatcgtgcagcccgagaacctggagtacaccatcgtggtcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccggaccggcctcgacttcaacgagatggtgctgctgcagatggagaacaaggcgtggctcgtgcaccgccagtggttcctggacctgcccctcccctggctgccgggcgccgacatccaggggtccaactggatccagaaggagaccctggtcaccttcaagaacccccacgccaagaagcaggacgtggtcgtgctcggcagccaggagggggccatgcacacggccctgaccggcgcgaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtggtgcgggtccagtacgagggggacggcagcccctgcaagatccccttcgagatcatggacctggagaagcgccacgtgctcggccggctgatcaccgtgaacccgatcgtcacggagaaggactcccccgtgaacatcgaggccgagccgcccttcggggacagctacatcatcatcggcgtggagccggggcagctgaagctctcctggttcaagaagggcagctccatcgggcagatgttcgagaccaccatgcgcggcgccaagcgcatggccatcctgggcgacaccgcgtgggacttcgggagcctgggcggggtcttcacgtccatcggcaaggccctccaccaggtgttcggggccatctacggcgccgcgttcagcggcgtgtcctggaccatgaagatcctgatcggggtcgtgatcacctggatcggcatgaacagccggtccaccagcctgtccgtgagcctggtcctcgtgggggtggtcacgctgtacctgggcgtgatggtgcaggccgactccgggtgcgtcgtgagctggaagaacaaggagctcaagtgcggcagcggcatcttcatcaccgacaacgtgcacacctggaccgagcagtacaagttccagcccgagtcccccagcaagctggcctccgccatccagaaggcccacgaggaggggatctgcggcatccgcagcgtcacgcggctggagaacctcatgtggaagcagatcacccccgagctgaaccacatcctgtccgagaacgaggtgaagctcagcatcatgaccggggacatcaagggcatcatgcaggcggggaagcgctccctgcggccgcagcccaccgagctgaagtacagctggaagacgtggggcaaggccaagatgctctccaccgagccccacaaccagaccttcctgatcgacggcccggagaccgccgagtgccccaacacgaaccgcgcctggaacagcctggaggtggaggactacgggttcggcgtcttcaccaccaacatctggctcaagctgaaggagcggcaggacgtgttctgcgactccaagctgatgagcgccgcgatcaaggacaaccgcgccgtgcacgccgacatggggtactggatcgagtccgccctcaacgacacctggaagatcgagaaggccagcttcatcgaggtcaagtcctgccactggcccaagagccacacgctgtggtccaacggcgtgctggagagcgagatgatcatccccaagaacttcgcgggcccggtgagccagcacaactaccggcccgggtaccacacccagaccgccggcccctggcacctcgggaagctggagatggacttcgacttctgcgagggcaccaccgtcgtggtgacggaggactgcgggaaccgcggcccctccctgcggaccaccaccgccagcggcaagctcatcacggagtggtgctgccgctcctgcaccctgccgcccctgcggtaccgcggggaggacggctgctggtacgggatggagatccggcccctcaaggagaaggaggagaacctggtcaacagcctggtgaccgccggccacgggcagatcgacaacttctccctcggcgtgctgggcatggcgctgttcctcgaggagatgctgcgcacccgggtcgggacgaagcacgccgtgctgctcgtggccgtcagcttcatgaccctgatcaccggcaacatgtccttccgcgacctggggcgggtgatggtgatggtcggcgccgccatgaccgacgacatcgggatgggcgtgacgtacctcgcgctgctggccgccttcaaggtgcgccccaccttcgccgccggcctcctgctgcgcaagctcaccagcaaggagctgatgatgaccacgatcgggatcgtcctgctctcccagagcaccaccccggagaccatcctggagctgacggacgcgctcgccctgggcatgatgatcctgaagatcgtgcggaacatggagaagtaccagctcgccgtcaccatcatggccatcctgtgcgtgcccaacgccgtgatcctgcagaacgcgtggaaggtctcctgcaccatcctcgccgccgtgagcgtgagccccctgctgctcaccagctcccagcagaaggccgactggatccccctggcgctgacgatcaaggggctcaacccgaccgccatcttcctgaccaccctgagccgcacgaacaagaagcggtcctggcccctcaacgaggccatcatggccgtcggcatggtgagcatcctggcctccagcctgctcaagaacgacatccccatgaccggccccctggtggccggcgggctgctcaccgtctgctacgtgctgaccgggcgcagcgccgacctggagctcgagcgggccgccgacgtgcgctgggaggaccaggccgagatctccgggagctccccgatcctgagcatcacgatctccgaggacgggagcatgtccatcaagaacgaggaggaggagcagaccctgaccatcctcatccggaccggcctgctggtcatcagcggcctcttccccgtgtccatccccatcacggcggccgcctggtacctgtgggaggtgaagaagcagcgcgccggggtcctgtgggacgtgcccagcccgccgcccgtgggcaaggccgagctcgaggacggggcgtaccggatcaagcagaagggcatcctggggtactcccagatcggcgccggcgtctacaaggaggggaccttccacaccatgtggcacgtgacccgcggcgccgtgctgatgcacaaggggaagcggatcgagccgagctgggccgacgtccgcaaggacctcatctcctacggcgggggctggaagctggagggcgagtggaaggagggggaggaggtccaggtgctggccctcgagcccggcaagaacccccgggcggtccagaccaagcccgggctgttcaagacgaacaccggcaccatcggggccgtgagcctggacttctccccgggcaccagcggctcccccatcgtggacaagaaggggaaggtcgtgggcctctacgggaacggcgtggtcacgcgcagcggcacctacgtgtccgccatcgcccagaccgagaagtccatcgaggacaaccccgagatcgaggacgacatcttccggaagaagcgcctgaccatcatggacctgcaccccggggcgggcaagacgaagcggtacctgccggccatcgtgcgcgaggccatcaagcgggggctccgcaccctgatcctggcccccacccgggtcgtggccgcggagatggaggaggccctccgcggcctgcccatccgctaccagacccccgccatccgggccgagcacacggggcgcgagatcgtggacctgatgtgccacgccaccttcaccatgcggctcctgagcccggtccgcgtgcccaactacaacctgatcatcatggacgaggcgcacttcaccgaccccgcctccatcgccgcccggggctacatcagcacgcgcgtggagatgggcgaggccgcggggatcttcatgaccgccacgccgcccggctcccgggaccccttcccccagagcaacgcccccatcatggacgaggagcgcgagatccccgagcggtcctggaacagcgggcacgagtgggtcaccgacttcaagggcaagacggtgtggttcgtgccctccatcaaggccgggaacgacatcgcggcctgcctccgcaagaacggcaagaaggtcatccagctgagccggaagaccttcgactccgagtacatcaagacccgcaccaacgactgggacttcgtggtgacgaccgacatcagcgagatgggcgccaacttcaaggccgagcgggtcatcgacccccgccggtgcatgaagcccgtgatcctgaccgacggggaggagcgcgtgatcctcgccggcccgatgcccgtcacccactccagcgcggcccagcggcgcgggcggatcggccgcaaccccaagaacgagaacgaccagtacatctacatgggggagcccctggagaacgacgaggactgcgcccactggaaggaggccaagatgctgctcgacaacatcaacacgccggagggcatcatcccctccatgttcgagcccgagcgcgagaaggtggacgccatcgacggcgagtaccggctgcgcggggaggcgcggaagaccttcgtggacctgatgcgccggggcgacctcccggtctggctggcctaccgcgtggccgccgaggggatcaactacgccgaccggcgctggtgcttcgacggcatcaagaacaaccagatcctggaggagaacgtcgaggtggagatctggaccaaggagggggagcggaagaagctcaagccccgctggctggacgcgcggatctacagcgaccccctggccctcaaggagttcaaggagttcgccgccggccgcaagtccctgaccctgaacctcatcacggagatgggccggctgcccaccttcatgacccagaaggcgcgcaacgccctggacaacctcgccgtgctgcacaccgccgaggccgggggccgggcgtacaaccacgccctgagcgagctcccggagacgctggagaccctgctcctgctgaccctcctggccaccgtcaccgggggcatcttcctgttcctcatgtccggcaaggggatcggcaagatgaccctggggatgtgctgcatcatcaccgccagcatcctgctctggtacgcccagatccagccccactggatcgcggcctccatcatcctggagttcttcctgatcgtgctcctgatccccgagcccgagaagcagcgcaccccgcaggacaaccagctgacctacgtggtcatcgccatcctcacggtggtggccgccaccatggcgaacgagatgggcttcctggagaagaccaagaaggacttcgggctgggcagcatcgccacccagcagcccgagagcaacatcctcgacatcgacctgcggcccgcctccgcctggacgctgtacgccgtcgcgaccaccttcatcacccccatgctccgccacagcatcgagaactccagcgtgaacgtgtccctgacggccatcgccaaccaggccaccgtcctgatgggcctcgggaagggctggccgctgagcaagatggacatcggggtgcccctgctcgcgatcggctgctactcccaggtgaaccccatcaccctgaccgccgccctgctcctgctggtcgcccactacgccatcatcgggcccggcctccaggcgaaggccacgcgggaggcccagaagcgcgccgccgcgggcatcatgaagaacccgaccgtggacgggatcaccgtgatcgacctggaccccatcccctacgaccccaagttcgagaagcagctgggccaggtcatgctcctggtgctgtgcgtgacccaggtcctcatgatgcggacgacctgggccctgtgcgaggccctgaccctcgccaccgggccgatcagcacgctgtgggagggcaaccccgggcgcttctggaacaccaccatcgccgtgtccatggcgaacatcttccgcggcagctacctggccggcgccgggctcctgttctccatcatgaagaacaccacgaacacccggcgcggcaccgggaacaccggcgagacgctgggcgagaagtggaagaaccggctcaacagcctggggaagtccgagttccagatctacaagcgcagcggcatccaggaggtggaccggaccctggccaaggaggggatcaagcgcggcgagaccgaccaccacgcggtctcccgggggagcgccaagctccgctggttcgtggagcggaacctggtgacccccgagggcaaggtcgtggacctgggctgcgggcgcggcgggtggtcctactactgcggcgggctcaagaacgtgcgggaggtcaagggcctgacgaagggcgggcccggccacgaggagccgatccccatgagcacctacgggtggaacctggtgcgcctccagtccggcgtggacgtcttcttcacgccgcccgagaagtgcgacaccctgctgtgcgacatcggggagagcagcccgaaccccacggtggaggccggccggaccctccgcgtgctgaacctggtcgagaactggctcaacaacaacacccagttctgcatcaaggtgctgaacccctacatgccgtccgtgatcgagaagatggagaccctgcagcggaagtacggcggggccctggtccgcaaccccctcagccggaactccacccacgagatgtactgggtgagcaacgcctccggcaacatcgtgagctccgtcaacatgatcagccgcatgctgatcaaccggttcacgatgcgccacaagaaggcgacctacgagcccgacgtggacctggggtccggcacccgcaacatcgggatcgagagcgagacccccaacctcgacatcatcggcaagcggatcgagaagatcaagcaggagcacgagacgtcctggcactacgaccaggaccacccgtacaagacctgggcctaccacggcagctacgagaccaagcagaccgggtccgccagctccatggtgaacggcgtcgtgcgcctgctgacgaagccctgggacgtgatccccatggtcacccagatggccatgaccgacaccacgcccttcgggcagcagcgggtgttcaaggagaaggtggacacccgcacccaggagccgaaggagggcaccaagaagctcatgaagatcacggccgagtggctgtggaaggagctgggcaagaagaagacgccccggatgtgcacccgcgaggagttcgcgcggaaggtccgcagcaacgccgccctcggggccatcttcaccgacgagaacaagtggaagtccgcccgggaggcggtggaggacagccgcttctgggagctggtcgacaaggagcggaacctgcacctcgagggcaagtgcgagacgtgcgtgtacaacatgatggggaagcgcgagaagaagatcggcgagttcgggaaggccaagggctcccgggccatctggtacatgtggctgggcgcccgcttcctggagttcgaggcgctcgggttcctgaacgaggaccactggttcagccgggagaacagcctgtccggcgtggagggggagggcctccacaagctggggtacatcctgcgcgaggtcagcaagaaggagggcggcgccatgtacgccgacgacaccgccgggtgggacacccggatcaccctcgaggacctgaagaacgaggagatggtgacgaaccacatggagggcgagcacaagaagctggccgaggcgatcttcaagctcacctaccagaacaaggtggtccgcgtgcagcggcccacgccccgcgggaccgtgatggacatcatctcccggcgcgaccagcgcggcagcgggcaggtcggcacgtacggcctgaacaccttcaccaacatgggggcccagctgatccggcagatggagggcgagggggtgttcaagggcatccagcacctcaccgccacggaggaggtggccgtccaggactggctggcccgcgtgggccgggagcgcctgtcccggatggcgatcagcggggacgactgcgtggtcaagccgctcgacgaccgcttcgcctccgccctgaccgccctgaacgacatgggcaaggtgcggaaggacatccagcagtgggagcccagccgcgggtggaacgactggacccaggtgcccttctgctcccaccacttccacgagctcatcatgaaggacggccgggtcctggtggtgccctgccgcaaccaggacgagctgatcgggcgggcccgcatcagccagggcgcgggctggtccctccgggagaccgcctgcctgggcaagagctacgcccagatgtggtccctgatgtacttccaccgccgggacctccgcctggccgccaacgcgatctgcagcgccgtcccgtcccactgggtgcccacgagccggaccacctggtccatccacgccggccacgagtggatgaccaccgaggacatgctgacggtgtggaaccgcgtctggatccaggagaacccctggatggaggacaagacccccgtggagagctgggaggagatcccgtacctcgggaagcgggaggaccagtggtgcggcagcctgatcgggctgacctcccgcgccacctgggcgcgcaacatccagacggccatcaaccaggtgcggagcctcatcggctccgaggagtacaccgactacatgcccagcatgaagcgcttccggcgcgaggaggaggaggccggcgtcctgtggtga

SEQ ID NO: 9041 - RNA, 9876 nt, synthetic construct
  misc_feature 1..9876: note = derived and/or modified CDS sequence (opt1) from DENV-2__KM217156__SS-prME
  source 1..9876: mol_type = other RNA
accgccggggtgatcatcatgctgatccccaccgccatggcgttccacctcaccacccgcaacggggagccccacatgatcgtcagcaagcaggagaaggggaagtccctgctgttcaagaccgaggacggggtgaacatgtgcaccctcatggccatggacctgggcgagctgtgcgaggacaccatcacctacaactgccccctcctgcggcagaacgagcccgaggacatcgactgctggtgcaacgccacctccacctgggtgacctacgggacctgcaccgccaccggcgagcaccgccgggagaagcgctccgtcgccctggtgccccacgtgggcatggggctcgagacccggaccgagacctggatgagctccgagggcgcgtggaagcacgcccagcgcatcgagacctggatcctgcggcacccggggttcaccatcatggccgccatcctggcgtacaccatcggcaccacctacttccagcgcgtcctcatcttcatcctgctgacggccgtggcccccagcatgaccatgcggtgcatcgggatctccaaccgcgacttcgtggagggcgtcagcggcgggtcctgggtggacatcgtgctcgagcacggcagctgcgtcaccaccatggccaagaacaagcccacgctggacttcgagctgatcaagaccgaggccaagcagcccgcgaccctccggaagtactgcatcgaggccaagctgaccaacacgaccaccgcctcccgctgcccgacccagggggagcccagcctgaacgaggagcaggacaagcggttcgtgtgcaagcactccatggtggaccgcggctggggcaacgggtgcggcctcttcgggaagggcgggatcgtcacgtgcgccatgttcacgtgcaagaagaacatggagggcaagatcgtgcagcccgagaacctggagtacaccatcgtggtcacgccccacagcggcgaggagaacgccgtggggaacgacacgggcaagcacgggaaggagatcaaggtgaccccgcagtccagcatcaccgaggcggagctgaccggctacgggaccgtcacgatggagtgcagcccccggaccggcctcgacttcaacgagatggtgctgctgcagatggagaacaaggcctggctcgtgcaccgccagtggttcctggacctgcccctcccctggctgccgggcgccgacatccaggggagcaactggatccagaaggagaccctggtcaccttcaagaacccccacgccaagaagcaggacgtggtcgtgctcggctcccaggagggggccatgcacacggcgctgaccggcgccaccgagatccagatgagcagcgggaaccccctgttcaccggccacctcaagtgccggctgcgcatggacaagctgcagctcaagggcatgtcctacagcatgtgcacggggaagttcaaggtggtcaaggagatcgccgagacccagcacggcaccatcgtggtgcggatccagtacgagggggacggctccccctgcaagatcccgttcgagatcatggacctggagaagcgccacgtcctgggccggctcatcaccgtgaaccccatcgtgacggagaaggacagccccgtcaacatcgaggccgagcccccgttcggggactcctacatcatcatcggcgtggagcccgggcagctgaagctgagctggttcaagaagggctccagcatcgggcagatgttcgagaccaccatgcgcggcgccaagcgcatggcgatcctcggcgacaccgcctgggacttcgggtccctgggcggggtgttcacgagcatcggcaaggccctgcaccaggtcttcggggccatctacggcgcggccttctccggcgtgagctggaccatgaagatcctcatcggggtggtcatcacctggatcggcatgaactcccggagcacctccctgagcgtgtccctggtgctggtcggggtggtgacgctctacctgggcgtcatggtgcaggccgacagcgggtgcgtggtctcctggaagaacaaggagctgaagtgcggcagcggcatcttcttcaccgacaacgtgcacacctggaccgagcagtacaagttccagcccgagagcccctccaagctcgccagcgccatccagaaggcgcacgaggaggggatctgcggcatccgctccatcacgcggctggacaacctgatgtggaagcagatcaccccggagctcaaccacatcctgagcgagaacgaggtgaagctgtccatcatgaccggggacatcaagggcatcatgcaggccgggaagcgcagcctccggccccagcccaccgagctgaagtactcctggaagacgtggggcaaggccaagatgctgagcaccgagccgcacaaccagaccttcctcatcgacggccccgagaccgcccagtgccccaacacgaaccgcgcctggaactccctggaggtcgaggactacgggttcggcgtgttcaccaccaacatctggctgaagctcaaggagcggcaggacgtgttctgcgacagcaagctgatgtccgcggccatcaaggacaaccgcgccgtccacgccgacatggggtactggatcgagagcgccctgaacgacacctggaagatcgagaaggcgtccttcatcgaggtcaagagctgccactggcccaagtcccacacgctctggagcaacggcgtgctggagtccgagatgatcatcccgaagaacttcgccggccccgtgagccagcacaactaccggcccgggtaccacacccagaccgccggcccctggcacctggggaagctcgagatggacttcgacttctgcgagggcaccaccgtggtggtcacggaggactgcgggaaccgcggcccgagcctgcggaccaccaccgcctccggcaagctgatcacggagtggtgctgccgcagctgcaccctgccgcccctccggtaccgcggggaggacggctgctggtacgggatggagatccggcccctgaaggagaaggaggagaacctcgtgaactccctggtgaccgcgggccacgggcagatcgacaacttcagcctgggcgtcctcggcatggccctgttcctggaggagatgctccgcacccgggtggggacgaagcacgccgtgctgctggtcgccgtgtccttcatgaccctcatcaccggcaacatgagcttccgcgacctggggcgggtgatggtcatggtgggcgccgcgatgaccgacgacatcgggatgggcgtgacgtacctggccctcctggccgccttcaaggtccgcccgaccttcgccgcgggcctgctcctgcgcaagctgacctccaaggagctcatgatgaccacgatcgggatcgtgctgctgagccagtccaccacccccgagaccatcctcgagctgacggacgccctggccctcggcatgatgatcctgaagatcgtgcggaacatggagaagtaccagctggccgtcaccatcatggccatcctctgcgtgcccaacgcggtcatcctgcagaacgcctggaaggtgagctgcaccatcctggccgccgtgtccgtcagccccctcctgctgacctccagccagcagaaggcggactggatcccgctcgccctgacgatcaaggggctgaaccccaccgccatcttcctcaccaccctgtcccgcacgaacaagaagcggagctggcccctgaacgaggccatcatggccgtgggcatggtgtccatcctcgcgagctccctgctgaagaacgacatccccatgaccggcccgctcgtcgccgggggcctgctgaccgtgtgctacgtgctcaccgggcgcagcgccgacctggagctggagcgggccgccgacgtccgctgggaggaccaggcggagatcagcggctccagccccatcctctccatcacgatcagcgaggacgggtccatgagcatcaagaacgaggaggaggagcagaccctgaccatcctgatccggaccggcctcctggtgatctccggcctgttccccgtgagcatccccatcacggccgccgcctggtacctctgggaggtcaagaagcagcgcgccggggtgctgtgggacgtgccgagcccgccgcccgtcggcaaggcggagctggaggacggggcctaccggatcaagcagaagggcatcctcgggtacagccagatcggcgccggcgtgtacaaggaggggaccttccacaccatgtggcacgtgacccgcggcgccgtcctgatgcacaaggggaagcggatcgagccctcctgggccgacgtgcgcaaggacctgatcagctacggcgggggctggaagctcgagggcgagtggaaggagggggaggaggtgcaggtcctggcgctggagcccggcaagaacccccgggccgtgcagaccaagcccggcctgttcaagacgaacaccggcaccatcggggccgtgtccctggacttcagccccggcacctccggcagccccatcgtcgacaagaaggggaaggtggtgggcctgtacgggaacggcgtcgtgacgcgctccggcacctacgtgagcgccatcgcgcagaccgagaagtccatcgaggacaaccccgagatcgaggacgacatcttccggaagaagcgcctcaccatcatggacctgcacccgggggccggcaagacgaagcggtacctgcccgccatcgtccgcgaggccatcaagcgggggctgcgcaccctcatcctggcccccacccgggtggtggcggccgagatggaggaggccctgcgcggcctccccatccgctaccagaccccggccatccgggccgagcacacggggcgcgagatcgtcgacctgatgtgccacgcgaccttcaccatgcggctgctcagccccgtgcgcgtgcccaactacaacctgatcatcatggacgaggcccacttcaccgaccccgccagcatcgccgcccggggctacatctccacgcgcgtcgagatgggcgaggcggccgggatcttcatgaccgccaccccgcccggcagccgggaccccttcccccagtccaacgccccgatcatggacgaggagcgcgagatccccgagcggagctggaactccgggcacgagtgggtgaccgacttcaagggcaagacggtgtggttcgtccccagcatcaaggcggggaacgacatcgccgcctgcctgcgcaagaacggcaagaaggtgatccagctctcccggaagaccttcgacagcgagtacatcaagacccgcaccaacgactgggacttcgtggtcacgaccgacatctccgagatgggcgccaacttcaaggccgagcgggtgatcgacccccgccggtgcatgaagccggtgatcctgaccgacggggaggagcgcgtcatcctggcgggccccatgcccgtgacccacagctccgccgcccagcggcgcgggcggatcggccgcaaccccaagaacgagaacgaccagtacatctacatgggggagccgctcgagaacgacgaggactgcgcccactggaaggaggccaagatgctgctggacaacatcaacacgcccgagggcatcatccccagcatgttcgagccggagcgcgagaaggtggacgcgatcgacggcgagtaccggctccgcggggaggcccggaagaccttcgtcgacctgatgcgccggggcgacctgcccgtgtggctcgcctaccgcgtggccgccgaggggatcaactacgcggaccggcgctggtgcttcgacggcatcaagaacaaccagatcctggaggagaacgtcgaggtggagatctggaccaaggagggggagcggaagaagctgaagccccgctggctcgacgcccggatctactccgaccccctggccctgaaggagttcaaggagttcgccgcggcccgcaagagcctcaccctgaacctgatcacggagatgggccggctcccgaccttcatgacccagaaggcccgcaacgccctggacaacctggccgtcctccacaccgcggaggccggcgggcgggcctacaaccacgccctgtccgagctgcccgagacgctcgagaccctgctgctcctgaccctgctcgccaccgtgacgggcgggatcttcctgttcctgatgagcggcaagggcatcgggaagatgaccctcggcatgtgctgcatcatcaccgcgtccatcctgctgtggtacgcccagatccagccccactggatcgccgccagcatcatcctcgagttcttcctgatcgtgctgctcatccccgagccggagaagcagcgcacgccccaggacaaccagctgacctacgtcgtgatcgccatcctgacggtggtcgcggccaccatggccaacgagatggggttcctcgagaagaccaagaaggacttcggcctggggtccatcgccacccagcagcccgagagcaacatcctggacatcgacctccggcccgccagcgcgtggacgctgtacgccgtggccaccaccttcatcaccccgatgctgcgccactccatcgagaacagctccgtgaacgtcagcctcacggccatcgcgaaccaggccaccgtgctgatgggcctgggcaaggggtggcccctctccaagatggacatcggcgtgcccctgctggccatcgggtgctacagccaggtcaaccccatcaccctcaccgccgccctgctgctcctggtggcgcactacgccatcatcggcccggggctgcaggccaaggcctcccgggaggcccagaagcgcgcggccgccggcatcatgaagaaccccacggtggacggcatcaccgtcatcgacctcgaccccatcccctacgacccgaagttcgagaagcagctgggccaggtgatgctgctcatcctgtgcgtgacccaggtcctgatgatgcggaccacgtgggccctctgcgaggccctgaccctggcgaccggccccatcagcaccctctgggaggggaaccccggccgcttctggaacacgaccatcgccgtgtccatggccaacatcttccgcgggagctacctggccggcgcgggcctcctcttctccatcatgaagaacaccaccaacacgcggcgcgggaccggcaacaccggggagaccctgggcgagaagtggaagaaccgggtgagcctgctcggcaagtccgagttccagatctacaagcgcagcgggatccaggaggtcgaccggacgctggccaaggagggcatcaagcgcggggagaccgaccaccacgccgtgtcccggggcagcgccaagctgcgctggttcgtggagcggaacctcgtcacccccgaggggaaggtggtggacctgggctgcggccgcgggggctggtcctactactgcgggggcctgaagaacgtccgggaggtgaaggggctcaccaagggcggcccggggcacgaggagcccatccccatgagcacgtacggctggaacctggtgcgcctgctcaccggggccgacgtcttcttcacgcccccggagaagtgcgacaccctgctgtgcgacatcggcgagtccagccccaaccccacggtggaggcggggcggaccctccgcgtgctgaacctggtcgagaactggctcaacaacaacacccagttctgcatcaaggtgctgaacccgtacatgcccagcgtgatcgagaagatggagaccctgcagcggaagtacggcggcgccctggtccgcaaccccctctcccggaacagcacccacgagatgtactgggtgtccaacgccagcgggaacatcgtgtccagcgtcaacatgatctcccgcatgctgatcaaccggttcacgatgcgccacaagaaggccacctacgaccccgacgtggacctgggcagcgggacccgcaacatcggcatcgagtccgagaccccgaacctcgacatcatcgggaagcggatcgagaagatcaagcaggagcacgagacgagccgccactacgaccaggaccacccctacaagacctgggcctaccacggctcctacgagaccaagcagaccggcagcgcgtccagcacggtgaacggggtcgtgcggctgctgaccaagccctgggacgtgatccccatggtcacccagatggccatgaccgacacgaccccgttcggccagcagcgcgtgttcaaggagaaggtggacacccggacccaggagcccaaggaggggacgaagaagctcatgaagatcaccgccgagtggctgtggaaggagctgggcaagaagaagacgccccgcatgtgcacccgggaggagttcgcccgcaaggtccggtccaacgccgcgctcggcgccatcttcacggacgagaacaagtggaagtccgcccgcgaggccgtggaggactcccggttctgggagctggtggacaaggagcgcaacctgcacctcgaggggaagtgcgagacctgcgtctacaacatgatgggcaagcgggagaagaagatcggggagttcggcaaggcgaaggggagccgcgccatctggtacatgtggctgggcgcccggttcctggagttcgaggccctcggcttcctgaacgaggaccactggttctcccgcgagaacagcctgagcggggtggagggcgaggggctccacaagctgggctacatcctgcgggaggtctccaagaaggagggcggggccatgtacgcggacgacaccgccggctgggacacccgcatcacgctcgaggacctgaagaacgaggagatggtgaccaaccacatggagggggagcacaagaagctggccgaggccatcttcaagctcacctaccagaacaaggtggtccgggtgcagcgccccaccccgcggggcacggtgatggacatcatcagccgccgcgaccagcgggggtccgtccaggtgggcacctacgggctgggcaccttcaccaacatgggcgcccagctgatccgccagatggagggggagggcgtgttcaaggggatccagcacctcacggcgaccgaggaggtcgccgtgcaggactggctggcccgggtgggccgcgagcggctgagccgcatggccatctccggcgacgactgcgtcgtgaagcccctcgacgaccggttcgccagcgcgctgaccgccctgaacgacatggggaaggtgcgcaaggacatccagcagtgggagccctcccggggctggaacgactggacccaggtccccttctgcagccaccacttccacgagctcatcatgaaggacgggcgcgtgctggtggtcgcctgccggaaccaggacgagctgatcggccgcgcccggatctcccagggggccggctggagcctccgcgagacggcgtgcctgggcaagtcctacgcccagatgtggagcctgatgtacttccaccggcgcgacctccggctggccgccaacgcgatctgctccgccgtgccgagccactgggtgcccacctcccgcaccacctggagcatccacgccgggcacgagtggatgaccacggaggacatgctgaccgtctggaaccgggtgtggatccaggagaacccctggatggaggacaagacccccgtggagtcctgggaggagatcccgtacctcggcaagcgcgaggaccagtggtgcgggagcctgatcggcctgaccagccgcgccacgtgggcccggaacatccagaccgcgatcaaccaggtccgctccctcatcgggagcgaggagtacaccgactacatgccctccatgaagcggttcggccgcgaggaggaggaggccggcgtgctgtggtga

SEQ ID NO: 9042 - RNA, 9876 nt, synthetic construct
  misc_feature 1..9876: note = derived and/or modified CDS sequence (opt1) from DENV-2__KX380809__SS-prME
  source 1..9876: mol_type = other RNA
accgccgggatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcaccgtgatggcggccatcctggcctacaccatcggcaccacctacttccagcgggtgctgatcttcatcctcctgaccgccgtcgcgccctccatgaccatgcgctgcatcgggatcagcaaccgggacttcgtggagggcgtgtccggcgggagctgggtcgacatcgtgctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtctgcaagcacagcatggtggaccggggctggggcaacgggtgcggcctgttcgggaagggcgggatcgtgacgtgcgccatgttcacgtgcaagaagaacatggagggcaagatcgtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgccacgatggagtgcagcccccgcaccggcctggacttcaacgagatggtgctcctgcagatggagaacaaggcgtggctggtgcaccggcagtggttcctcgacctgcccctgccctggctcccgggcgccgacacccaggggtccaactggatccagaaggagaccctggtcacgttcaagaacccccacgccaagaagcaggacgtggtcgtgctgggcagccaggagggggccatgcacaccgccctcaccggcgcgaccgagatccagatgagctccgggaacctgctgttcacgggccacctcaagtgccgcctgcggatggacaagctgcagctcaagggcatgagctactccatgtgcaccgggaagttcaaggtggtcaaggagatcgccgagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcgtgggacttcgggagcctgggcggggtgttcacctccatcggcaaggccctgcaccaggtcttcggggccatctacggcgccgcgttcagcggcgtgtcctggaccatgaagatcctcatcggggtggtcatcacctggatcggcatgaacagccgctccacgagcctgtccgtgagcctggtgctggtcgggatcgtgaccctctacctgggcgtgatggtccaggccgactccgggtgcgtggtgagctggaagaacaaggagctgaagtgcggcagcggcatcttcatcaccgacaacgtccacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtgaagctgaccatcatgacgggggacatcaagggcatcatgcaggcggggaagcggagcctccgcccgcagcccaccgagctgaagtactcctggaaggcctggggcaaggccaagatgctgagcaccgagctccacaaccacaccttcctgatcgacggccccgagacggccgagtgcccgaacaccaaccgggcctggaactccctggaggtcgaggactacgggttcggcgtgttcaccaccaacatctggctcaagctgaaggagcgccaggacgtgttctgcgacagcaagctgatgtccgcggccatcaaggacaaccgggccgtccacgccgacatggggtactggatcgagagcgccctcaacgacacgtggaagatcgagaaggcgtccttcatcgaggtcaagagctgccactggcccaagtcccacaccctgtggagcaacggcgtgctggagtccgagatgatcatccccaagaacttcgccggccccgtgagccagcacaactaccgcccggggtaccacacccagaccgccggcccctggcacctcgggcggctggagatggacttcgacttctgcgagggcaccacggtggtggtcaccgaggactgcgggaaccgcggccccagcctgcggaccaccacggcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtgaccgcgggccacgggcagatcgacaacttcagcctcggcgtcctgggcatggccctgttcctcgaggagatgctgcgcacgcgggtggggaccaagcacgccatcctgctcgtggccgtctccttcgtgaccctgatcaccggcaacatgagcttccgcgacctggggcgcgtgatggtcatggtgggcgccacgatgaccgacgacatcgggatgggcgtgacctacctcgcgctgctggccgccttcaaggtccggcccaccttcgccgccggcctcctgctgcgcaagctcacgtccaaggagctgatgatgaccaccatcgggatcgtgctgctcagccagtccaccatccccgagacgatcctggagctgaccgacgcgctcgccctgggcatgatggtgctgaagatcgtccggaacatggagaagtaccagctcgccgtgaccatcatggccatcctgtgcgtcccgaacgccgtgatcctgcagaacgcgtggaaggtgagctgcaccatcctcgccgtcgtgtccgtgagccccctgctgctcacgtccagccagcagaaggccgactggatccccctggccctgaccatcaaggggctcaaccccaccgcgatcttcctgaccacgctgtcccgcaccagcaagaagcggtcctggccgctcaacgaggccatcatggccgtcggcatggtgagcatcctggcctccagcctgctcaagaacgacatccccatgaccggccccctggtggccgggggcctgctcaccgtctgctacgtgctgacggggcgcagcgcggacctggagctcgagcgggccgccgacgtgcgctgggaggagcaggccgagatctccggcagctcccccatcctgagcatcaccatctccgaggacgggagcatgtccatcaagaacgaggaggaggagcagaccctgaccatcctcatccggacgggcctgctggtcatcagcggcctcttcccggtgtccatccccatcaccgccgcggcctggtacctgtgggaggtgaagaagcagcgcgccggggtcctgtgggacgtgcccagcccgccgcccgtgggcaaggccgagctcgaggacggggcctaccggatcaagcagaagggcatcctggggtactcccagatcggcgcgggcgtctacaaggaggggaccttccacaccatgtggcacgtgacccgcggcgccgtgctgatgcacaaggggaagcggatcgagcccagctgggccgacgtcaagaaggacctcatctcctacggcgggggctggaagctggagggcgagtggaaggagggggaggaggtccaggtgctggccctcgagcccggcaagaacccccgcgccgtccagacgaagcccgggctgttcaagaccaacaccggcaccatcggggcggtgagcctggacttctcccccggcacgagcggctcccccatcgtggacaagaaggggaaggtcgtgggcctctacgggaacggcgtggtcacccggagcggcacctacgtgtccgccatcgcccagaccgagaagtccatcgaggacaaccccgagatcgaggacgacatcttccgcaagaagcggctgacgatcatggacctgcaccccggggccggcaagaccaagcgctacctgcccgcgatcgtgcgggaggccatcaagcgcgggctccggaccctgatcctggccccgacccgcgtcgtggccgccgagatggaggaggcgctccgcggcctgcccatccggtaccagacgcccgccatccgcgccgagcacaccgggcgggagatcgtggacctgatgtgccacgccaccttcaccatgcgcctcctgagccccatccgggtcccgaactacaacctgatcatcatggacgaggcccacttcacggaccccgcgtccatcgccgcccgcggctacatcagcacccgggtggagatgggcgaggccgccgggatcttcatgaccgcgacgccgcccggctcccgcgacccgttcccccagagcaacgcccccatcatggacgaggagcgggagatccccgagcgctcctggaacagcgggcacgagtgggtgacggacttcaagggcaagaccgtctggttcgtgccgtccatcaaggccgggaacgacatcgccgcgtgcctccggaagaacggcaagaaggtgatccagctgagccgcaagaccttcgactccgagtacatcaagacccggacgaacgactgggacttcgtcgtgaccaccgacatcagcgagatgggcgccaacttcaaggccgagcgcgtgatcgacccccggcgctgcatgaagcccgtcatcctgaccgacggggaggagcgggtgatcctcgccggccccatgccggtgacgcactccagcgccgcgcagcgccgggggcgcgtcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgccatcgacggcgagtaccgcctgcgcggggaggcccgcaagaccttcgtggacctgatgcggcgcggcgacctccccgtctggctggcgtaccgggtggccgccgaggggatcaactacgccgaccgccggtggtgcttcgacggcgtcaagaacaaccagatcctggaggagaacgtggaggtggagatctggaccaaggagggggagcgcaagaagctcaagccgcggtggctggacgcccgcatctacagcgaccccctggcgctcaaggagttcaaggagttcgccgccggccggaagtccctgacgctgaacctcatcaccgagatgggccgcctgcccaccttcatgacccagaaggcccggaacgcgctggacaacctcgccgtcctgcacacggccgaggccgggggccgcgcctacaaccacgcgctgagcgagctccccgagaccctggagaccctgctcctgctgaccctcctggccacggtgaccgggggcatcttcctgttcctcatgtccggcaaggggatcggcaagatgaccctggggatgtgctgcatcatcaccgccagcatcctgctctggtacgcccagatccagccgcactggatcgccgcgtccatcatcctggagttcttcctgatcgtgctcctgatccccgagcccgagaagcagcggacgccccaggacaaccagctgacgtacgtcgtgatcgccatcctcaccgtggtcgccgccaccatggccaacgagatgggcttcctggagaagaccaagaaggacttcgggctgggcagcatcacgacccagcagccggacagcaacatcctcgacatcgacctgcgccccgcgtccgcctggaccctgtacgccgtggccaccacgttcatcacccccatgctccggcacagcatcgagaactccagcgtgaacgtctccctgaccgccatcgcgaaccaggccaccgtgctgatgggcctcgggaagggctggcccctgagcaagatggacatcggggtgccgctgctcgccatcggctgctactcccaggtcaaccccatcacgctgaccgccgcgctgctcctgctggtggcccactacgccatcatcgggcccggcctccaggccaaggccacccgcgaggcgcagaagcgggccgccgccggcatcatgaagatccccaccgtggacgggatcacggtcatcgacctggacccgatcccctacgaccccaagttcgagaagcagctgggccaggtgatgctcctggtgctgtgcgtcacccaggtgctcatgatgcgcaccacctgggccctgtgcgaggcgctgacgctcgccaccgggcccatcagcaccctgtgggagggcaacccggggcgcttctggaacaccacgatcgccgtgtccatggccaacatcttccggggcagctacctggccggcgcggggctcctgttctccatcatgaagaacaccgccaacacccgccggggcaccgggaacacgggcgagaccctgggcgagaagtggaagaaccgcctcaacgccctgggcaagagcgagttccagatctacaagaagtccggcatccaggaggtcgaccggaccctggccaaggaggggatcaagcgcggcgagaccgaccaccacgcggtgagccgggggtccgccaagctccgctggttcgtggagcggaacctggtcacgcccgagggcaaggtggtggacctgggctgcgggcgcggcgggtggagctactactgcggcgggctcaagaacgtcaaggaggtgaagggcctgaccaagggcgggcccggccacgaggagcccatcccgatgtccacctacgggtggaacctggtgcggctccagagcggcgtcgacgtgttcttcacgccgcccgagaagtgcgacacgctgctgtgcgacatcggggagtccagccccaacccgaccgtggaggccggccgcaccctccgggtcctgaacctggtggagaactggctcaacaacaacacccagttctgcatcaaggtgctgaacccctacatgcccagcgtcatcgagaagatggaggccctgcagcgcaagtacggcggggccctggtgcggaacccgctctcccgcaacagcacccacgagatgtactgggtgtccaacgcgagcggcaacatcgtctccagcgtgaacatgatctcccggatgctgatcaaccgcttcacgatgaagcacaagaaggccacctacgagcccgacgtggacctggggagcggcacccggaacatcgggatcgagtccgagacccccaacctcgacatcatcggcaagcgcatcgagaagatcaagcaggagcacgagacgagctggcactacgaccaggaccacccctacaagacctgggcctaccacggctcctacgagaccaagcagaccgggagcgcctccagcatggtcaacggcgtggtgcgcctgctgacgaagccgtgggacgtcatccccatggtgacccagatggccatgaccgacaccacgcccttcgggcagcagcgggtgttcaaggagaaggtcgacacccgcacccaggagcccaaggagggcaccaagaagctcatgaagatcacggcggagtggctgtggaaggagctgggcaagaagaagaccccgcggatgtgcacccgcgaggagttcacccggaaggtgcgctccaacgccgccctcggggccatcttcacggacgagaacaagtggaagtccgcccgggaggcggtcgaggactccggcttctgggagctggtggacaaggagcgcaacctgcacctcgaggggaagtgcgagacctgcgtgtacaacatgatgggcaagcgggagaagaagctgggggagttcggcaaggccaagggcagccgcgccatctggtacatgtggctgggggcccggttcctcgagttcgaggcgctgggcttcctgaacgaggaccactggttctcccgcgagaacagcctcagcggggtcgagggcgaggggctgcacaagctgggctacatcctccgggacgtgtccaagaaggagggcggggccatgtacgccgacgacaccgccggctgggacacccgcatcacgctggaggacctgaagaacgaggagatggtgaccaaccacatggagggggagcaccggaagctcgccgaggcgatcttccgcctgacctaccagaacaaggtcgtgcgggtgcagcgccccacgccccggggcacggtcatggacatcatcagccgccgggaccagcgcgggtccggccaggtggtgacctacggcctgaacaccttcaccaacatggaggcccagctcatccgccagatggagggggagggcgtcttcaagagcatccagcacctgacggtgaccgaggagatcgccgtgaagaactggctggagcgggtcgggcgcgagcggctctcccgcatggccatcagcggcgacgactgcgtggtgaagcccctggacgaccggttcgcctccgcgctgaccgccctcaacgacatgggcaaggtccgcaaggacatccagcagtgggagccgagccgggggtggaacgactggacccaggtgcccttctgctcccaccacttccacgagctgatcatgaaggacggccgcgtgctggtcgtgccctgccggaaccaggacgagctcatcgggcgcgcccggatcagccagggcgccgggtggtccctgcgcgagacggcctgcctgggcaagagctacgcgcagatgtggtccctcatgtacttccaccggcgcgacctgcggctggccgccaacgccatctgcagcgccgtgccctcccactgggtcccgaccagccgcaccacctggtccatccacgcgacccacgagtggatgacgaccgaggacatgctcaccgtgtggaaccgggtgtggatccaggagaacccctggatggaggacaagacccccgtcgagagctgggaggagatcccctacctgggcaagcgcgaggaccagtggtgcgggagcctgatcggcctcacgtcccgggccacctgggccaagaacatccagaccgccatcaaccaggtgcgcagcctgatcgggaacgaggagtacaccgactacatgccgtccatgaagcgcttccggcgcgaggaggaggaggcgggcgtgctgtggtga

SEQ ID NO: 9043 - RNA, 9876 nt, synthetic construct
  misc_feature 1..9876: note = derived and/or modified CDS sequence (opt1) from DENV-2__KX380810__SS-prME
  source 1..9876: mol_type = other RNA
accgccggcatcatcatcatgatgatccccaccgtgatggccttccacctgaccacccgcaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcaccgtgatggcggccatcctggcctacaccatcggcaccacctacttccagcgggtgctgatcttcatcctcctgacggccgtcgcgccctccatgaccatgcgctgcatcgggatcagcaaccgggacttcgtggagggcgtgtccggcgggagctgggtcgacatcgtgctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtctgcaagcacagcatggtggaccggggctggggcaacgggtgcggcctgttcgggaagggcgggatcgtgacgtgcgccatgttcacgtgcaagaagaacatggagggcaagatcgtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgccacgatggagtgcagcccccgcaccggcctggacttcaacgagatggtgctcctgcagatggagaacaaggcgtggctggtgcaccggcagtggttcctcgacctgcccctgccctggctcccgggcgccgacacccaggggtccaactggatccagaaggagaccctggtcacgttcaagaacccccacgccaagaagcaggacgtggtcgtgctgggcagccaggagggggccatgcacaccgccctcaccggcgcgaccgagatccagatgagctccgggaacctgctgttcacgggccacctcaagtgccgcctgcggatggacaagctgcagctcaagggcatgagctactccatgtgcaccgggaagttcaaggtggtcaaggagatcgccgagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgggaaggactcccccgtcaacatcgaggccgagccgcccttcggcgacagctacatcatcatcggggtggagccgggccagctgaagctgtcctggttcaagaaggggagctccatcggccagatgttcgagaccaccatgcgcggcgccaagcggatggccatcctcggggacacggcgtgggacttcggcagcctcggcggggtgttcacctccatcgggaaggccctgcaccaggtcttcggggccatctacggcgccgcgttcagcggggtgtcctggaccatgaagatcctcatcggcgtggtcatcacctggatcgggatgaacagccgctccacgagcctgtccgtgagcctggtgctggtcggcatcgtgaccctctacctgggggtgatggtccaggccgactccggctgcgtggtgagctggaagaacaaggagctgaagtgcggcagcgggatcttcatcaccgacaacgtccacacctggacggagcagtacaagttccagcccgagtcccccagcaagctcgcctccgccatccagaaggcccacgaggagggcatctgcgggatccggagcgtgacccgcctggagaacctgatgtggaagcagatcacccccgagctcaaccacatcctgtccgagaacgaggtgaagctgaccatcatgacgggcgacatcaaggggatcatgcaggcgggcaagcggagcctccgcccgcagcccaccgagctgaagtactcctggaaggcctggggcaaggccaagatgctgagcaccgagctccacaaccacaccttcctgatcgacgggcccgagacggccgagtgcccgaacaccaaccgggcctggaactccctggaggtcgaggactacggcttcggggtgttcaccaccaacatctggctcaagctgaaggagcgccaggacgtgttctgcgacagcaagctgatgtccgcggccatcaaggacaaccgggccgtccacgccgacatgggctactggatcgagagcgccctcaacgacacgtggaagatcgagaaggcgtccttcatcgaggtcaagagctgccactggcccaagtcccacaccctgtggagcaacggcgtgctggagtccgagatgatcatccccaagaacttcgccgggcccgtgagccagcacaactaccgcccgggctaccacacccagaccgccgggccctggcacctcggccggctggagatggacttcgacttctgcgaggggaccacggtggtggtcaccgaggactgcggcaaccgcggccccagcctgcggaccaccacggcctccgggaagctcatcaccgagtggtgctgccgcagctgcaccctgcccccgctgcggtaccgcggcgaggacgggtgctggtacggcatggagatccggcccctcaaggagaaggaggagaacctggtgaactccctggtgaccgcggggcacggccagatcgacaacttcagcctcggcgtcctggggatggccctgttcctcgaggagatgctgcgcacgcgggtgggcaccaagcacgccatcctgctcgtggccgtctccttcgtgaccctgatcaccgggaacatgagcttccgcgacctgggccgcgtgatggtcatggtgggggccacgatgaccgacgacatcggcatgggcgtgacctacctcgcgctgctggccgccttcaaggtccggcccaccttcgccgccgggctcctgctgcgcaagctcacgtccaaggagctgatgatgaccaccatcggcatcgtgctgctcagccagtccaccatccccgagacgatcctggagctgaccgacgcgctcgccctggggatgatggtgctgaagatcgtccggaacatggagaagtaccagctcgccgtgaccatcatggccatcctgtgcgtcccgaacgccgtgatcctgcagaacgcgtggaaggtgagctgcaccatcctcgccgtcgtgtccgtgagccccctgctgctcacgtccagccagcagaaggccgactggatccccctggccctgaccatcaagggcctcaaccccaccgcgatcttcctgaccacgctgtcccgcaccagcaagaagcggtcctggccgctcaacgaggccatcatggccgtcggcatggtgagcatcctggcctccagcctgctcaagaacgacatccccatgaccgggcccctggtggccggcgggctgctcaccgtctgctacgtgctgacgggccgcagcgcggacctggagctcgagcgggccgccgacgtgcgctgggaggagcaggccgagatctccgggagctcccccatcctgagcatcaccatctccgaggacggcagcatgtccatcaagaacgaggaggaggagcagaccctgaccatcctcatccggacgggcctgctggtcatcagcgggctgttcccggtgtccatccccatcaccgccgcggcctggtacctgtgggaggtgaagaagcagcgcgccggcgtcctgtgggacgtgcccagcccgccgcccgtggggaaggccgagctcgaggacggcgcctaccggatcaagcagaaggggatcctgggctactcccagatcggcgcgggggtctacaaggagggcaccttccacaccatgtggcacgtgacccgcggggccgtgctgatgcacaagggcaagcggatcgagcccagctgggccgacgtcaagaaggacctcatctcctacgggggcggctggaagctggagggggagtggaaggagggcgaggaggtccaggtgctggccctcgagcccgggaagaacccccgcgccgtccagacgaagcccggcctgttcaagaccaacaccgggaccatcggcgcggtgagcctggacttctcccccggcacgagcgggtcccccatcgtggacaagaagggcaaggtcgtggggctctacggcaacggcgtggtcacccggagcgggacctacgtgtccgccatcgcccagaccgagaagtccatcgaggacaaccccgagatcgaggacgacatcttccgcaagaagcggctgacgatcatggacctgcaccccggcgccgggaagaccaagcgctacctgcccgcgatcgtgcgggaggccatcaagcgcggcctccggaccctgatcctggccccgacccgcgtcgtggccgccgagatggaggaggcgctccgcgggctgcccatccggtaccagacgcccgccatccgcgccgagcacaccggccgggagatcgtggacctgatgtgccacgccaccttcaccatgcgcctcctgagccccatccgggtcccgaactacaacctgatcatcatggacgaggcccacttcacggaccccgcgtccatcgccgcccgcggctacatcagcacccgggtggagatgggggaggccgccggcatcttcatgaccgcgacgccgcccgggtcccgcgacccgttcccccagagcaacgcccccatcatggacgaggagcgggagatccccgagcgctcctggaacagcggccacgagtgggtgacggacttcaaggggaagaccgtctggttcgtgccgtccatcaaggccggcaacgacatcgccgcgtgcctccggaagaacggcaagaaggtgatccagctgagccgcaagaccttcgactccgagtacatcaagacccggacgaacgactgggacttcgtcgtgaccaccgacatcagcgagatgggggccaacttcaaggccgagcgcgtgatcgacccccggcgctgcatgaagcccgtcatcctgaccgacggcgaggagcgggtgatcctcgccgggcccatgccggtgacgcactccagcgccgcgcagcgccggggccgcgtcgggcgcaaccccaagaacgagaacgaccagtacatctacatgggcgagcccctggagaacgacgaggactgcgcccactggaaggaggccaagatgctgctcgacaacatcaacacccccgagggcatcatcccgtccatgttcgagcccgagcgggagaaggtggacgccatcgacggggagtaccgcctgcggggcgaggcccgcaagaccttcgtggacctgatgcggcgcggggacctccccgtctggctggcgtaccgggtggccgccgagggcatcaactacgccgaccgccggtggtgcttcgacggggtcaagaacaaccagatcctggaggagaacgtggaggtggagatctggaccaaggagggcgagcgcaagaagctcaagccgcggtggctggacgcccgcatctacagcgaccccctggcgctcaaggagttcaaggagttcgccgccggccggaagtccctgacgctgaacctcatcaccgagatggggcgcctgcccaccttcatgacccagaaggcccggaacgcgctggacaacctcgccgtcctgcacacggccgaggccggcgggcgcgcctacaaccacgcgctgagcgagctccccgagaccctggagaccctgctcctgctgaccctcctggccacggtgaccggcggcatcttcctgttcctcatgtccgggaagggcatcgggaagatgaccctgggcatgtgctgcatcatcaccgccagcatcctgctctggtacgcccagatccagccgcactggatcgccgcgtccatcatcctggagttcttcctgatcgtgctcctgatccccgagcccgagaagcagcggacgccccaggacaaccagctgacgtacgtcgtgatcgccatcctcaccgtggtcgccgccaccatggccaacgagatggggttcctggagaagaccaagaaggacttcggcctgggcagcatcacgacccagcagccggacagcaacatcctcgacatcgacctgcgccccgcgtccgcctggaccctgtacgccgtggccaccacgttcatcacccccatgctccggcacagcatcgagaactccagcgtgaacgtctccctgaccgccatcgcgaaccaggccaccgtgctgatggggctcggcaaggggtggcccctgagcaagatggacatcggcgtgccgctgctcgccatcgggtgctactcccaggtcaaccccatcacgctgaccgccgcgctgctcctgctggtggcccactacgccatcatcggccccggcctccaggccaaggccacccgcgaggcgcagaagcgggccgccgccgggatcatgaagatccccgccgcggacatcggcaccgtgatcgacctggacccgatcccctacgaccccaagttcgagaagcagctggggcaggtcatgctcctggtgctgtgcagcacccaggtgctcatgatgcgcaccacctgggccctgtgcgaggccctgaccctcgccacgggccccatctccaccctgtgggaggggaacccgggccgcttctggaacaccaccatcgccgtcagcatggcgaacatcttccggggctcctacctggccggggccggcctcctgttcagcatcatgaagaacacggccaacacccgccgggggaccggcaacaccggcgagacgctgggggagaagtggaagaaccgcctcaacgcgctgggcaagtccgagttccagatctacaagaagtccgggatccaggaggtggaccggaccctggccaaggagggcatcaagcgcggggagaccgaccaccacgccgtgtcccggggcagcgccaagctccgctggttcgtcgagcggaacctggtgacccccgagggcaaggtggtcgacctggggtgcggccgcgggggctggtcctactactgcgggggcctcaagaacgtgaaggaggtgaagggcctgacgaagggcgggcccgggcacgaggagcccatcccgatgagcacctacggctggaacctggtccggctccagtccggggtggacgtgttcttcacgccgcccgagaagtgcgacaccctgctgtgcgacatcggcgagagcagccccaacccgacggtcgaggccggccgcaccctccgggtgctgaacctggtggagaactggctcaacaacaacacccagttctgcatcaaggtcctgaacccctacatgccctccgtgatcgagaagatggaggcgctgcagcgcaagtacgggggcgccctggtgcggaacccgctcagccgcaactccacccacgagatgtactgggtcagcaacgcctccgggaacatcgtgagctccgtgaacatgatcagccggatgctgatcaaccgcttcaccatgaagcacaagaaggccacgtacgagcccgacgtcgacctgggctccgggacccggaacatcggcatcgagagcgagacccccaacctcgacatcatcggcaagcgcatcgagaagatcaagcaggagcacgagacctcctggcactacgaccaggaccacccctacaagacgtgggcctaccacgggagctacgagaccaagcagaccggctccgcgagctccatggtgaacggggtggtccgcctgctgaccaagccgtgggacgtgatccccatggtgacgcagatggccatgaccgacaccacccccttcggccagcagcgggtcttcaaggagaaggtggacacgcgcacccaggagcccaaggagggcaccaagaagctcatgaagatcaccgccgagtggctgtggaaggagctggggaagaagaagacgccgcggatgtgcacccgcgaggagttcacccggaaggtgcgcagcaacgccgccctcggcgcgatcttcaccgacgagaacaagtggaagtccgcccgggaggccgtcgaggacagcgggttctgggagctggtggacaaggagcgcaacctgcacctcgagggcaagtgcgagacgtgcgtctacaacatgatggggaagcgggagaagaagctgggcgagttcggcaaggccaaggggtcccgcgcgatctggtacatgtggctgggcgcccggttcctcgagttcgaggccctggggttcctgaacgaggaccactggttcagccgcgagaacagcctctccggcgtggagggggagggcctgcacaagctgggctacatcctccgggacgtgagcaagaaggagggcggcgccatgtacgccgacgacaccgcggggtgggacacccgcatcaccctggaggacctgaagaacgaggagatggtcacgaaccacatggagggcgagcaccggaagctcgccgaggccatcttccgcctgacctaccagaacaaggtggtgcgggtccagcgccccacgccccgggggaccgtgatggacatcatctcccgccgggaccagcgcggcagcggccaggtggtcacgtacgggctgaacaccttcaccaacatggaggcccagctcatccgccagatggagggcgagggggtgttcaagtccatccagcacctgaccgtgacggaggagatcgccgtcaagaactggctggagcgggtgggccgcgagcggctcagccgcatggcgatctccggcgacgactgcgtggtcaagcccctggacgaccggttcgccagcgccctgaccgccctcaacgacatggggaaggtgcgcaaggacatccagcagtgggagccgtcccggggctggaacgactggacccaggtgcccttctgcagccaccacttccacgagctgatcatgaaggacgggcgcgtcctggtggtgccctgccggaaccaggacgagctcatcggccgcgcccggatctcccagggggcgggctggagcctgcgcgagaccgcctgcctgggcaagtcctacgcccagatgtggagcctcatgtacttccaccggcgcgacctgcggctggccgccaacgcgatctgctccgccgtccccagccactgggtgccgatctcccgcacgacctggagcatccacgccacccacgagtggatgaccaccgaggacatgctcacggtgtggaaccgggtctggatccaggagaacccctggatggaggacaagacccccgtggagagctgggaggagatcccctacctggggaagcgcgaggaccagtggtgcggctccctgatcgggctcaccagccgggccacctgggcgaagaacatccagacggccatcaaccaggtgcgctccctgatcggcaacgaggagtacaccgactacatgccgagcatgaagcgcttccggcgcgaggaggaggaggccggggtcctgtggtga

SEQ ID NO: 9044 - RNA, 9876 nt, synthetic construct
  misc_feature 1..9876: note = derived and/or modified CDS sequence (opt1) from DENV-2__KX380811__SS-prME
  source 1..9876: mol_type = other RNA
accgcggggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgagcagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggtccctgcgcccccagccgaccgagctgaagtacagctggaaggcgtggggcaaggccaagatgctctccaccgagctgcacaaccacacgttcctgatcgacggccccgagaccgccgagtgccccaacaccaaccgggcctggaacagcctcgaggtggaggactacgggttcggcgtcttcaccacgaacatctggctgaagctgaaggagcgccaggacgtgttctgcgactccaacctcatgagcgccgcgatcaaggacaaccgggccgtgcacgccgacatggggtactggatcgagtccgccctgaacgacacctggaagatcgagaaggccagcttcatcgaggtcaagtcctgccactggcccaagagccacaccctgtggtccaacggcgtgctcgagagcgagatgatcatccccaagaacttcgcgggccccgtgtcccagcacaactaccgccccgggtaccacacccagaccgccggcccgtggcacctggggcggctggagatggacttcgacttctgcgagggcacgaccgtcgtggtgaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtcaacagcctcgtgacggccggccacgggcagatcgacaacttctccctgggcgtgctgggcatggccctcttcctggaggagatgctgcgcacccgggtcgggaccaagcacgccatcctcctggtggccgtgagcttcgtcaccctgatcacgggcaacatgtccttccgcgacctcgggcgcgtgatggtgatggtcggcgccaccatgaccgacgacatcgggatgggcgtgacctacctggccctgctcgcggccttcaaggtgcggcccacgttcgccgccggcctgctgctccgcaagctgaccagcaaggagctgatgatgaccaccatcgggatcgtcctcctgtcccagagcacgatccccgagtccatcctggagctcaccgacgccctggcgctgggcatgatggtgctcaagatcgtccggaacatggagaagtaccagctggccgtgaccatcatggccatcctgtgcgtgcccaacgccgtcatcctccagaacgcctggaaggtgagctgcaccacgctggcggtggtctccgtgagcccgctgctcctgacctccagccagcagaaggccgactggatccccctggccctcaccatcaaggggctgaaccccaccgccatcttcctgacgaccctctcccgcaccagcaagaagcggtcctggcccctgaacgaggcgatcatggccgtgggcatggtcagcatcctggcctccagcctcctgaagaacgacatcccgatgaccggccccctggtggccgggggcctcctgacggtgtgctacgtcctgaccgggcgcagcgccgacctcgagctggagcgggcggccgacgtgcgctgggaggagcaggccgagatctccggcagctcccccatcctgagcatcaccatctccgaggacgggagcatgtccatcaagaacgaggaggaggagcagaccctcacgatcctgatccggaccggcctgctcgtgatcagcggcctgttccccgtctccatcccgatcaccgccgccgcgtggtacctgtgggaggtgaagaagcagcgcgccggggtgctctgggacgtcccctccccgccgcccgtgggcaaggccgagctggaggacggggcctaccggatcaagcagaagggcatcctggggtactcccagatcggcgccggcgtgtacaaggaggggaccttccacaccatgtggcacgtcacgcgcggcgcggtgctcatgcacaaggggaagcggatcgagcccagctgggccgacgtgaagaaggacctgatctcctacggcgggggctggaagctggagggcgagtggaaggagggggaggaggtccaggtgctcgccctggagcccggcaagaacccgcgcgccgtgcagaccaagcccgggctgttcaagaccaacaccggcacgatcggggccgtcagcctcgacttctcccccggcaccagcggctcccccatcgtggacaagaaggggaaggtggtcggcctgtacgggaacggcgtggtgacccggagcggcacctacgtctccgcgatcgcccagacggagaagtccatcgaggacaacccggagatcgaggacgacatcttccgcaagaagcggctgaccatcatggacctgcaccccggggccggcaagaccaagcgctacctccccgccatcgtgcgggaggcgatcaagcgcgggctgcggaccctgatcctcgcccccacgcgcgtggtcgccgccgagatggaggaggccctgcgcggcctgccgatccggtaccagacccccgcgatccgcgccgagcacaccgggcgggagatcgtggacctcatgtgccacgccaccttcacgatgcgcctgctgagccccatccgggtgcccaactacaacctcatcatcatggacgaggcccacttcaccgacccggcctccatcgcggcccgcggctacatcagcacccgggtcgagatgggcgaggccgccgggatcttcatgaccgccacgccgcccggctcccgcgaccccttcccgcagagcaacgcgcccatcatggacgaggagcgggagatccccgagcgctcctggaacagcgggcacgagtgggtgaccgacttcaagggcaagaccgtgtggttcgtcccctccatcaaggccgggaacgacatcgccgcctgcctgcggaagaacggcaagaaggtgatccagctgagccgcaagaccttcgactccgagtacatcaagacgcggaccaacgactgggacttcgtggtcaccaccgacatcagcgagatgggcgcgaacttcaaggccgagcgcgtgatcgacccgcggcgctgcatgaagcccgtgatcctcacggacggggaggagcgggtcatcctggccggccccatgcccgtgacccactccagcgccgcccagcgccgggggcgcgtgggccgcaacccgaagaacgagaacgaccagtacatctacatgggggagcccctggagaacgacgaggactgcgcgcactggaaggaggccaagatgctcctggacaacatcaacacccccgagggcatcatcccctccatgttcgagccggagcgggagaaggtcgacgccatcgacggcgagtaccgcctgcgcggggaggcccgcaagaccttcgtggacctcatgcggcgcggcgacctgcccgtctggctggcctaccgggtggcggccgaggggatcaactacgccgaccgccggtggtgcttcgacggcgtgaagaacaaccagatcctcgaggagaacgtcgaggtggagatctggacgaaggagggggagcgcaagaagctgaagccccggtggctggacgcccgcatctacagcgacccgctcgccctgaaggagttcaaggagttcgcggccggccggaagtccctgaccctcaacctgatcaccgagatgggccgcctgcccaccttcatgacgcagaaggccaagaacgccctcgacaacctggcggtgctgcacaccgccgaggccgggggccgggcctacaaccacgccctcagcgagctgcccgagaccctggagaccctcctgctgctcacgctgctggcgaccgtcaccgggggcatcttcctcttcctgatgtccggcaaggggatcggcaagatgaccctggggatgtgctgcatcatcaccgccagcatcctcctgtggtacgcccagatccagccccactggatcgccgcctccatcatcctggagttcttcctcatcgtgctgctgatcccggagcccgagaagcagcgcacgccccaggacaaccagctcacctacgtggtcatcgcgatcctgaccgtggtggccgccaccatggccaacgagatgggcttcctggagaagacgaagaaggacttcgggctcggcagcatcaccacccagcagcccgagagcaacatcctggacatcgacctgcggccggcctccgcgtggaccctctacgccgtcgccacgaccttcatcacccccatgctgcgccacagcatcgagaactccagcgtgaacgtgtccctgaccgccatcgccaaccaggcgacggtcctcatgggcctggggaagggctggcccctgagcaagatggacatcggggtgcccctcctggccatcggctgctactcccaggtgaacccgatcaccctgaccgccgccctcctgctgctcgtcgcgcactacgccatcatcgggcccggcctgcaggccaaggccacccgggaggcccagaagcgcgcggccgccggcatcatgaagatccccacggtggacgggatgaccgtgatcgacctggaccccatcccgtacgaccccaagttcgagaagcagctcggccaggtcatgctgctggtgctctgcgtgacccaggtcctgatgatgcggaccacgtgggccctgtgcgaggccctcaccctggcgaccgggcccatcagcaccctgtgggagggcaaccccgggcgcttctggaacacgaccatcgccgtgtccatggccaacatcttccgcggcagctacctcgccggcgccgggctgctgttctccatcatgaagaacaccgcgaacacccggcgcggcacggggaacaccggcgagaccctcggcgagaagtggaagaaccggctgaacgccctgggcaagagcgagttccagatctacaagaagtccggcatccaggaggtggaccgcaccctcgccaaggaggggatcaagcggggcgagacggaccaccacgccgtcagccgcgggtccgcgaagctgcggtggttcgtggagcgcaacctggtgaccccggagggcaaggtcgtggacctcggctgcgggcggggcgggtggagctactactgcggcgggctgaagaacgtgaaggaggtcaagggcctgaccaagggcgggcccggccacgaggagcccatccccatgtccacctacgggtggaacctcgtgcgcctgcagagcggcgtggacgtcttcttcacgccgcccgagaagtgcgacaccctgctctgcgacatcggggagtccagccccaaccccaccgtggaggccggccggaccctgcgcgtgctgaacctcgtcgagaactggctgaacaacaacacccagttctgcatcaaggtgctgaacccgtacatgcccagcgtgatcgagaagatggaggccctgcagcggaagtacggcggggccctcgtccgcaaccccctgtcccggaacagcacgcacgagatgtactgggtgtccaacgccagcggcaacatcgtgtccagcgtcaacatgatctcccgcatgctgatcaaccggttcaccatgcgccacaagaaggcgacctacgagccggacgtggacctcgggagcggcacccggaacatcgggatcgagtccgagacgcccaacctggacatcatcggcaagcgcatcgagaagatcaagcaggagcacgagaccagctggcactacgaccaggaccacccctacaagacctgggcctaccacggctcctacgagaccaagcagacggggagcgcctccagcatggtgaacggcgtcgtgcgcctgctcaccaagccctgggacgtgatcccgatggtcacccagatggccatgaccgacacgacccccttcgggcagcagcgggtgttcaaggagaaggtcgacacccgcacccaggagcccaaggagggcacgaagaagctgatgaagatcaccgccgagtggctgtggaaggagctcggcaagaagaagacgccccggatgtgcacccgcgaggagttcacgcggaaggtgcgctccaacgcggccctgggggccatcttcaccgacgagaacaagtggaagtccgcccgggaggccgtggaggactccggcttctgggagctggtcgacaaggagcgcaacctccacctggaggggaagtgcgagacctgcgtgtacaacatgatgggcaagcgggagaagaagctgggggagttcggcaaggcgaagggcagccgcgccatctggtacatgtggctcggggcccggttcctggagttcgaggccctgggcttcctcaacgaggaccactggttctcccgcgagaacagcctgagcggggtggagggcgaggggctgcacaagctcggctacatcctgcgggacgtctccaagaaggagggcggggcgatgtacgccgacgacaccgccggctgggacacgcgcatcaccctggaggacctcaagaacgaggagatggtgaccaaccacatggagggggagcacaagaagctggccgaggccatcttcaagctgacctaccagaacaaggtggtccgggtgcagcgcccgacgccccggggcaccgtgatggacatcatcagccgccgggaccagcgcgggtccggccaggtcgtgacctacggcctcaacaccttcacgaacatggaggcgcagctgatccggcagatggagggggagggcgtgttcaagagcatccagcagctgaccgtcaaggaggagatcgccgtgaagaactggctcatccgcgtggggcgcgagcggctgtcccgcatggccatcagcggcgacgactgcgtcgtgaagcccctggacgaccggttcgcctccgccctcaccgcgctgaacgacatgggcaaggtgcgcaaggacatccagcagtgggagcccagccgggggtggaacgactggacccaggtcccgttctgctcccaccacttccacgagctgatcatgaaggacggccgcgtgctcgtggtcccctgccggaaccaggacgagctgatcgggcgcgcccggatcagccagggcgccgggtggtccctgcgcgagacggcctgcctcggcaagagctacgcccagatgtggtccctgatgtacttccaccggcgcgacctgcggctcgcggccaacgccatctgcagcgccgtgccctcccactggatccccaccagccgcaccacctggtccatccacgccacccacgagtggatgacgaccgaggacatgctgaccgtgtggaaccgggtctggatccaggagaacccgtggatggaggacaagacccccgtggagagctgggaggagatcccctacctgggcaagcgcgaggaccagtggtgcgggagcctcatcggcctgacgtcccgggcgacctgggccaagaacatccagaccgccatcaaccaggtgcgcagcctgatcgggaacgaggagtacaccgactacatgccctccatgaagcggttccgccgcgaggaggaggaggccggcgtcctctggtga

SEQ ID NO: 9045 - RNA, 9876 nt, synthetic construct
  misc_feature 1..9876: note = derived and/or modified CDS sequence (opt1) from DENV-2__KX380813__SS-prME
  source 1..9876: mol_type = other RNA
accgcggggatcatcatcatgatgatccccaccgtgatggccttccacctgaccacccgcaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcaccatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagagcgcggagacccagcacggcaccatcgtgatccgcgtccagtacgagggggacggctccccctgcaagatccccttcgagatcatggacctggagaagcggcacgtgctcggccgcctgatcacggtgaaccccatcgtcaccgagaaggacagcccggtgaacatcgaggccgagccgcccttcggggactcctacatcatcatcggcgtggagcccgggcagctgaagctcagctggttcaagaagggctccagcatcgggcagatgttcgagaccaccatgcgcggcgccaagcggatggccatcctgggcgacacggcctgggacttcgggtccctgggcggggtcttcaccagcatcggcaaggcgctccaccaggtgttcggggccatctacggcgccgccttctccggcgtgagctggaccatgaagatcctgatcggggtcgtgatcacctggatcggcatgaactcccgcagcacgtccctgagcgtgtccctggtcctcgtgggggtggtcaccctgtacctgggcgtgatggtgcaggcggacagcgggtgcgtcgtgagctggaagaacaaggagctcaagtgcggctccggcatcttcatcaccgacaacgtgcacacctggacggagcagtacaagttccagccggagagcccctccaagctggccagcgccatccagaaggcccacgaggaggggatctgcggcatccggtccgtcacccgcctggagaacctcatgtggaagcagatcacccccgagctgaaccacatcctgaccgagaacgaggtgaagctcacgatcatgaccggggacatcaagggcatcatgcaggccgggaagcggaccctgcgcccccagccgaccgagctgaagtacagctggaaggcgtggggcaaggccaagatgctctccacggagctgcacaaccacaccttcctgatcgacggccccgagaccgccgagtgccccaacaccaaccgggcctggaacagcctcgaggtggaggactacgggttcggcgtcttcacgaccaacatctggctgaagctgaaggagcgccaggacgtgttctgcgactccaagctcatgagcgccgcgatcaaggacaaccgggccgtgcacgccgacatggggtactggatcgagtccgccctgaacgacacctggaagatcgagaaggccagcttcatcgaggtcaagtcctgccactggcccaagagccacaccctgtggtccaacggcgtgctcgagagcgagatgatcatccccaagaacttcgcgggccccgtgtcccagcacaactaccgccccgggtaccacacccagacggccggcccgtggcacctggggcggctggagatggacttcgacttctgcgagggcaccaccgtcgtggtgaccgaggactgcgggaaccgcggccccagcctccggacgaccaccgccagcggcaagctgatcaccgagtggtgctgccgctcctgcacgctgccgcccctccggtaccgcggggaggacggctgctggtacgggatggagatccggccgctgaaggagaaggaggagaacctggtcaacagcctcgtgaccgccggccacgggcagatcgacaacttctccctgggcgtgctgggcatggccctcttcctggaggagatgctgcgcacccgggtcgggaccaagcacgccatcctcctggtggccgtgagcttcgtcacgctgatcaccggcaacatgtccttccgcgacctcgggcgcgtgatggtgatggtcggcgccaccatgaccgacgacatcgggatgggcgtgacgtacctggccctgctcgcggccttcaagatccggcccaccttcgccgccggcctgctgctccgcaagctgaccagcaaggagctgatgatgaccacgatcgggatcgtgctcctgtcccagagcaccatccccgagtccatcctggagctcaccgacgccctggcgctgggcatgatggtcctcaagatcgtgcggaacatggagaagtaccagctggccgtcaccatcatggccatcctgtgcgtgcccaacgccgtgatcctccagaacgcctggaaggtcagctgcacgaccctggcggtggtgtccgtcagcccgctgctcctgacctccagccagcagaaggccgactggatccccctggccctcaccatcaaggggctgaaccccacggccatcttcctgaccaccctctcccgcaccagcaagaagcggtcctggcccctgaacgaggcgatcatggccgtgggcatggtgagcatcctggcctccagcctcctgaagaacgacatcccgatgacgggccccctggtcgccgggggcctcctgaccgtgtgctacgtgctgaccgggcgcagcgccgacctcgagctggagcgggcggccgacgtccgctgggaggagcaggccgagatctccggcagctcccccatcctgagcatcaccatctccgaggacgggagcatgtccatcaagaacgaggaggaggagcagacgctcaccatcctgatccggaccggcctgctcgtgatcagcggcctgttccccgtgtccatcccgatcaccgccgccgcgtggtacctgtgggaggtcaagaagcagcgcgccggggtgctctgggacgtgccctccccgccgcccgtcggcaaggccgagctggaggacggggcctaccggatcaagcagaagggcatcctggggtactcccagatcggcgccggcgtgtacaaggaggggaccttccacacgatgtggcacgtgacccgcggcgcggtcctcatgcacaaggggaagcggatcgagcccagctgggccgacgtgaagaaggacctgatctcctacggcgggggctggaagctggagggcgagtggaaggagggggaggaggtgcaggtcctcgccctggagcccggcaagaacccgcgcgccgtgcagaccaagcccgggctgttcaagaccaacacgggcaccatcggggccgtgagcctcgacttctcccccggcaccagcggctcccccatcgtcgacaagaaggggaaggtggtgggcctgtacgggaacggcgtcgtgacccggagcggcacgtacgtgtccgcgatcgcccagaccgagaagtccatcgaggacaacccggagatcgaggacgacatcttccgcaagaagcggctgaccatcatggacctgcaccccggggccggcaagaccaagcgctacctccccgccatcgtccgggaggcgatcaagcgcgggctgcggacgctgatcctcgcccccacccgcgtggtggccgccgagatggaggaggccctgcgcggcctgccgatccggtaccagacccccgcgatccgcgccgagcacaccgggcgggagatcgtcgacctcatgtgccacgccacgttcaccatgcgcctgctgagccccatccgggtgcccaactacaacctcatcatcatggacgaggcccacttcaccgacccggcctccatcgcggcccgcggctacatcagcacccgggtggagatgggcgaggccgccgggatcttcatgacggccacgccgcccggctcccgcgaccccttcccgcagagcaacgcgcccatcatggacgaggagaaggagatccccgagcggtcctggaacagcgggcacgagtgggtcaccgacttcaagggcaagaccgtgtggttcgtgccctccatcaaggccgggaacgacatcgccgcctgcctgcgcaagaacggcaagaaggtcatccagctgagccggaagacgttcgactccgagtacatcaagacccgcaccaacgactgggacttcgtggtgaccacggacatcagcgagatgggcgcgaacttcaaggccgagcgggtcatcgacccgcgccggtgcatgaagcccgtgatcctcaccgacggggaggagcgcgtgatcctggccggccccatgcccgtcacccactccagcgccgcccagcggcgcgggcgggtgggccgcaacccgaagaacgagaacgaccagtacatctacatgggggagcccctggagaacgacgaggactgcgcgcactggaaggaggccaagatgctcctggacaacatcaacacccccgagggcatcatcccctccatgttcgagccggagcgcgagaaggtggacgccatcgacggcgagtaccggctgcgcggggaggcccggaagacgttcgtcgacctcatgcgccggggcgacctgcccgtgtggctggcctaccgcgtcgcggccgaggggatcaactacgccgaccggcgctggtgcttcgacggcgtgaagaacaaccagatcctcgaggagaacgtggaggtcgagatctggaccaaggagggggagcggaagaagctgaagccccgctggctggacgcccggatctacagcgacccgctcgccctgaaggagttcaaggagttcgcggccggccgcaagtccctgaccctcaacctgatcaccgagatgggccggctgcccacgttcatgacccagaaggccaagaacgccctcgacaacctggcggtgctgcacaccgccgaggccgggggccgcgcctacaaccacgccctcagcgagctgcccgagaccctggagacgctcctgctgctcaccctgctggcgaccgtgaccgggggcatcttcctcttcctgatgtccggcaaggggatcggcaagatgaccctggggatgtgctgcatcatcacggccagcatcctcctgtggtacgcccagatccagccccactggatcgccgcctccatcatcctggagttcttcctcatcgtcctgctgatcccggagcccgagaagcagcggacgccccaggacaaccagctcacctacgtggtgatcgcgatcctgaccgtcgtggccgccacgatggccaacgagatgggcttcctggagaagaccaagaaggacttcgggctcggcagcatcaccacccagcagcccgagagcaacatcctggacatcgacctgcgcccggcctccgcgtggacgctctacgccgtggccaccaccttcatcacccccatgctgcggcacagcatcgagaactccagcgtcaacgtgtccctgacggccatcgccaaccaggcgaccgtgctcatgggcctggggaagggctggcccctgagcaagatggacatcggggtccccctcctggccatcggctgctactcccaggtgaacccgatcaccctgaccgccgccctcctgctgctcgtggcgcactacgccatcatcgggcccggcctgcaggccaaggccacgcgcgaggcccagaagcgggcggccgccggcatcatgaagaaccccaccgtcgacgggatgaccgtgatcgacctggaccccatcccgtacgaccccaagttcgagaagcagctcggccaggtgatgctgctggtcctctgcgtgacccaggtgctgatgatgcgcacgacctgggccctgtgcgaggccctcaccctggcgaccgggcccatcagcacgctgtgggagggcaaccccgggcggttctggaacaccaccatcgccgtctccatggccaacatcttccgcggcagctacctcgccggcgccgggctgctgttctccatcatgaagaacaccgcgaacacgcgccggggcaccgggaacaccggcgagaccctcggcgagaagtggaagaaccgcctgaacgccctgggcaagagcgagttccagatctacaagaagtccggcatccaggaggtggaccggacgctcgccaaggaggggatcaagcgcggcgagaccgaccaccacgccgtgagccgggggtccgcgaagctgcgctggttcgtcgagcggaacctggtgaccccggagggcaaggtggtcgacctcggctgcgggcgcggcgggtggagctactactgcggcgggctgaagaacgtgaaggaggtgaagggcctgaccaagggcgggcccggccacgaggagcccatccccatgtccacgtacgggtggaacctcgtccggctgcagagcggcgtggacgtgttcttcacctccccggagaagtgcgacaccctgctctgcgacatcggggagagcagccccaaccccaccgtcgaggccggccgcaccctgcgggtgctgaacctcgtggagaactggctgaacaacaacacgcagttctgcatcaaggtcctgaacccctacatgccgtccgtgatcgagaagatggaggccctgcagcgcaagtacggcggggccctcgtgcggaaccccctgagccgcaactccacccacgagatgtactgggtcagcaacgcctccggcaacatcgtgagctccgtgaacatgatcagccggatgctgatcaaccgcttcaccatgcggcacaagaaggcgacctacgagcccgacgtcgacctcgggtccggcacgcgcaacatcgggatcgagagcgagaccccgaacctggacatcatcggcaagcggatcgagaagatcaagcaggagcacgagacctcctggcactacgaccaggaccacccctacaagacctgggcctaccacggcagctacgagacgaagcagaccgggtccgccagctccatggtgaacggcgtggtccgcctgctcaccaagccctgggacgtgatccccatggtgacccagatggccatgacggacaccaccccgttcgggcagcagcgcgtcttcaaggagaaggtggacacccggacgcaggagcccaaggagggcaccaagaagctgatgaagatcaccgccgagtggctgtggaaggagctcggcaagaagaagacgccccgcatgtgcacgcgggaggagttcacccgcaaggtccggagcaacgcggccctgggggccatcttcaccgacgagaacaagtggaagtccgcccgcgaggccgtggaggacagcggcttctgggagctggtggacaaggagcggaacctccacctggaggggaagtgcgagacctgcgtctacaacatgatgggcaagcgcgagaagaagctgggggagttcggcaaggcgaagggctcccgggccatctggtacatgtggctcggggcccgcttcctggagttcgaggccctgggcttcctcaacgaggaccactggttcagccgggagaacagcctgtccggggtggagggcgaggggctgcacaagctcggctacatcctgcgcgacgtgagcaagaaggagggcggggcgatgtacgccgacgacacggccggctgggacacccggatcaccctggaggacctcaagaacgaggagatggtcaccaaccacatggagggggagcacaagaagctggccgaggccatcttcaagctgacgtaccagaacaaggtggtgcgcgtccagcggcccaccccgcgcggcaccgtgatggacatcatctcccggcgcgaccagcgggggagcggccaggtggtcacctacggcctcaacacgttcaccaacatggaggcgcagctgatccgccagatggagggggagggcgtgttcaagtccatccagcagctgaccgtgaaggaggagatcgccgtcaagaactggctcatccgggtggggcgcgagcgcctgagccggatggccatctccggcgacgactgcgtggtcaagcccctggacgaccgcttcgccagcgccctcaccgcgctgaacgacatgggcaaggtgcggaaggacatccagcagtgggagccctcccgcgggtggaacgactggacccaggtgcccttctgcagccaccacttccacgagctgatcatgaaggacggccgggtcctcgtggtgccgtgccgcaaccaggacgagctgatcgggcgggcccgcatctcccagggcgccgggtggagcctgcgggagaccgcctgcctcggcaagtcctacgcccagatgtggagcctgatgtacttccaccgccgggacctgcgcctcgcggccaacgccatctgctccgccgtccccagccactggatccccacctcccggaccacctggagcatccacgccacgcacgagtggatgaccaccgaggacatgctgaccgtgtggaaccgcgtgtggatccaggagaacccctggatggaggacaagacgccggtcgagagctgggaggagatcccctacctgggcaagcgggaggaccagtggtgcgggtccctcatcggcctgaccagccgcgcgacctgggccaagaacatccagaccgccatcaaccaggtgcggtccctgatcgggaacgaggagtacacggactacatgcccagcatgaagcgcttccggcgcgaggaggaggaggccggcgtgctctggtga

SEQ ID NO: 9046 - RNA, 9876 nt, synthetic construct
  misc_feature 1..9876: note = derived and/or modified CDS sequence (opt1) from DENV-2__KX380814__SS-prME
  source 1..9876: mol_type = other RNA
accgcgggcatcatcatcatgatgatccccaccgtgatggccttccacctgaccacccgcaacggggagccccacatgatcgtcagccggcaggagaagggcaagtccctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcaccatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggaccctgcgcccccagccgaccgagctgaagtactcctggaaggcgtggggcaaggccaagatgctcagcacggagctgcacaaccacaccttcctgatcgacggccccgagaccgccgagtgccccaacaccaaccgggcctggaactccctcgaggtggaggactacgggttcggcgtcttcacgaccaacatctggctgaagctgaaggagcgccaggacgtgttctgcgacagcaagctcatgtccgccgcgatcaaggacaaccgggccgtgcacgccgacatggggtactggatcgagagcgccctgaacgacacctggaagatcgagaaggcctccttcatcgaggtcaagagctgccactggccgaagtcccacaccctgtggagcaacggcgtgctcgagtccgagatgatcatccccaagaacttcgcgggccccgtgagccagcacaactaccgccccgggtaccacacccagacggccggcccgtggcacctggggcggctggagatggacttcgacttctgcgagggcaccaccgtcgtggtgaccgaggactgcgggaaccgcggcccctccctccggacgaccaccgccagcggcaagctgatcaccgagtggtgctgccgcagctgcacgctgccgcccctccggtaccgcggggaggacggctgctggtacgggatggagatccggccgctgaaggagaaggaggagaacctggtcaactccctcgtgaccgccggccacgggcagatcgacaacttcagcctgggcgtgctgggcatggccctcttcctggaggagatgctgcgcacccgggtcgggaccaagcacgccatcctcctggtggccgtgtccttcgtcacgctgatcaccggcaacatgagcttccgcgacctcgggcgcgtgatggtgatggtcggcgccaccatgaccgacgacatcgggatgggcgtgacgtacctggccctgctcgcggccttcaagatccggcccaccttcgccgccggcctgctgctccgcaagctgacctccaaggagctgatgatgaccacgatcgggatcgtgctcctgagccagtccaccatccccgagagcatcctggagctcaccgacgccctggcgctgggcatgatggtcctcaagatcgtgcggaacatggagaagtaccagctggccgtcaccatcatggccatcctgtgcgtgcccaacgccgtgatcctccagaacgcctggaaggtctcctgcacgaccctggcggtggtgagcgtctccccgctgctcctgaccagctcccagcagaaggccgactggatccccctggccctcaccatcaaggggctgaaccccacggccatcttcctgaccaccctcagccgcacctccaagaagcggagctggcccctgaacgaggcgatcatggccgtgggcatggtgtccatcctggccagctccctcctgaagaacgacatcccgatgacgggccccctggtcgccgggggcctcctgaccgtgtgctacgtgctgaccgggcgcagcgccgacctcgagctggagcgggcggccgacgtccgctgggaggagcaggccgagatcagcggctccagccccatcctgtccatcaccatcagcgaggacgggtccatgagcatcaagaacgaggaggaggagcagacgctcaccatcctgatccggaccggcctgctcgtgatctccggcctgttccccgtgagcatcccgatcaccgccgccgcgtggtacctgtgggaggtcaagaagcagcgcgccggggtgctctgggacgtgcccagcccgccgcccgtcggcaaggccgagctggaggacggggcctaccggatcaagcagaagggcatcctggggtacagccagatcggcgccggcgtgtacaaggaggggaccttccacacgatgtggcacgtgacccgcggcgcggtcctcatgcacaaggggaagcggatcgagccctcctgggccgacgtgaagaaggacctgatcagctacggcgggggctggaagctggagggcgagtggaaggagggggaggaggtgcaggtcctcgccctggagcccggcaagaacccccgcgccgtgcagaccaagcccgggctgttcaagaccaacacgggcaccatcggggccgtgtccctcgacttcagccccggcacctccggcagccccatcgtcgacaagaaggggaaggtggtgggcctgtacgggaacggcgtcgtgacccggtccggcacgtacgtgagcgcgatcgcccagaccgagaagtccatcgaggacaacccggagatcgaggacgacatcttccgcaagaagcggctgaccatcatggacctgcaccccggggccggcaagaccaagcgctacctccccgccatcgtccgggaggcgatcaagcgcgggctgcggacgctgatcctcgcccccacccgcgtggtggccgccgagatggaggaggccctgcgcggcctgccgatccggtaccagacccccgcgatccgcgccgagcacaccgggcgggagatcgtcgacctcatgtgccacgccacgttcaccatgcgcctgctgagccccatccgggtgcccaactacaacctcatcatcatggacgaggcccacttcaccgacccggccagcatcgcggcccgcggctacatctccacccgggtggagatgggcgaggccgccgggatcttcatgacggccacgccgcccggcagccgcgaccccttcccgcagtccaacgcgcccatcatggacgaggagaaggagatccccgagcggagctggaactccgggcacgagtgggtcaccgacttcaagggcaagaccgtgtggttcgtgcccagcatcaaggccgggaacgacatcgccgcctgcctgcgcaagaacggcaagaaggtcatccagctgtcccggaagacgttcgacagcgagtacatcaagacccgcaccaacgactgggacttcgtggtgaccacggacatctccgagatgggcgcgaacttcaaggccgagcgggtcatcgacccgcgccggtgcatgaagcccgtgatcctcaccgacggggaggagcgcgtgatcctggccggccccatgcccgtcacccacagctccgccgcccagcggcgcgggcgggtgggccgcaacccgaagaacgagaacgaccagtacatctacatgggggagcccctggagaacgacgaggactgcgcgcactggaaggaggccaagatgctcctggacaacatcaacacccccgagggcatcatccccagcatgttcgagccggagcgcgagaaggtggacgccatcgacggcgagtaccggctgcgcggggaggcccggaagacgttcgtcgacctcatgcgccggggcgacctgcccgtgtggctggcctaccgcgtcgcggccgaggggatcaactacgccgaccggcgctggtgcttcgacggcgtgaagaacaaccagatcctcgaggagaacgtggaggtcgagatctggaccaaggagggggagcggaagaagctgaagccccgctggctggacgcccggatctactccgacccgctcgccctgaaggagttcaaggagttcgcggccggccgcaagagcctgaccctcaacctgatcaccgagatgggccggctgcccacgttcatgacccagaaggccaagaacgccctcgacaacctggcggtgctgcacaccgccgaggccgggggccgcgcctacaaccacgccctctccgagctgcccgagaccctggagacgctcctgctgctcaccctgctggcgaccgtgaccgggggcatcttcctcttcctgatgagcggcaaggggatcggcaagatgaccctggggatgtgctgcatcatcacggcctccatcctcctgtggtacgcccagatccagccccactggatcgccgccagcatcatcctggagttcttcctcatcgtcctgctgatcccggagcccgagaagcagcggacgccccaggacaaccagctcacctacgtggtgatcgcgatcctgaccgtcgtggccgccacgatggccaacgagatgggcttcctggagaagaccaagaaggacttcgggctcggctccatcaccacccagcagcccgagagcaacatcctggacatcgacctgcgcccggccagcgcgtggacgctctacgccgtggccaccaccttcatcacccccatgctgcggcactccatcgagaacagctccgtcaacgtgagcctgacggccatcgccaaccaggcgaccgtgctcatgggcctggggaagggctggcccctgtccaagatggacatcggggtccccctcctggccatcggctgctacagccaggtgaacccgatcaccctgaccgccgccctcctgctgctcgtggcgcactacgccatcatcgggcccggcctgcaggccaaggccacgcgcgaggcccagaagcgggcggccgccggcatcatgaagaaccccaccgtcgacgggatgaccgtgatcgacctggaccccatcccgtacgaccccaagttcgagaagcagctcggccaggtgatgctgctggtcctctgcgtgacccaggtgctgatgatgcgcacgacctgggccctgtgcgaggccctcaccctggcgaccgggcccatctccacgctgtgggagggcaaccccgggcggttctggaacaccaccatcgccgtcagcatggccaacatcttccgcggctcctacctcgccggcgccgggctgctgttcagcatcatgaagaacaccgcgaacacgcgccggggcaccgggaacaccggcgagaccctcggcgagaagtggaagaaccgcctgaacgccctggggaagtccgagttccagatctacaagaagtccggcatccaggaggtggaccggacgctcgccaaggaggggatcaagcgcggcgagaccgaccaccacgccgtgagccgggggagcgcgaagctgcgctggttcgtcgagcggaacctggtgaccccggagggcaaggtggtcgacctcggctgcgggcgcggcgggtggtcctactactgcggcgggctgaagaacgtgaaggaggtgaagggcctgaccaagggcgggcccggccacgaggagcccatccccatgagcacgtacgggtggaacctcgtccggctgcagtccggcgtggacgtgttcttcaccagcccggagaagtgcgacaccctgctctgcgacatcggggagtccagccccaaccccaccgtcgaggccggccgcaccctgcgggtgctgaacctcgtggagaactggctgaacaacaacacgcagttctgcatcaaggtcctgaacccctacatgccgagcgtgatcgagaagatggaggccctgcagcgcaagtacggcggggccctcgtgcggaaccccctgtcccgcaacagcacccacgagatgtactgggtctccaacgccagcggcaacatcgtgtccagcgtgaacatgatctcccggatgctgatcaaccgcttcaccatgcggcacaagaaggcgacctacgagcccgacgtcgacctcgggagcggcacgcgcaacatcgggatcgagtccgagaccccgaacctggacatcatcggcaagcggatcgagaagatcaagcaggagcacgagaccagctggcactacgaccaggaccacccctacaagacctgggcctaccacggctcctacgagacgaagcagaccgggagcgcctccagcatggtgaacggcgtggtccgcctgctcaccaagccctgggacgtgatccccatggtgacccagatggccatgacggacaccaccccgttcgggcagcagcgcgtcttcaaggagaaggtggacacccggacgcaggagcccaaggagggcaccaagaagctgatgaagatcaccgccgagtggctgtggaaggagctcggcaagaagaagacgccccgcatgtgcacgcgggaggagttcacccgcaaggtccggtccaacgcggccctgggggccatcttcaccgacgagaacaagtggaagtccgcccgcgaggccgtggaggactccggcttctgggagctggtggacaaggagcggaacctccacctggaggggaagtgcgagacctgcgtctacaacatgatgggcaagcgcgagaagaagctgggggagttcggcaaggcgaagggcagccgggccatctggtacatgtggctcggggcccgcttcctggagttcgaggccctgggcttcctcaacgaggaccactggttctcccgggagaacagcctgagcggggtggagggcgaggggctgcacaagctcggctacatcctgcgcgacgtgtccaagaaggagggcggggcgatgtacgccgacgacacggccggctgggacacccggatcaccctggaggacctcaagaacgaggagatggtcaccaaccacatggagggggagcacaagaagctggccgaggccatcttcaagctgacgtaccagaacaaggtggtgcgcgtccagcggcccaccccgcgcggcaccgtgatggacatcatcagccggcgcgaccagcgggggtccggccaggtggtcacctacggcctcaacacgttcaccaacatggaggcgcagctgatccgccagatggagggggagggcgtgttcaagagcatccagcagctgaccgtgaaggaggagatcgccgtcaagaactggctcatccgggtggggcgcgagcgcctgtcccggatggccatcagcggcgacgactgcgtggtcaagcccctggacgaccgcttcgcctccgccctcaccgcgctgaacgacatgggcaaggtgcggaaggacatccagcagtgggagcccagccgcgggtggaacgactggacccaggtgcccttctgctcccaccacttccacgagctgatcatgaaggacggccgggtcctcgtggtgccgtgccgcaaccaggacgagctgatcgggcgggcccgcatcagccagggcgccgggtggtccctgcgggagaccgcctgcctcggcaagagctacgcccagatgtggtccctgatgtacttccaccgccgggacctgcgcctcgcggccaacgccatctgcagcgccgtcccctcccactggatccccaccagccggaccacctggtccatccacgccacgcacgagtggatgaccaccgaggacatgctgaccgtgtggaaccgcgtgtggatccaggagaacccctggatggaggacaagacgccggtcgagagctgggaggagatcccctacctgggcaagcgggaggaccagtggtgcgggagcctcatcggcctgacctcccgcgcgacctgggccaagaacatccagaccgccatcaaccaggtgcggagcctgatcgggaacgaggagtacacggactacatgccctccatgaagcgcttccggcgcgaggaggaggaggccggcgtgctctggtga

SEQ ID NO: 9047 - RNA, 9876 nt, synthetic construct
  misc_feature 1..9876: note = derived and/or modified CDS sequence (opt1) from DENV-2__KX380807__SS-prME
  source 1..9876: mol_type = other RNA
accgccggcatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggccatggacctcggcgagctgtgcgaggacaccatcacctacaactgccccctgctccggcagaacgagcccgaggacatcgactgctggtgcaacagcaccagcacctgggtgacgtacgggacctgcaccgccaccggcgagcaccggcgcgagaagcggagcgtcgccctggcgccccacgtgggcatggggctggagacgcggaccgagacctggatgtccagcgagggcgcctggaagcacgcgcagcggatcgagatctgggtgctccgccaccccgggttcaccatcatggccgccatcctggcctacacgatcggcaccacctacttccagcgggtcctgatcttcatcctcctgaccgcggtggccccctccatgacgatgcgctgcatcgggatcagcaaccgggacttcgtggagggcgtctccggcgggagctgggtggacatcgtgctggagcacggctcctgcgtcaccaccatggccaagaacaagcccaccctcgacttcgagctgatcaagacggaggccaagcaccccgccaccctgcgcaagtactgcatcgaggcgaagctcaccaacaccacgaccgccagccggtgcccgacccagggggagccctccctgaacgaggagcaggacaagcgcttcgtgtgcaagcacagcatggtggaccggggctggggcaacgggtgcggcctgttcgggaagggcgggatcgtgacctgcgccatgttcacgtgcaagaagaacatggagggcaagatcgtgcagcccgagaacctcgagtacaccatcgtgatcacgccccactccggcgaggagaacgccgtcgggaacgacaccggcaagcacgggaaggagatcaaggtgaccccgcagagctccatcaccgaggccgagctgaccggctacgggaccgtgaccatggagtgcagcccccgcacgggcctggacttcaacgagatggtcctcctgcagatggagaacaaggcgtggctggtgcaccggcagtggttcctcgacctgcccctgccctggctcccgggcgccgacacccaggggtccaactggatccagaaggagaccctggtgaccttcaagaacccccacgccaagaagcaggacgtcgtggtcctgggcagccaggagggggccatgcacacggccctcaccggcgcgaccgagatccagatgagctccgggaacctgctgttcaccggccacctcaagtgccgcctgcggatggacaagctgcagctcaagggcatgagctactccatgtgcacggggaagttcaaggtggtgaaggagatcgccgagacccagcacggcaccatcgtcatccgcgtgcagtacgagggggacggcagcccctgcaagatccccttcgagatcatggacctggagaagcggcacgtgctgggccgcctcatcaccgtcaacccgatcgtgacggagaaggactcccccgtgaacatcgaggccgagccgcccttcggggacagctacatcatcatcggcgtcgagccggggcagctgaagctgtcctggttcaagaagggcagctccatcgggcagatgttcgagaccaccatgcgcggcgccaagcggatggccatcctcggcgacaccgcgtgggacttcgggagcctgggcggggtgttcacgtccatcggcaaggccctgcaccaggtgttcggggccatctacggcgccgcgttcagcggcgtctcctggaccatgaagatcctcatcggggtggtgatcacctggatcggcatgaacagccgctccaccagcctgtccgtcagcctggtgctggtgggggtcgtgacgctctacctgggcgtgatggtccaggccgactccgggtgcgtggtgagctggaagaacaaggagctgaagtgcggcagcggcatcttcatcaccgacaacgtccacacctggaccgagcagtacaagttccagcccgagtcccccagcaagctcgcctccgccatccagaaggcccacgaggaggggatctgcggcatccggagcgtgacgcgcctggagaacctgatgtggaagcagatcacccccgagctcaaccacatcctgtccgagaacgaggtgaagctgaccatcatgaccggggacatcaagggcatcatgcaggcggggaagcggagcctccgcccgcagcccacggagctgaagtactcctggaaggcctggggcaaggccaagatgctgagcaccgagctccacaaccacaccttcctgatcgacggccccgagaccgccgagtgcccgaacacgaaccgggcctggaactccctggaggtcgaggactacgggttcggcgtgttcaccaccaacatctggctcaagctgaaggagcgccaggacgtgttctgcgacagcaagctgatgtccgcggccatcaaggacaaccgggccgtccacgccgacatggggtactggatcgagagcgccctcaacgacacctggaagatcgagaaggcgtccttcatcgaggtcaagagctgccactggcccaagtcccacacgctgtggagcaacggcgtgctggagtccgagatgatcatccccaagaacttcgccggccccgtcagccagcacaactaccgcccggggtaccacacccagaccgccggcccctggcacctcgggcggctggagatggacttcgacttctgcgagggcaccaccgtggtggtcacggaggactgcgggaaccgcggccccagcctgcggaccaccaccgcctccggcaagctcatcacggagtggtgctgccgcagctgcaccctgcccccgctgcggtaccgcggggaggacggctgctggtacgggatggagatccggcccctcaaggagaaggaggagaacctggtgaactccctggtgaccgcgggccacgggcagatcgacaacttcagcctcggcgtcctgggcatggccctgttcctcgaggagatgctgcgcacccgggtggggacgaagcacgccatcctgctcgtggccgtctccttcgtgaccctgatcaccggcaacatgagcttccgcgacctggggcgcgtgatggtcatggtgggcgccaccatgacggacaacatcgggatgggcgtgacctacctcgcgctgctggccgccttcaaggtccggcccaccttcgccgccggcctcctgctgcgcaagctcacctccaaggagctgatgatgacgaccatcgggatcgtgctgctcagccagtccaccatccccgagaccatcctggagctgacggacgcgctcgccctgggcatgatggtgctgaagatcgtccggaacatggagaagtaccagctcgccgtgaccatcatggccatcctgtgcgtcccgaacgccgtgatcctgcagaacgcgtggaaggtgagctgcaccatcctcgccgtcgtgtccgtgagccccctgctgctcacctccagccagcagaaggccgactggatccccctggccctgacgatcaaggggctcaaccccaccgcgatcttcctgaccaccctgtcccgcacgagcaagaagcggtcctggccgctcaacgaggccatcatggccgtcggcatggtgagcatcctggcctccagcctgctcaagaacgacatccccatgaccggccccctggtggccgggggcctgctcaccgtctgctacgtgctgaccgggcgcagcgcggacctggagctcgagcgggccgccgacgtgcgctgggaggagcaggccgagatctccggcagctcccccatcctgagcatcacgatctccgaggacgggagcatgtccatcaagaacgaggaggaggagcagaccctgaccatcctcatccggaccggcctgctggtcatcagcggcctcttcccggtgtccatccccatcacggccgcggcctggtacctgtgggaggtgaagaagcagcgcgccggggtcctgtgggacgtgcccagcccgccgcccgtgggcaaggccgagctcgaggacggggcctaccggatcaagcagaagggcatcctggggtactcccagatcggcgcgggcgtctacaaggaggggaccttccacaccatgtggcacgtgacccgcggcgccgtgctgatgcacaaggggaagcggatcgagcccagctgggccgacgtcaagaaggacctcatctcctacggcgggggctggaagctggagggcgagtggaaggagggggaggaggtccaggtgctggccctcgagcccggcaagaacccccgcgccgtccagaccaagcccgggctgttcaagacgaacaccggcaccatcggggcggtgagcctggacttctcccccggcaccagcggctcccccatcgtggacaagaaggggaaggtcgtgggcctctacgggaacggcgtggtcacgcggagcggcacctacgtgtccgccatcgcccagaccgagaagtccatcgaggacaaccccgagatcgaggacgacatcttccgcaagaagcggctgaccatcatggacctgcaccccggggccggcaagacgaagcgctacctgcccgcgatcgtgcgggaggccatcaagcgcgggctccggaccctgatcctggccccgacccgcgtcgtggccgccgagatggaggaggcgctccgcggcctgcccatccggtaccagacccccgccatccgcgccgagcacacggggcgggagatcgtggacctgatgtgccacgccaccttcaccatgcgcctcctgagccccatccgggtcccgaactacaacctgatcatcatggacgaggcccacttcaccgaccccgcgtccatcgccgcccgcggctacatcagcacgcgggtggagatgggcgaggccgccgggatcttcatgaccgcgacgccgcccggctcccgcgacccgttcccccagagcaacgcccccatcatggacgaggagcgggagatccccgagcgctcctggaacagcgggcacgagtgggtgaccgacttcaagggcaagacggtctggttcgtgccgtccatcaaggccgggaacgacatcgccgcgtgcctccggaagaacggcaagaaggtgatccagctgagccgcaagaccttcgactccgagtacatcaagacccggaccaacgactgggacttcgtcgtgacgaccgacatcagcgagatgggcgccaacttcaaggccgagcgcgtgatcgacccccggcgctgcatgaagcccgtcatcctgaccgacggggaggagcgggtgatcctcgccggccccatgccggtgacccactccagcgccgcgcagcgccgggggcgcgtcggccgcaaccccaagaacgagaacgaccagtacatctacatgggggagcccctggagaacgacgaggactgcgcccactggaaggaggccaagatgctgctcgacaacatcaacacgcccgagggcatcatcccgtccatgttcgagcccgagcgggagaaggtggacgccgtggacggcgagtaccgcctgcgcggggaggcccgcaagaccttcgtcgacctgatgcggcgcggcgacctccccgtgtggctggcgtacaaggtcgccgccgaggggatcaactacgccgaccggcgctggtgcttcgacggcgtgaagaacaaccagatcctggaggagaacgtggaggtcgagatctggaccaaggagggggagcggaagaagctcaagccgcgctggctggacgcccggatctacagcgaccccctggcgctcaaggagttcaaggagttcgccgccggccgcaagtccctgaccctgaacctcatcacggagatgggccggctgcccaccttcatgacccagaaggcccgcaacgcgctggacaacctcgccgtgctgcacaccgccgaggccgggggccgggcctacaaccacgcgctgagcgagctccccgagacgctggagaccctgctcctgctgaccctcctggccaccgtgaccggcgggatcttcctgttcctcatgtccgggaaggggatcggcaagatgaccctggggatgtgctgcatcatcaccgccagcatcctgctctggtacgcccagatccagccgcactggatcgccgcgtccatcatcctggagttcttcctgatcgtcctcctgatccccgagcccgagaagcagcgcacgccccaggacaaccagctgacctacgtggtgatcgccatcctcacggtcgtggccgccaccatggccaacgagatgggcttcctggagaagaccaagaaggacttcgggctgggcagcatcaccacgcagcagccggagagcaacatcctcgacatcgacctgcggcccgcgtccgcctggaccctgtacgccgtggccaccaccttcatcacgcccatgctccgccacagcatcgagaactccagcgtcaacgtgtccctgaccgccatcgcgaaccaggccaccgtgctgatgggcctcgggaagggctggcccctgagcaagatggacatcggggtcccgctgctcgccatcggctgctactcccaggtgaaccccatcaccctgacggccgcgctgctcctgctggtggcccactacgccatcatcgggcccggcctccaggccaaggccacccgggaggcgcagaagcgcaccgccgccggcatcatgaagatccccgccgccctgatcgtcaccgtgatcgacctggacccgatcccctacgaccccaagttcgagaagcagctcggccaggtgatgctgctggtcctctgcagcacccaggtgctgatgatgcggaccacctgggcgctgtgcgaggccctcaccctggccacgggccccatctccaccctgtgggaggggaacccgggccgcttctggaacaccaccatcgccgtgagcatggccaacatcttccgcgggtcctacctcgcgggcgccggcctgctgttcagcatcatgaagaacacggccaacacccggcgcgggaccggcaacaccggggagacgctcggcgagaagtggaagaaccggctgaacgccctgggcaagtccgagttccagatctacaagaagtccgggatccaggaggtcgaccgcaccctcgcgaaggagggcatcaagcgcggggagaccgaccaccacgccgtgtcccgcggcagcgccaagctgcggtggttcgtggagcgcaacctggtcacccccgaggggaaggtggtggacctcggctgcggccgcggcgggtggtcctactactgcggcgggctgaagaacgtcaaggaggtgaaggggctgacgaagggcgggcccgggcacgaggagcccatcccgatgagcacctacggctggaacctcgtgcgcctgcagtccggggtcgacgtgttcttcacgccgcccgagaagtgcgacaccctgctctgcgacatcggcgagagcagccccaacccgacggtggaggccgggcggaccctgcgcgtcctgaccctcgtggagaactggctgaacaacaacacccagttctgcatcaaggtgctgaacccctacatgccctccgtcatcgagaagatggaggccctgcagcggaagtacggcggcgcgctcgtgcgcaacccgctgagccggaactccacccacgagatgtactgggtgagcaacgcctccgggaacatcgtcagctccgtgaacatgatcagccgcatgctgatcaaccggttcacgatgcgccacaagaaggccacctacgagcccgacgtggacctcggctccgggacccggaacatcggcatcgagagcgagacccccaacctggacatcatcgggaagcgcatcgagaagatcaagcaggagcacgagacgtcctggcactacgaccaggaccacccctacaagacctgggcctaccacggcagctacgagaccaagcagaccggctccgccagctccatggtcaacggggtggtgcgcctgctcacgaagccgtgggacgtcatccccatggtgacccagatggcgatgaccgacaccacgcccttcggccagcagcgggtgttcaaggagaaggtcgacacccgcacccaggagcccaaggaggggaccaagaagctgatgaagatcacggccgagtggctgtggaaggagctcggcaagaagaagaccccgcggatgtgcacccgcgaggagttcacccggaaggtgcgcagcaacgccgccctgggcgccatcttcacggacgagaacaagtggaagtccgcgcgggaggccgtcgaggacagcgggttctgggagctggtggacaaggagcgcaacctccacctggagggcaagtgcgagacctgcgtgtacaacatgatggggaagcgggagaagaagctgggcgagttcgggaaggccaagggctcccgcgccatctggtacatgtggctcggcgcgcggttcctggagttcgaggccctggggttcctcaacgaggaccactggttcagccgcgagaacagcctgtccggcgtcgagggggagggcctgcacaagctcgggtacatcctgcgggacgtgagcaagaaggagggcggcgccatgtacgccgacgacaccgccgggtgggacacccgcatcacgctggaggacctcaagaacgaggagatggtgaccaaccacatggagggcgagcacaagaagctggcggaggccatcttcaagctgacctaccagaacaaggtcgtgcgggtgcagcgccccacgccccgggggacggtcatggacatcatctcccgccgggaccagcgcggcagcggccaggtggtgacctacggcctcaacaccttcaccaacatggaggcccagctgatccggcagatggagggcgagggggtcttcaagtccatccagcagctgacggccaccgaggagatcgccgtgaagaactggctcgtgcgcgtcggccgcgagcggctgagccgcatggcgatctccggggacgactgcgtggtgaagcccctggacgaccggttcgccagcgccctcaccgccctgaacgacatgggcaaggtccgcaaggacatccagcagtgggagccgtcccggggctggaacgactggacccaggtgcccttctgcagccaccacttccacgagctgatcatgaaggacgggcgcgtgctcgtcgtgccctgccggaaccaggacgagctgatcggccgcgcccggatctcccagggggcgggctggagcctgcgcgagacggcctgcctcgggaagtcctacgcccagatgtggagcctgatgtacttccaccggcgcgacctgcggctcgccgccaacgcgatctgctccgccgtgcccagccactgggtcccgacctcccgcaccacctggagcatccacgccacccacgagtggatgacgaccgaggacatgctgaccgtgtggaaccgggtgtggatccaggagaacccctggatggaggacaagacccccgtcgagagctgggaggagatcccctacctgggcaagcgcgaggaccagtggtgcggctccctcatcgggctgacgagccgggccacctgggcgaagaacatccagaccgccatcaaccaggtgcgctccctgatcggcaacgaggagtacaccgactacatgccgagcatgaagcggttccgccgcgaggaggaggaggccggggtgctctggtga

SEQ ID NO: 9048 - RNA, 9876 nt, synthetic construct
  misc_feature 1..9876: note = derived and/or modified CDS sequence (opt1) from DENV-2__KX380815__SS-prME
  source 1..9876: mol_type = other RNA
accgccgggatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggcgatggacctcggggagctgtgcgaggacaccatcacctacaactgccccctgctccggcagaacgagcccgaggacatcgactgctggtgcaacagcacctccacctgggtgacctacgggacctgcaccgccaccggcgagcaccggcgggagaagcggagcgtcgccctggtgccccacgtgggcatggggctggagacccggaccgagacctggatgtccagcgagggcgcctggaagcacgcccagcggatcgagacctgggtcctccgccaccccgggttcacgatcatggcggccatcctggcctacaccatcggcaccacctacttccagcgggtgctgatcttcatcctcctgacggccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgaccgagaacgaggtcaagctgacgatcatgaccggggacatcaagggcatcatgcaggccgggaagcggtccctccgcccgcagcccaccgagctgaagtacagctggaaggcgtggggcaaggccaagatgctgtccaccgagctccacaaccacacgttcctgatcgacggccccgagaccgccgagtgcccgaacaccaaccgggcctggaacagcctggaggtggaggactacgggttcggcgtgttcaccacgaacatctggctcaagctgaaggagcgccaggacgtctcctgcgacagcaagctgatgtccgccgcgatcaaggacaaccgggccgtgcacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggcggctggagatggacttcgacttctgcgagggcacgaccgtggtcgtgaccgaggactgcgggaaccgcggccccagcctgcggaccacgaccgcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtcacggccggccacgggcagatcgacaacttcagcctcggcgtgctgggcatggcgctgttcctcgaggagatgctgcgcacccgggtggggaccaagcacgccatcctgctcgtcgccgtgtccttcgtgaccctgatcacgggcaacatgagcttccgcgacctggggcgcgtcatggtgatggtgggcgccaccatgaccgacgacatcgggatgggcgtcacctacctcgccctgctggcggccttcaaggtgcggcccacgttcgccgccggcctcctgctgcgcaagctcacctccaaggagctgatgatgaccaccatcgggatcgtgctgctcagccagtccacgatccccgagaccatcctggagctgaccgacgccctcgcgctgggcatgatggtcctgaagatcgtgcggaacatggagaagtaccagctcgccgtcaccatcatggccatcctgtgcgtgccgaacgccgtgatcctgcagaacgcctggaaggtcagctgcacgaccctcgcggtggtgtccgtcagccccctgctgctcacctccagccagcagaagaccgactggatccccctggccctgacgatcaaggggctcaaccccaccgccatcttcctgaccaccctgtcccgcacgagcaagaagcggtcctggccgctcaacgaggccatcatggcggtgggcatggtgagcatcctggcctccagcttcctgaagaacgacatccccatgaccggccccctcgtcgccgggggcctgctgaccgtgtgctacgtgctcaccgggcgcagcgccgacctggagctggagcgggccgcggacatccgctgggaggagcaggccgagatctccggcagctcccccatcctcagcatcacgatctccgaggacgggagcatgtccatcaagaacgaggaggaggagcagaccctgaccatcctgatccggaccggcctcctggtcatcagcggcctgttcccggtgtccatccccatcaccgccgccgcctggtacctctgggaggtgaagaagcagcgcgcgggggtcctgtgggacgtgcccagcccgccgcccgtgggcaaggccgagctggaggacggggcctaccggatcaagcagaagggcatcctcgggtactcccagatcggcgccggcgtctacaaggaggggacgttccacaccatgtggcacgtgacccgcggcgccgtgctgatgcacaaggggaagcggatcgagcccagctgggcggacgtcaagaaggacctgatctcctacggcgggggctggaagctcgagggcgagtggaaggagggggaggaggtccaggtgctggccctggagcccggcaagaacccccgcgccgtccagaccaagcccggcctcttcaagacgaacaccggcaccatcggggccgtgagcctggacttctcccccggcaccagcggctcccccatcgtggacaagaaggggaaggtcgtgggcctgtacgggaacggcgtggtcacgcggagcggcacctacgtgtccgccatcgcgcagaccgagaagaacatcgaggacaaccccgagatcgaggacgacatcttccgcaagaagcggctcaccatcatggacctgcaccccggggccggcaagacgaagcgctacctgcccgccatcgtgcgggaggccatcaagcgcgggctgcggaccctcatcctggcgccgacccgcgtcgtggccgccgagatggaggaggccctgcgcggcctccccatccggtaccagacccccgccatccgcgcggagcacacggggcgggagatcgtggacctgatgtgccacgccaccttcaccatgcgcctgctcagccccatccgggtcccgaactacaacctgatcatcatggacgaggcccacttcaccgaccccgccagcatcgccgcgcgcggctacatctccacgcgggtggagatgggcgaggccgccgggatcttcatgaccgccacgccgcccggcagccgcgacccgttcccccagtccaacgcccccatcatggacgaggagcgggagatccccgagcgcagctggaactccgggcacgagtgggtgaccgacttcaagggcaagacggtctggttcgtgccgagcatcaaggcggggaacgacatcgccgcctgcctgcggaagaacggcaagaaggtgatccagctctcccgcaagaccttcgacagcgagtacgtcaagacccggaccaacgactgggacttcgtggtgacgaccgacatctccgagatgggcgccaacttcaaggcggagcgcgtcatcgacccccggcgctgcatgaagcccgtgatcctgaccgacggggaggagcgggtgatcctggccggccccatgccggtcacccacagctccgccgcccagcgccgggggcgcgtgggccgcaaccccaagaacgagaacgaccagtacatctacatgggggagcccctcgagaacgacgaggactgcgcccactggaaggaggcgaagatgctgctggacaacatcaacacgcccgagggcatcatcccgagcatgttcgagcccgagcgggagaaggtggacgccatcgacggcgagtaccgcctccgcggggaggcccgcaagaccttcgtcgacctgatgcggcgcggcgacctgcccgtgtggctcgcctaccgggtcgccgcggaggggatcaactacgccgaccgccggtggtgcttcgacggcgtgaagaacaaccagatcctggaggagaacgtggaggtcgagatctggaccaaggagggggagcgcaagaagctgaagccgcggtggctcgacgcccgcatctactccgaccccctggccctgaaggagttcaaggagttcgccgcgggccgcaagagcctcaccctgaacctgatcacggagatgggccgcctccccaccttcatgacccagaaggcccggaacgccctggacaacctggccgtgctccacaccgcggaggccgggggccgcgcctacaaccacgccctgtccgagctgcccgagacgctcgagaccctgctgctcctgaccctgctcgccaccgtgaccgggggcatcttcctgttcctgatgagcggcaaggggatcggcaagatgacgctcgggatgtgctgcatcgtcaccgcgtccatcctgctgtggtacgcccagatccagccgcactggatcgccgccagcatcatcctcgagttcttcctgatcgtgctgctcatccccgagcccgagaagcagcggacgccccaggacaaccagctgacctacgtggtcatcgccatcctgacggtggtggcggccaccatggccaacgagatgggcttcctcgagaagaccaagaaggacttcgggctgggctccatcaccacgcagcagccggagagcaacatcctggacatcgacctccgccccgccagcgcctggaccctgtacgcggtcgccaccaccttcatcacgcccatgctgcggcactccatcgagaacagctccgtgaacgtgagcctcaccgccatcgccaaccaggccaccgtcctgatgggcctggggaagggctggcccctctccaagatggacatcggggtgccgctgctggcgatcggctgctacagccaggtgaaccccatcaccctcacggccgccctgctgctcctggtcgcccactacgcgatcatcgggcccggcctgcaggccaaggccacccgcgaggcccagaagcgggccgcggccggcatcatgaagatccccgccgccctcatcatgaccgtgatcgacctggacccgatcccctacgaccccaagttcgagaagcagctgggccaggtgatgctcctggtcctgtgctccacccaggtgctcatgatgcgcacgacctgggccctgtgcgaggcgctgaccctcgccaccggccccatcagcacgctgtgggaggggaacccgggccgcttctggaacaccaccatcgccgtgtccatggccaacatcttccgggggagctacctggccggcgcgggcctcctgttctccatcatgaagaacaccgccaacacgcgccgggggaccggcaacaccggggagaccctgggcgagaagtggaagaaccagctcaacgccctgggcaagagcgagttccagatctacaagaagtccgggatccaggaggtcgaccgcacgctggccaaggagggcatcaagcgcggggagaccgaccaccacgcggtgagccgcggctccgccaagctccggtggttcgtggagcgcaacctggtcacccccgaggggaaggtggtggacctgggctgcggccgcggcgggtggagctactactgcggcgggctcaagaacgtcaaggaggtgaaggggctgaccaagggcgggcccgggcacgaggagcccatcccgatgtccacgtacggctggaacctggtgcgcctccagagcggggtcgacgtgttcttcacgccgcccgagaagtgcgacaccctgctgtgcgacatcggcgagtccagccccaacccgaccgtggaggccgggcggaccctccgcgtcctgaacctggtggagaactggctcaacaacaacacgcagttctgcatcaaggtgctgaacccctacatgcccagcgtcatcgagaagatggaggccctgcagcggaagtacggcggcgccctggtgcgcaacccgctctcccggaacagcacccacgagatgtactgggtgtccaacgcgagcgggaacatcgtctccagcgtgaacatgatctcccgcatgctgatcaaccggttcaccatgcgccacaagaaggccacctacgagcccgacgtggacctgggcagcgggacgcggaacatcggcatcgagtccgaggtccccaacctcgacatcatcgggaagcgcatcgagaagatcaagcaggagcacgagaccagctggcactacgaccaggaccacccctacaagacctgggcctaccacggctcctacgagaccaagcagacgggcagcgcctccagcatggtgaacggggtggtccgcctgctgaccaagccgtgggacgtgatccccatggtgacccagatggccatgaccgacacgacccccttcggccagcagcgggtcttcaaggagaaggtggacacccgcacccaggagcccaaggaggggacgaagaagctcatgaagatcaccgcggagtggctgtggaaggagctgggcaagaagaagaccccgcggatgtgcacccgcgaggagttcacgcggaaggtccgctccaacgccgccctcggcgccatcttcaccgacgagaacaagtggaagtccgcccgggaggcggtggaggactccgggttctgggagctggtggacaaggagcgcaacctgcacctcgagggcaagtgcgagacctgcgtctacaacatgatggggaagcgggagaagaagctgggcgagttcgggaaggccaagggcagccgcgccatctggtacatgtggctgggcgcccggttcctcgagttcgaggcgctggggttcctgaacgaggaccactggttctcccgcgagaacagcctcagcggcgtggagggggagggcctgcacaagctggggtacatcctccgggacgtgtccaagaaggagggcggcgccatgtacgccgacgacaccgccgggtgggacacgcgcatcaccctggaggacctgaagaacgaggagatggtcaccaaccacatggagggcgagcacaagaagctcgccgaggcgatcttccggctgacctaccagaacaaggtggtgcgcgtccagcggcccacgccccgcgggaccgtgatggacatcatcagccggcgcgaccagcggggctccggccaggtggtcacctacggcctgaacaccttcacgaacatggaggcccagctcatccgccagatggagggcgagggggtgttcaagagcatccagcacctgaccgccaccgaggagatcgccgtgaagaactggctggtccgcgtgggccgggagcgcctctcccggatggccatcagcggggacgactgcgtggtcaagcccctggacgaccgcttcgcgaacgccctgaccgccctcaacgacatgggcaaggtgcggaaggacatccagcagtgggagccgtcccgcggctggaacgactggacccaggtgcccttctgcagccaccacttccacgagctgatcatgaaggacgggcgggtcctggtggtgccctgccgcaaccaggacgagctcatcggccgggcccgcatctcccagggggccggctggagcctgcgggagaccgcgtgcctggggaagtcctacgcccagatgtggagcctcatgtacttccaccgccgggacctgcgcctggccgccaacgccatctgctccgcggtccccagccactgggtgccgacctcccggaccacctggagcatccacgccacgcacgagtggatgaccaccgaggacatgctcaccgtgtggaaccgcgtctggatccaggagaacccctggatggaggacaagacgcccgtggagtcctgggaggagatcccctacctgggcaagcgggaggaccagtggtgcggcagcctgatcgggctcaccagccgcgccacctgggccaagaacatccagaccgcgatcaaccaggtgcggtccctgatcggcaacgaggagtacacggactacatgccgagcatgaagcgcttccgccgggaggaggaggaggccggggtcctgtggtga

SEQ ID NO: 9049 - RNA, 9876 nt, synthetic construct
  misc_feature 1..9876: note = derived and/or modified CDS sequence (opt1) from DENV-2__KX380816__SS-prME
  source 1..9876: mol_type = other RNA
accgcgggcatcatcatcatgatgatccccaccgtgatggccttccacctgaccacccgcaacggggagccccacatgatcgtcagccggcaggagaagggcaagtccctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcaccatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggaccctgcgcccccagccgaccgagctgaagtactcctggaaggcgtggggcaaggccaagatgctcagcacggagctgcacaaccacaccttcctgatcgacggccccgagaccgccgagtgccccaacaccaaccgggcctggaactccctcgaggtggaggactacgggttcggcgtcttcacgaccaacatctggctgaagctgaaggagcgccaggacgtgttctgcgacagcaagctcatgtccgccgcgatcaaggacaaccgggccgtgcacgccgacatggggtactggatcgagagcgccctgaacgacacctggaagatcgagaaggcctccttcatcgaggtcaagagctgccactggccgaagtcccacaccctgtggagcaacggcgtgctcgagtccgagatgatcatccccaagaacttcgcgggccccgtgagccagcacaactaccgccccgggtaccacacccagacggccggcccgtggcacctggggcggctggagatggacttcgacttctgcgagggcaccaccgtcgtggtgaccgaggactgcgggaaccgcggcccctccctccggacgaccaccgccagcggcaagctgatcaccgagtggtgctgccgcagctgcacgctgccgcccctccggtaccgcggggaggacggctgctggtacgggatggagatccggccgctgaaggagaaggaggagaacctggtcaactccctcgtgaccgccggccacgggcagatcgacaacttcagcctgggcgtgctgggcatggccctcttcctggaggagatgctgcgcacccgggtcgggaccaagcacgccatcctcctggtggccgtgtccttcgtcacgctgatcaccggcaacatgagcttccgcgacctcgggcgcgtgatggtgatggtcggcgccaccatgaccgacgacatcgggatgggcgtgacgtacctggccctgctcgcggccttcaagatccggcccaccttcgccgccggcctgctgctccgcaagctgacctccaaggagctgatgatgaccacgatcgggatcgtgctcctgagccagtccaccatccccgagagcatcctggagctcaccgacgccctggcgctgggcatgatggtcctcaagatcgtgcggaacatggagaagtaccagctggccgtcaccatcatggccatcctgtgcgtgcccaacgccgtgatcctccagaacgcctggaaggtctcctgcacgaccctggcggtggtgagcgtctccccgctgctcctgaccagctcccagcagaaggccgactggatccccctggccctcaccatcaaggggctgaaccccacggccatcttcctgaccaccctcagccgcacctccaagaagcggagctggcccctgaacgaggcgatcatggccgtgggcatggtgtccatcctggccagctccctcctgaagaacgacatcccgatgacgggccccctggtcgccgggggcctcctgaccgtgtgctacgtgctgaccgggcgcagcgccgacctcgagctggagcgggcggccgacgtccgctgggaggagcaggccgagatcagcggctccagccccatcctgtccatcaccatcagcgaggacgggtccatgagcatcaagaacgaggaggaggagcagacgctcaccatcctgatccggaccggcctgctcgtgatctccggcctgttccccgtgagcatcccgatcaccgccgccgcgtggtacctgtgggaggtcaagaagcagcgcgccggggtgctctgggacgtgcccagcccgccgcccgtcggcaaggccgagctggaggacggggcctaccggatcaagcagaagggcatcctggggtacagccagatcggcgccggcgtgtacaaggaggggaccttccacacgatgtggcacgtgacccgcggcgcggtcctcatgcacaaggggaagcggatcgagccctcctgggccgacgtgaagaaggacctgatcagctacggcgggggctggaagctggagggcgagtggaaggagggggaggaggtgcaggtcctcgccctggagcccggcaagaacccccgcgccgtgcagaccaagcccgggctgttcaagaccaacacgggcaccatcggggccgtgtccctcgacttcagccccggcacctccggcagccccatcgtcgacaagaaggggaaggtggtgggcctgtacgggaacggcgtcgtgacccggtccggcacgtacgtgagcgcgatcgcccagaccgagaagtccatcgaggacaacccggagatcgaggacgacatcttccgcaagaagcggctgaccatcatggacctgcaccccggggccggcaagaccaagcgctacctccccgccatcgtccgggaggcgatcaagcgcgggctgcggacgctgatcctcgcccccacccgcgtggtggccgccgagatggaggaggccctgcgcggcctgccgatccggtaccagacccccgcgatccgcgccgagcacaccgggcgggagatcgtcgacctcatgtgccacgccacgttcaccatgcgcctgctgagccccatccgggtgcccaactacaacctcatcatcatggacgaggcccacttcaccgacccggccagcatcgcggcccgcggctacatctccacccgggtggagatgggcgaggccgccgggatcttcatgacggccacgccgcccggcagccgcgaccccttcccgcagtccaacgcgcccatcatggacgaggagaaggagatccccgagcggagctggaactccgggcacgagtgggtcaccgacttcaagggcaagaccgtgtggttcgtgcccagcatcaaggccgggaacgacatcgccgcctgcctgcgcaagaacggcaagaaggtcatccagctgtcccggaagacgttcgacagcgagtacatcaagacccgcaccaacgactgggacttcgtggtgaccacggacatctccgagatgggcgcgaacttcaaggccgagcgggtcatcgacccgcgccggtgcatgaagcccgtgatcctcaccgacggggaggagcgcgtgatcctggccggccccatgcccgtcacccacagctccgccgcccagcggcgcgggcgggtgggccgcaacccgaagaacgagaacgaccagtacatctacatgggggagcccctggagaacgacgaggactgcgcgcactggaaggaggccaagatgctcctggacaacatcaacacccccgagggcatcatccccagcatgttcgagccggagcgcgagaaggtggacgccatcgacggcgagtaccggctgcgcggggaggcccggaagacgttcgtcgacctcatgcgccggggcgacctgcccgtgtggctggcctaccgcgtcgcggccgaggggatcaactacgccgaccggcgctggtgcttcgacggcgtgaagaacaaccagatcctcgaggagaacgtggaggtcgagatctggaccaaggagggggagcggaagaagctgaagccccgctggctggacgcccggatctactccgacccgctcgccctgaaggagttcaaggagttcgcggccggccgcaagagcctgaccctcaacctgatcaccgagatgggccggctgcccacgttcatgacccagaaggccaagaacgccctcgacaacctggcggtgctgcacaccgccgaggccgggggccgcgcctacaaccacgccctctccgagctgcccgagaccctggagacgctcctgctgctcaccctgctggcgaccgtgaccgggggcatcttcctcttcctgatgagcggcaaggggatcggcaagatgaccctggggatgtgctgcatcatcacggcctccatcctcctgtggcacgcccagatccagccccactggatcgccgccagcatcatcctggagttcttcctcatcgtcctgctgatcccggagcccgagaagcagcggacgccccaggacaaccagctcacctacgtggtgatcgcgatcctgaccgtcgtggccgccacgatggccaacgagatgggcttcctggagaagaccaagaaggacttcgggctcggctccatcaccacccagcagcccgagagcaacatcctggacatcgacctgcgcccggccagcgcgtggacgctctacgccgtggccaccaccttcatcacccccatgctgcggcactccatcgagaacagctccgtcaacgtgagcctgacggccatcgccaaccaggcgaccgtgctcatgggcctggggaagggctggcccctgtccaagatggacatcggggtccccctcctggccatcggctgctacagccaggtgaacccgatcaccctgaccgccgccctcctgctgctcgtggcgcactacgccatcatcgggcccggcctgcaggccaaggccacgcgcgaggcccagaagcgggcggccgccggcatcatgaagaaccccaccgtcgacgggatgaccgtgatcgacctggaccccatcccgtacgaccccaagttcgagaagcagctcggccaggtgatgctgctggtcctctgcgtgacccaggtgctgatgatgcgcacgacctgggccctgtgcgaggccctcaccctggcgaccgggcccatctccacgctgtgggagggcaaccccgggcggttctggaacaccaccatcgccgtcagcatggccaacatcttccgcggctcctacctcgccggcgccgggctgctgttcagcatcatgaagaacaccgcgaacacgcgccggggcaccgggaacaccggcgagaccctcggcgagaagtggaagaaccgcctgaacgccctggggaagtccgagttccagatctacaagaagtccggcatccaggaggtggaccggacgctcgccaaggaggggatcaagcgcggcgagaccgaccaccacgccgtgagccgggggagcgcgaagctgcgctggttcgtcgagcggaacctggtgaccccggagggcaaggtggtcgacctcggctgcgggcgcggcgggtggtcctactactgcggcgggctgaagaacgtgaaggaggtgaagggcctgaccaagggcgggcccggccacgaggagcccatccccatgagcacgtacgggtggaacctcgtccggctgcagtccggcgtggacgtgttcttcaccagcccggagaagtgcgacaccctgctctgcgacatcggggagtccagccccaaccccaccgtcgaggccggccgcaccctgcgggtgctgaacctcgtggagaactggctgaacaacaacacgcagttctgcatcaaggtcctgaacccctacatgccgagcgtgatcgagaagatggaggccctgcagcgcaagtacggcggggccctcgtgcggaaccccctgtcccgcaacagcacccacgagatgtactgggtctccaacgccagcggcaacatcgtgtccagcgtgaacatgatctcccggatgctgatcaaccgcttcaccatgcggcacaagaaggcgacctacgagcccgacgtcgacctcgggagcggcacgcgcaacatcgggatcgagtccgagaccccgaacctggacatcatcggcaagcggatcgagaagatcaagcaggagcacgagaccagctggcactacgaccaggaccacccctacaagacctgggcctaccacggctcctacgagacgaagcagaccgggagcgcctccagcatggtgaacggcgtggtccgcctgctcaccaagccctgggacgtgatccccatggtgacccagatggccatgacggacaccaccccgttcgggcagcagcgcgtcttcaaggagaaggtggacacccggacgcaggagcccaaggagggcaccaagaagctgatgaagatcaccgccgagtggctgtggaaggagctcggcaagaagaagacgccccgcatgtgcacgcgggaggagttcacccgcaaggtccggtccaacgcggccctgggggccatcttcaccgacgagaacaagtggaagtccgcccgcgaggccgtggaggactccggcttctgggagctggtggacaaggagcggaacctccacctggaggggaagtgcgagacctgcgtctacaacatgatgggcaagcgcgagaagaagctgggggagttcggcaaggcgaagggcagccgggccatctggtacatgtggctcggggcccgcttcctggagttcgaggccctgggcttcctcaacgaggaccactggttctcccgggagaacagcctgagcggggtggagggcgaggggctgcacaagctcggctacatcctgcgcgacgtgtccaagaaggagggcggggcgatgtacgccgacgacacggccggctgggacacccggatcaccctggaggacctcaagaacgaggagatggtcaccaaccacatggagggggagcacaagaagctggccgaggccatcttcaagctgacgtaccagaacaaggtggtgcgcgtccagcggcccaccccgcgcggcaccgtgatggacatcatcagccggcgcgaccagcgggggtccggccaggtggtcacctacggcctcaacacgttcaccaacatggaggcgcagctgatccgccagatggagggggagggcgtgttcaagagcatccagcagctgaccgtgaaggaggagatcgccgtcaagaactggctcatccgggtggggcgcgagcgcctgtcccggatggccatcagcggcgacgactgcgtggtcaagcccctggacgaccgcttcgcctccgccctcaccgcgctgaacgacatgggcaaggtgcggaaggacatccagcagtgggagcccagccgcgggtggaacgactggacccaggtgcccttctgctcccaccacttccacgagctgatcatgaaggacggccgggtcctcgtggtgccgtgccgcaaccaggacgagctgatcgggcgggcccgcatcagccagggcgccgggtggtccctgcgggagaccgcctgcctcggcaagagctacgcccagatgtggtccctgatgtacttccaccgccgggacctgcgcctcgcggccaacgccatctgcagcgccgtcccctcccactggatccccaccagccggaccacctggtccatccacgccacgcacgagtggatgaccaccgaggacatgctgaccgtgtggaaccgcgtgtggatccaggagaacccctggatggaggacaagacgccggtcgagagctgggaggagatcccctacctgggcaagcgggaggaccagtggtgcgggagcctcatcggcctgacctcccgcgcgacctgggccaagaacatccagaccgccatcaaccaggtgcggagcctgatcgggaacgaggagtacacggactacatgccctccatgaagcgcttccggcgcgaggaggaggaggccggcgtgctctggtga

SEQ ID NO: 9050 - RNA, 9876 nt, synthetic construct
  misc_feature 1..9876: note = derived and/or modified CDS sequence (opt1) from DENV-2__KX380817__SS-prME
  source 1..9876: mol_type = other RNA
accgcgggcatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaagatcacgccccagagctccatcaccgaggccgagctgaccggctacgggaccgtcacgatggagtgcagcccgcgcaccggcctcgacttcaacgagatggtgctgctgcagatggagaacaaggcctggctcgtgcaccggcagtggttcctggacctgcccctcccctggctgcccggcgcggacacccaggggtccaactggatccagaaggagaccctggtcacgttcaagaacccgcacgccaagaagcaggacgtggtcgtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctcggccgcctgatcacggtgaaccccatcgtgaccgagaaggactccccggtcaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtgttcacctccatcggcaaggcgctccaccaggtcttcggggccatctacggcgccgccttcagcggcgtgtcctggaccatgaagatcctgatcggggtggtcatcacctggatcggcatgaacagccgctccacgagcctgtccgtgagcctggtgctcgtcggggtggtgaccctgtacctgggcgtcatggtgcaggcggactccgggtgcgtggtcagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtgacccgcctggagaacctcatgtggaagcagatcacccccgagctgaaccacatcctgaccgagaacgaggtcaagctcacgatcatgaccggggacatcaagggcatcatgcaggccgggaagcggtccctgcgcccccagccgaccgagctgaagtacagctggaaggcgtggggcaaggccaagatgctctccaccgagctgcacaaccacacgttcctgatcgacggccccgagaccgccgagtgccccaacaccaaccgggcctggaacagcctcgaggtggaggactacgggttcggcgtgttcaccacgaacatctggctgaagctgaaggagcgccaggacgtcttctgcgactccaagctcatgagcgccgcgatcaaggacaaccgggccgtgcacgccgacatggggtactggatcgagtccgccctgaacgacacctggaagatcgagaaggccagcttcatcgaggtgaagtcctgccactggcccaagagccacaccctgtggtccaacggcgtcctcgagagcgagatgatcatccccaagaacttcgcgggccccgtgtcccagcacaactaccgccccgggtaccacacccagaccgccggcccgtggcacctggggcggctggagatggacttcgacttctgcgagggcacgaccgtggtcgtgaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtgaacagcctcgtcacggccggccacgggcagatcgacaacttctccctgggcgtgctgggcatggccctcttcctggaggagatgctgcgcacccgggtggggaccaagcacgccatcctcctggtcgccgtgagcttcgtgaccctgatcacgggcaacatgtccttccgcgacctcgggcgcgtcatggtgatggtgggcgccaccatgaccgacgacatcgggatgggcgtcacctacctggccctgctcgcggccttcaaggtgcggcccacgttcgccgccggcctgctgctccgcaagctgaccagcaaggagctgatgatgaccaccatcgggatcgtgctcctgtcccagagcacgatccccgagtccatcctggagctcaccgacgccctggcgctgggcatgatggtcctcaagatcgtgcggaacatggagaagtaccagctggccgtcaccatcatggccatcagctgcgtgcccaacgccgtgatcctgcagaacgcctggaaggtctcctgcaccacgctcgcggtggtgagcgtctccccgctgctgctcaccagctcccagcagaaggccgactggatccccctggccctgaccatcaaggggctcaaccccaccgccatcttcctgacgaccctgagccgcacctccaagaagcggagctggcccctcaacgaggcgatcatggccgtgggcatggtgtccatcctggccagcagcctgctcaagaacgacatcccgatgaccggccccctggtcgccgggggcctgctcacggtgtgctacgtgctgaccgggcgctccgccgacctggagctcgagcgggcggccgacgtccgctgggaggagcaggccgagatcagcggctccagccccatcctgtccatcaccatcagcgaggacgggtccatgagcatcaagaacgaggaggaggagcagaccctgacgatcctcatccggaccggcctgctggtgatctccggcctcttccccgtgagcatcccgatcaccgccgccgcgtggtacctgtgggaggtcaagaagcagcgcgccggggtgctgtgggacgtgcccagcccgccgcccgtcggcaaggccgagctcgaggacggggcctaccggatcaagcagaagggcatcctggggtacagccagatcggcgccggcgtgtacaaggaggggaccttccacaccatgtggcacgtgacgcgcggcgcggtcctgatgcacaaggggaagcggatcgagccctcctgggccgacgtgaagaaggacctcatcagctacggcgggggctggaagctggagggcgagtggaaggagggggaggaggtgcaggtcctggccctcgagcccggcaagaacccgcgcgccgtgcagaccaagcccgggctgttcaagaccaacaccggcacgatcggggccgtgtccctggacttcagccccggcacctccggcagccccatcgtcgacaagaaggggaaggtggtgggcctctacgggaacggcgtcgtgacccggtccggcacctacgtgagcgcgatcgcccagacggagaagtccatcgaggacaacccggagatcgaggacgacatcttccgcaagaagcggctgaccatcatggacctgcaccccggggccggcaagaccaagcgctacctgcccgccatcgtccgggaggcgatcaagcgcgggctccggaccctgatcctggcccccacgcgcgtggtggccgccgagatggaggaggccctccgcggcctgccgatccggtaccagacccccgcgatccgcgccgagcacaccgggcgggagatcgtcgacctgatgtgccacgccaccttcacgatgcgcctcctgagccccatccgggtgcccaactacaacctgatcatcatggacgaggcccacttcaccgacccggccagcatcgcggcccgcggctacatctccacccgggtggagatgggcgaggccgccgggatcttcatgaccgccacgccgcccggcagccgcgaccccttcccgcagtccaacgcgcccatcatggacgaggagcgggagatccccgagcgcagctggaactccgggcacgagtgggtcaccgacttcaagggcaagaccgtgtggttcgtgcccagcatcaaggccgggaacgacatcgccgcctgcctccggaagaacggcaagaaggtcatccagctgtcccgcaagaccttcgacagcgagtacatcaagacgcggaccaacgactgggacttcgtggtgaccaccgacatctccgagatgggcgcgaacttcaaggccgagcgcgtcatcgacccgcggcgctgcatgaagcccgtgatcctgacggacggggaggagcgggtgatcctcgccggccccatgcccgtcacccacagctccgccgcccagcgccgggggcgcgtgggccgcaacccgaagaacgagaacgaccagtacatctacatgggggagcccctggagaacgacgaggactgcgcgcactggaaggaggccaagatgctgctcgacaacatcaacacccccgagggcatcatccccagcatgttcgagccggagcgggagaaggtggacgccatcgacggcgagtaccgcctgcgcggggaggcccgcaagaccttcgtcgacctgatgcggcgcggcgacctccccgtgtggctggcctaccgggtcgcggccgaggggatcaactacgccgaccgccggtggtgcttcgacggcgtgaagaacaaccagatcctggaggagaacgtggaggtcgagatctggacgaaggagggggagcgcaagaagctcaagccccggtggctggacgcccgcatctactccgacccgctggccctcaaggagttcaaggagttcgcggccggccggaagtccctgaccctgaacctcatcaccgagatgggccgcctgcccaccttcatgacgcagaaggccaagaacgccctggacaacctcgcggtgctgcacaccgccgaggccgggggccgggcctacaaccacgccctgtccgagctccccgagaccctggagaccctgctcctgctgacgctcctggcgaccgtgaccgggggcatcttcctgttcctcatgagcggcaaggggatcggcaagatgaccctggggatgtgctgcatcatcaccgcctccatcctgctctggtacgcccagatccagccccactggatcgccgccagcatcatcctggagttcttcctgatcgtcctcctgatcccggagcccgagaagcagcgcacgccccaggacaaccagctgacctacgtggtgatcgcgatcctcaccgtcgtggccgccaccatggccaacgagatgggcttcctggagaagacgaagaaggacttcgggctgggcagcatcaccacccagcagcccgagtccaacatcctcgacatcgacctgcggccggccagcgcgtggaccctgtacgccgtggccacgaccttcatcacccccatgctccgccactccatcgagaacagctccgtcaacgtgagcctgaccgccatcgccaaccaggcgacggtgctgatgggcctcgggaagggctggcccctgtccaagatggacatcggggtccccctgctcgccatcggctgctacagccaggtgaacccgatcaccctgaccgccgccctgctcctgctggtggcgcactacgccatcatcgggcccggcctccaggccaaggccacccgggaggcccagaagcgcgcggccgccggcatcatgaagaaccccacggtcgacgggatgaccgtgatcgacctggaccccatcccgtacgaccccaagttcgagaagcagctgggccaggtgatgctcctggtcctgtgcgtgacccaggtgctcatgatgcggaccacgtgggccctgtgcgaggccctgaccctcgcgaccgggcccatctccaccctgtgggagggcaaccccgggcgcttctggaacacgaccatcgccgtcagcatggccaacatcttccgcggctcctacctggccggcgccgggctcctgttcagcatcatgaagaacaccgcgaacacccggcgcggcacggggaacaccggcgagaccctgggcgagaagtggaagaaccggctcaacgccctggggaagtccgagttccagatctacaagaagtccggcatccaggaggtggaccgcaccctggccaaggaggggatcaagcggggcgagacggaccaccacgccgtgtcccgcgggagcgcgaagctccggtggttcgtcgagcgcaacctggtgaccccggagggcaaggtggtcgacctgggctgcgggcggggcgggtggtcctactactgcggcgggctcaagaacgtgaaggaggtgaagggcctgaccaagggcgggcccggccacgaggagcccatccccatgagcacctacgggtggaacctggtccgcctccagtccggcgtggacgtgttcttcacgccgcccgagaagtgcgacaccctgctgtgcgacatcggggagagcagccccaaccccaccgtcgaggccggccggaccctccgcgtgctgaacctggtggagaactggctcaacaacaacacccagttctgcatcaaggtcctgaacccgtacatgccctccgtgatcgagaagatggaggccctgcagcggaagtacggcggggccctggtgcgcaaccccctcagccggaactccacgcacgagatgtactgggtcagcaacgcctccggcaacatcgtgagctccgtgaacatgatcagccgcatgctgatcaaccggttcaccatgcgccacaagaaggcgacctacgagccggacgtcgacctggggtccggcacccggaacatcgggatcgagagcgagacgcccaacctcgacatcatcggcaagcgcatcgagaagatcaagcaggagcacgagacctcctggcactacgaccaggaccacccctacaagacctgggcctaccacggcagctacgagaccaagcagacggggtccgccagctccatggtgaacggcgtggtccgcctgctgaccaagccctgggacgtgatcccgatggtgacccagatggccatgaccgacacgacccccttcgggcagcagcgggtcttcaaggagaaggtggacacccgcacccaggagcccaaggagggcacgaagaagctcatgaagatcaccgccgagtggctgtggaaggagctgggcaagaagaagacgccccggatgtgcacccgcgaggagttcacgcggaaggtccgcagcaacgcggccctcggggccatcttcaccgacgagaacaagtggaagtccgcccgggaggccgtggaggacagcggcttctgggagctggtggaccgcgagcggaacctgcacctcgaggggaagtgcgagacctgcgtctacaacatgatgggcaagcgcgagaagaagctgggggagttcggcaaggcgaagggctcccgggccatctggtacatgtggctgggggcccgcttcctcgagttcgaggccctgggcttcctgaacgaggaccactggttcagccgggagaacagcctctccggggtggagggcgaggggctgcacaagctgggctacatcctccgcgacgtgagcaagaaggagggcggggcgatgtacgccgacgacaccgccggctgggacacgcggatcaccctggaggacctgaagaacgaggagatggtcaccaaccacatggagggggagcacaagaagctcgccgaggccatcttcaagctgacctaccagaacaaggtggtgcgcgtccagcggccgacgccccgcggcaccgtgatggacatcatctcccggcgcgaccagcgggggagcggccaggtggtcacctacggcctgaacaccttcacgaacatggaggcgcagctcatccgccagatggagggggagggcgtgttcaagtccatccagcagctgaccgtgaaggaggagatcgccgtcaagaactggctgatccgcgtggggcgggagcgcctcagccggatggccatctccggcgacgactgcgtggtcaagcccctggacgaccgcttcgccagcgccctgaccgcgctcaacgacatgggcaaggtgcggaaggacatccagcagtgggagccctcccgcgggtggaacgactggacccaggtgccgttctgcagccaccacttccacgagctgatcatgaaggacggccgggtcctggtggtgccctgccgcaaccaggacgagctcatcgggcgggcccgcatctcccagggcgccgggtggagcctgcgggagacggcctgcctgggcaagtcctacgcccagatgtggagcctcatgtacttccaccgccgggacctgcgcctggcggccaacgccatctgctccgccgtccccagccactggatccccacctcccggaccacctggagcatccacgccacccacgagtggatgacgaccgaggacatgctcaccgtgtggaaccgcgtgtggatccaggagaacccgtggatggaggacaagacccccgtcgagagctgggaggagatcccctacctgggcaagcgggaggaccagtggtgcgggtccctgatcggcctcacgagccgcgcgacctgggccaagaacatccagaccgccatcaaccaggtgcggtccctgatcgggaacgaggagtacaccgactacatgcccagcatgaagcgcttccgccgggaggaggaggaggccggcgtgctgtggtga

SEQ ID NO: 9051 - RNA, 9876 nt, synthetic construct
  misc_feature 1..9876: note = derived and/or modified CDS sequence (opt1) from DENV-2__KX380818__SS-prME
  source 1..9876: mol_type = other RNA
accgccgggatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccggcagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcaccatcatggcggccatcctggcctacaccatcggcaccacctacttccagcgggtgctgatcttcatcctcctgacggccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgaccgagaacgaggtcaagctgacgatcatgaccggggacatcaagggcatcatgcaggccgggaagcggtccctccgcccgcagcccaccgagctgaagtacagctggaaggcgtggggcaaggccaagatgctgtccaccgagctccacaaccacacgttcctgatcgacggccccgagaccgccgagtgcccgaacaccaaccgggcctggaacagcctggaggtggaggactacgggttcggcgtgttcaccacgaacatctggctcaagctgaaggagcgccaggacgtctcctgcgacagcaagctgatgtccgccgcgatcaaggacaaccgggccgtgcacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggcggctggagatggacttcgacttctgcgagggcacgaccgtggtcgtgaccgaggactgcgggaaccgcggccccagcctgcggaccacgaccgcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtcacggccggccacgggcagatcgacaacttcagcctcggcgtgctgggcatggcgctgttcctcgaggagatgctgcgcacccgggtggggaccaagcacgccatcctgctcgtcgccgtgtccttcgtgaccctgatcacgggcaacatgagcttccgcgacctggggcgcgtcatggtgatggtgggcgccaccatgaccgacgacatcgggatgggcgtcacctacctcgccctgctggcggccttcaaggtgcggcccacgttcgccgccggcctcctgctgcgcaagctcacctccaaggagctgatgatgaccaccatcgggatcgtgctgctcagccagtccacgatccccgagaccatcctggagctgaccgacgccctcgcgctgggcatgatggtcctgaagatcgtgcggaacatggagaagtaccagctcgccgtcaccatcatggccatcctgtgcgtgccgaacgccgtgatcctgcagaacgcctggaaggtcagctgcacgaccctcgcggtggtgtccgtcagccccctgctgctcacctccagccagcagaagaccgactggatccccctggccctgacgatcaaggggctcaaccccaccgccatcttcctgaccaccctgtcccgcacgagcaagaagcggtcctggccgctcaacgaggccatcatggcggtgggcatggtgagcatcctggcctccagcttcctgaagaacgacatccccatgaccggccccctcgtcgccgggggcctgctgaccgtgtgctacgtgctcaccgggcgcagcgccgacctggagctggagcgggccgcggacatccgctgggaggagcaggccgagatctccggcagctcccccatcctcagcatcacgatctccgaggacgggagcatgtccatcaagaacgaggaggaggagcagaccctgaccatcctgatccggaccggcctcctggtcatcagcggcctgttcccggtgtccatccccatcaccgccgccgcctggtacctctgggaggtgaagaagcagcgcgcgggggtcctgtgggacgtgcccagcccgccgcccgtgggcaaggccgagctggaggacggggcctaccggatcaagcagaagggcatcctcgggtactcccagatcggcgccggcgtctacaaggaggggacgttccacaccatgtggcacgtgacccgcggcgccgtgctgatgcacaaggggaagcggatcgagcccagctgggcggacgtcaagaaggacctgatctcctacggcgggggctggaagctcgagggcgagtggaaggagggggaggaggtccaggtgctggccctggagcccggcaagaacccccgcgccgtccagaccaagcccggcctgttcaagacgaacaccggcaccatcggggccgtgagcctggacttctcccccggcaccagcggctcccccatcgtggacaagaaggggaaggtcgtgggcctgtacgggaacggcgtggtcacgcggagcggcacctacgtgtccgccatcgcgcagaccgagaagaacatcgaggacaaccccgagatcgaggacgacatcttccgcaagaagcggctcaccatcatggacctgcaccccggggccggcaagacgaagcgctacctgcccgccatcgtgcgggaggccatcaagcgcgggctgcggaccctcatcctggcgccgacccgcgtcgtggccgccgagatggaggaggccctgcgcggcctccccatccggtaccagacccccgccatccgcgcggagcacacggggcgggagatcgtggacctgatgtgccacgccaccttcaccatgcgcctgctcagccccatccgggtcccgaactacaacctgatcatcatggacgaggcccacttcaccgaccccgccagcatcgccgcgcgcggctacatctccacgcgggtggagatgggcgaggccgccgggatcttcatgaccgccacgccgcccggcagccgcgacccgttcccccagtccaacgcccccatcatggacgaggagcgggagatccccgagcgcagctggaactccgggcacgagtgggtgaccgacttcaagggcaagacggtctggttcgtgccgagcatcaaggcggggaacgacatcgccgcctgcctgcggaagaacggcaagaaggtgatccagctctcccgcaagaccttcgacagcgagtacgtcaagacccggaccaacgactgggacttcgtggtgacgaccgacatctccgagatgggcgccaacttcaaggcggagcgcgtcatcgacccccggcgctgcatgaagcccgtgatcctgaccgacggggaggagcgggtgatcctggccggccccatgccggtcacccacagctccgccgcccagcgccgggggcgcgtgggccgcaaccccaagaacgagaacgaccagtacatctacatgggggagcccctcgagaacgacgaggactgcgcccactggaaggaggcgaagatgctgctggacaacatcaacacgcccgagggcatcatcccgagcatgttcgagcccgagcgggagaaggtggacgccatcgacggcgagtaccgcctccgcggggaggcccgcaagaccttcgtcgacctgatgcggcgcggcgacctgcccgtgtggctcgcctaccgggtcgccgcggaggggatcaactacgccgaccgccggtggtgcttcgacggcgtgaagaacaaccagatcctggaggagaacgtggaggtcgagatctggaccaaggagggggagcgcaagaagctgaagccgcggtggctcgacgcccgcatctactccgaccccctggccctgaaggagttcaaggagttcgccgcgggccgcaagagcctcaccctgaacctgatcacggagatgggccgcctccccaccttcatgacccagaaggcccggaacgccctggacaacctggccgtgctccacaccgcggaggccgggggccgcgcctacaaccacgccctgtccgagctgcccgagacgctcgagaccctgctgctcctgaccctgctcgccaccgtgaccgggggcatcttcctgttcctgatgagcggcaaggggatcggcaagatgacgctcgggatgtgctgcatcgtcaccgcgtccatcctgctgtggtacgcccagatccagccgcactggatcgccgccagcatcatcctcgagttcttcctgatcgtgctgctcatccccgagcccgagaagcagcggacgccccaggacaaccagctgacctacgtggtcatcgccatcctgacggtggtggcggccaccatggccaacgagatgggcttcctcgagaagaccaagaaggacttcgggctgggctccatcaccacgcagcagccggagagcaacatcctggacatcgacctccgccccgccagcgcctggaccctgtacgcggtcgccaccaccttcatcacgcccatgctgcggcactccatcgagaacagctccgtgaacgtgagcctcaccgccatcgccaaccaggccaccgtcctgatgggcctggggaagggctggcccctctccaagatggacatcggggtgccgctgctggcgatcggctgctacagccaggtgaaccccatcaccctcacggccgccctgctgctcctggtcgcccactacgcgatcatcgggcccggcctgcaggccaaggccacccgcgaggcccagaagcgggccgcggccggcatcatgaagatccccgccgccgacatcgggcgcgtgatcgacctcgacccgatcccctacgaccccaagttcgagaagcagctgggccaggtgatgctgctcgtcctgtgcgtgacccaggtgctgatgatgcgcaccacgtgggccctctgcgaggcgctgaccctggccaccgggcccatctccaccctctgggagggcaacccggggcggttctggaacacgaccatcgccgtcagcatggccaacatcttccgcggctcctacctggccggcgcggggctcctcttcagcatcatgaagaacaccgccaacacccggcgcggcacggggaacaccggcgagaccctgggcgagaagtggaagaaccagctgaacgccctcgggaagtccgagttccagatctacaagaagtccggcatccaggaggtggaccggaccctggccaaggaggggatcaagcgcggcgagacggaccaccacgcggtgtcccgggggagcgccaagctgcgctggttcgtcgagcggaacctcgtgacccccgagggcaaggtggtcgacctgggctgcgggcgcggcgggtggtcctactactgcggcgggctgaagaacgtgaaggaggtgaagggcctcaccaagggcgggcccggccacgaggagcccatcccgatgagcacctacgggtggaacctggtccggctgcagtccggcgtggacgtgttcttcacgccgcccgagaagtgcgacaccctcctgtgcgacatcggggagagctcccccaacccgaccgtcgaggccggccgcaccctgcgggtgctcaacctggtggagaactggctgaacaacaacacccagttctgcatcaaggtcctcaacccctacatgcccagcgtgatcgagaagatggaggccctgcagcgcaagtacggcggggccctggtgcggaacccgctgagccgcaactccacgcacgagatgtactgggtcagcaacgcgtccggcaacatcgtgagctccgtgaacatgatcagccggatgctcatcaaccgcttcaccatgcggcacaagaaggccacctacgagcccgacgtcgacctggggtccggcacccgcaacatcgggatcgagagcgaggtgcccaacctggacatcatcggcaagcgcatcgagaagatcaagcaggagcacgagacgtcctggcactacgaccaggaccacccctacaagacctgggcctaccacggcagctacgagaccaagcagaccgggtccgccagctccatggtgaacggcgtcgtgcggctcctgacgaagccgtgggacgtgatccccatggtcacccagatggccatgaccgacaccacgcccttcgggcagcagcgcgtgttcaaggagaaggtcgacacccggacccaggagcccaaggagggcaccaagaagctgatgaagatcacggcggagtggctctggaaggagctgggcaagaagaagaccccgcgcatgtgcacccgggaggagttcacccgcaaggtgcggagcaacgccgccctgggggccatcttcacggacgagaacaagtggaagtccgcccgcgaggcggtggaggacagcggcttctgggagctcgtcgacaaggagcggaacctgcacctggaggggaagtgcgagacctgcgtgtacaacatgatgggcaagcgcgagaagaagctcggggagttcggcaaggccaagggctcccgggccatctggtacatgtggctgggggcccgcttcctggagttcgaggcgctcggcttcctgaacgaggaccactggttcagccgggagaactccctgagcggggtggagggcgaggggctccacaagctgggctacatcctgcgcgacgtcagcaagaaggagggcggggccatgtacgccgacgacaccgccggctgggacacccggatcacgctcgaggacctgaagaacgaggagatggtgaccaaccacatggagggggagcacaagaagctggccgaggcgatcttccgcctcacctaccagaacaaggtggtccgggtgcagcgccccacgccccggggcacggtgatggacatcatctcccgccgggaccagcgcgggagcggccaggtcgtgacctacggcctgaacaccttcaccaacatggaggcccagctgatccgccagatggagggggagggcgtgttcaagtccatccagcacctcacggccaccgaggagatcgccgtcaagaactggctggtgcgggtggggcgcgagcggctgagccgcatggccatctccggcgacgactgcgtcgtgaagcccctcgacgaccggttcgcgaacgccctgaccgccctgaacgacatgggcaaggtgcgcaaggacatccagcagtgggagccgagccgggggtggaacgactggacccaggtccccttctgctcccaccacttccacgagctcatcatgaaggacggccgcgtgctggtggtcccctgccggaaccaggacgagctgatcgggcgcgcccggatcagccagggcgccgggtggtccctccgcgagacggcgtgcctgggcaagagctacgcccagatgtggtccctgatgtacttccaccggcgcgacctccggctggccgccaacgccatctgcagcgcggtgccctcccactgggtgccgaccagccgcaccacctggtccatccacgccacccacgagtggatgacgaccgaggacatgctgaccgtctggaaccgggtgtggatccaggagaacccctggatggaggacaagacccccgtggagagctgggaggagatcccctacctcggcaagcgcgaggaccagtggtgcgggtccctgatcggcctgacgagccgggccacctgggccaagaacatccagaccgcgatcaaccaggtccgcagcctcatcgggaacgaggagtacaccgactacatgccgtccatgaagcgcttccggcgcgaggaggaggaggccggcgtgctgtggtga

SEQ ID NO: 9052 - RNA, 9876 nt, synthetic construct
  misc_feature 1..9876: note = derived and/or modified CDS sequence (opt1) from DENV-2__KX380819__SS-prME
  source 1..9876: mol_type = other RNA
accgccgggatcatcatcatgatgatccccaccgtgatggccttccacctgaccacccgcaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcaccgtgatggcggccatcctggcctacaccatcggcaccacctacttccagcgggtgctgatcttcatcctcctgaccgccgtcgcgccctccatgaccatgcgctgcatcgggatcagcaaccgggacttcgtggagggcatctccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgccacgatggagtgcagcccccgcaccggcctggacttcaacgagatggtcctcctgcagatggagaacaaggcgtggctggtgcaccggcagtggttcctcgacctgcccctgccctggctcccgggcgccgacacccaggggtccaactggatccagaaggagaccctggtgacgttcaagaacccccacgccaagaagcaggacgtcgtggtcctgggcagccaggagggggccatgcacaccgccctcaccggcgcgaccgagatccagatgagctccgggaacctgctgttcacgggccacctcaagtgccgcctgcggatggacaagctgcagctcaagggcatgagctactccatgtgcaccgggaagttcaaggtggtgaaggagatcgccgagacccagcacggcaccatcgtcatccgcgtgcagtacgagggggacggcagcccctgcaagatccccttcgagatcatggacctggagaagcggcacgtgctgggccgcctcatcacggtcaacccgatcgtgaccgagaaggactcccccgtgaacatcgaggccgagccgcccttcggggacagctacatcatcatcggcgtcgagccggggcagctgaagctgtcctggttcaagaagggcagctccatcgggcagatgttcgagaccaccatgcgcggcgccaagcggatggccatcctcggcgacacggcgtgggacttcgggagcctgggcggggtgttcacctccatcggcaaggccctgcaccaggtgttcggggccatctacggcgccgcgttcagcggcgtctcctggaccatgaagatcctcatcggggtggtgatcacctggatcggcatgaacagccgctccacgagcctgtccgtcagcctggtgctggtggggatcgtcaccctctacctgggcgtgatggtgcaggccgactccgggtgcgtcgtgagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtcacccgcctggagaacctgatgtggaagcagatcacccccgagctcaaccacatcctgtccgagaacgaggtgaagctgaccatcatgacgggggacatcaagggcatcatgcaggcggggaagcggagcctccgcccgcagcccaccgagctgaagtactcctggaaggcctggggcaaggccaagatgctgagcaccgagctccacaaccacaccttcctgatcgacggccccgagacggccgagtgcccgaacaccaaccgggcctggaactccctggaggtggaggactacgggttcggcgtcttcaccaccaacatctggctcaagctgaaggagcgccaggacgtgttctgcgacagcaagctgatgtccgcggccatcaaggacaaccgggccgtgcacgccgacatggggtactggatcgagagcgccctcaacgacacgtggaagatcgagaaggcgtccttcatcgaggtcaagagctgccactggcccaagtcccacaccctgtggagcaacggcgtgctggagtccgagatgatcatccccaagaacttcgccggccccgtgagccagcacaactaccgcccggggtaccacacccagaccgccggcccctggcacctcgggcggctggagatggacttcgacttctgcgagggcaccacggtcgtggtgaccgaggactgcgggaaccgcggccccagcctgcggaccaccacggcctccggcaagctcatcaccgagtggtgctgccgcagctgcaccctgcccccgctgcggtaccgcggggaggacggctgctggtacgggatggagatccggcccctcaaggagaaggaggagaacctggtcaactccctggtgaccgcgggccacgggcagatcgacaacttcagcctcggcgtgctgggcatggccctgttcctcgaggagatgctgcgcacgcgggtcgggaccaagcacgccatcctgctcgtggccgtgtccttcgtcaccctgatcaccggcaacatgagcttccgcgacctggggcgcgtgatggtgatggtcggcgccacgatgaccgacgacatcgggatgggcgtgacctacctcgcgctgctggccgccttcaaggtgcggcccaccttcgccgccggcctcctgctgcgcaagctcacgtccaaggagctgatgatgaccaccatcgggatcgtcctgctcagccagtccaccatccccgagacgatcctggagctgaccgacgcgctcgccctgggcatgatggtgctgaagatcgtgcggaacatggagaagtaccagctcgccgtcaccatcatggccatcctgtgcgtgccgaacgccgtcatcctgcagaacgcgtggaaggtgagctgcaccatcctcgccgtggtctccgtgagccccctgctgctcacgtccagccagcagaaggccgactggatccccctggccctgaccatcaaggggctcaaccccaccgcgatcttcctgaccacgctgtcccgcaccagcaagaagcggtcctggccgctcaacgaggccatcatggccgtgggcatggtcagcatcctggcctccagcctgctcaagaacgacatccccatgaccggccccctggtggccgggggcctgctcaccgtgtgctacgtcctgacggggcgcagcgcggacctggagctcgagcgggccgccgacgtgcgctgggaggagcaggccgagatctccggcagctcccccatcctgagcatcaccatctccgaggacgggagcatgtccatcaagaacgaggaggaggagcagaccctgaccatcctcatccggacgggcctgctggtgatcagcggcctcttcccggtctccatccccatcaccgccgcggcctggtacctgtgggaggtgaagaagcagcgcgccggggtgctgtgggacgtccccagcccgccgcccgtgggcaaggccgagctcgaggacggggcctaccggatcaagcagaagggcatcctggggtactcccagatcggcgcgggcgtgtacaaggaggggaccttccacaccatgtggcacgtcacccgcggcgccgtgctgatgcacaaggggaagcggatcgagcccagctgggccgacgtgaagaaggacctcatctcctacggcgggggctggaagctggagggcgagtggaaggagggggaggaggtccaggtgctggccctcgagcccggcaagaacccccgcgccgtgcagacgaagcccgggctgttcaagaccaacaccggcaccatcggggcggtcagcctggacttctcccccggcacgagcggctcccccatcgtggacaagaaggggaaggtggtcggcctctacgggaacggcgtggtgacccggagcggcacctacgtctccgccatcgcccagaccgagaagtccatcgaggacaaccccgagatcgaggacgacatcttccgcaagaagcggctgacgatcatggacctgcaccccggggccggcaagaccaagcgctacctgcccgcgatcgtgcgggaggccatcaagcgcgggctccggaccctgatcctggccccgacccgcgtggtcgccgccgagatggaggaggcgctccgcggcctgcccatccggtaccagacgcccgccatccgcgccgagcacaccgggcgggagatcgtggacctgatgtgccacgccaccttcaccatgcgcctcctgagccccatccgggtgccgaactacaacctgatcatcatggacgaggcccacttcacggaccccgcgtccatcgccgcccgcggctacatcagcacccgggtcgagatgggcgaggccgccgggatcttcatgaccgcgacgccgcccggctcccgcgacccgttcccccagagcaacgcccccatcatggacgaggagcgggagatccccgagcgctcctggaacagcgggcacgagtgggtgacggacttcaagggcaagaccgtgtggttcgtcccgtccatcaaggccgggaacgacatcgccgcgtgcctccggaagaacggcaagaaggtgatccagctgagccgcaagaccttcgactccgagtacatcaagacccggacgaacgactgggacttcgtggtcaccaccgacatcagcgagatgggcgccaacttcaaggccgagcgcgtgatcgacccccggcgctgcatgaagcccgtgatcctgaccgacggggaggagcgggtcatcctcgccggccccatgccggtgacgcactccagcgccgcgcagcgccgggggcgcgtgggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtcgacgccatcgacggcgagtaccgcctgcgcggggaggcccgcaagaccttcgtggacctgatgcggcgcggcgacctccccgtgtggctggcgtaccgggtcgccgccgaggggatcaactacgccgaccgccggtggtgcttcgacggcgtgaagaacaaccagatcctggaggagaacgtcgaggtggagatctggaccaaggagggggagcgcaagaagctcaagccgcggtggctggacgcccgcatctacagcgaccccctggcgctcaaggagttcaaggagttcgccgccggccggaagtccctgacgctgaacctcatcaccgagatgggccgcctgcccaccttcatgacccagaaggcccggaacgcgctggacaacctcgccgtgctgcacacggccgaggccgggggccgcgcctacaaccacgcgctgagcgagctccccgagaccctggagaccctgctcctgctgaccctcctggccacggtcaccgggggcatcttcctgttcctcatgtccggcaaggggatcggcaagatgaccctggggatgtgctgcatcatcaccgccagcatcctgctctggtacgcccagatccagccgcactggatcgccgcgtccatcatcctggagttcttcctgatcgtgctcctgatccccgagcccgagaagcagcggacgccccaggacaaccagctgacgtacgtggtcatcgccatcctcaccgtggtggccgccaccatggccaacgagatgggcttcctggagaagaccaagaaggacttcgggctgggcagcatcacgacccagcagccggacagcaacatcctcgacatcgacctgcgccccgcgtccgcctggaccctgtacgccgtcgccaccacgttcatcacccccatgctccggcacagcatcgagaactccagcgtgaacgtgtccctgaccgccatcgcgaaccaggccaccgtcctgatgggcctcgggaagggctggcccctgagcaagatggacatcggggtgccgctgctcgccatcggctgctactcccaggtgaaccccatcacgctgaccgccgcgctgctcctgctggtcgcccactacgccatcatcgggcccggcctccaggccaaggccacccgcgaggcgcagaagcgggccgccgccggcatcatgaagatccccgccgcgctgatcgggcgcgtgatcgacctggacccgatcccctacgaccccaagttcgagaagcagctcggccaggtgatgctgctggtcctctgcgtgacccaggtgctgatgatgcgcacgacctgggccctgtgcgaggccctcaccctggccaccgggcccatcagcacgctgtgggagggcaacccggggcggttctggaacaccaccatcgccgtctccatggcgaacatcttccgcggcagctacctcgccggcgccgggctgctgttctccatcatgaagaacaccgccaacacgcggcgcggcaccgggaacaccggcgagaccctcggcgagaagtggaagaaccggctgaacgcgctgggcaagagcgagttccagatctacaagaagtccggcatccaggaggtggaccgcacgctcgccaaggaggggatcaagcggggcgagaccgaccaccacgccgtgagccgcgggtccgccaagctgcggtggttcgtcgagcgcaacctggtgacccccgagggcaaggtggtcgacctcggctgcgggcggggcgggtggagctactactgcggcgggctgaagaacgtgaaggaggtgaagggcctgaccaagggcgggcccggccacgaggagcccatcccgatgtccacgtacgggtggaacctcgtccgcctgcagagcggcgtggacgtgttcttcacgccgcccgagaagtgcgacaccctgctctgcgacatcggggagtccagccccaacccgaccgtcgaggccggccggacgctgcgcgtgctgaacctcgtggagaactggctgaacaacaacacccagttctgcatcaaggtcctgaacccctacatgcccagcgtgatcgagaagatggaggcgctgcagcggaagtacggcggggccctcgtgcgcaacccgctgtcccggaacagcacccacgagatgtactgggtctccaacgccagcggcaacatcgtgtccagcgtgaacatgatctcccgcatgctgatcaaccggttcaccatgaagcacaagaaggccacctacgagcccgacgtcgacctcgggagcggcacgcgcaacatcgggatcgagtccgagacccccaacctggacatcatcggcaagcgcatcgagaagatcaagcaggagcacgagaccagctggcactacgaccaggaccacccctacaagacctgggcctaccacggctcctacgagacgaagcagaccgggagcgcgtccagcatggtgaacggcgtggtccggctgctcaccaagccgtgggacgtgatccccatggtgacccagatggccatgacggacaccacccccttcgggcagcagcgcgtcttcaaggagaaggtggacacccggacgcaggagcccaaggagggcaccaagaagctgatgaagatcaccgccgagtggctgtggaaggagctcggcaagaagaagaccccgcgcatgtgcacgcgggaggagttcacccgcaaggtgcggtccaacgccgccctgggggcgatcttcaccgacgagaacaagtggaagtccgcccgcgaggccgtcgaggactccggcttctgggagctggtggacaaggagcggaacctccacctggaggggaagtgcgagacctgcgtctacaacatgatgggcaagcgcgagaagaagctgggggagttcggcaaggccaagggcagccgggcgatctggtacatgtggctcggggcccgcttcctggagttcgaggccctgggcttcctcaacgaggaccactggttctcccgggagaacagcctgagcggggtggagggcgaggggctgcacaagctcggctacatcctgcgcgacgtgtccaagaaggagggcggggccatgtacgccgacgacacggcgggctgggacacccggatcaccctggaggacctcaagaacgaggagatggtcaccaaccacatggagggggagcaccgcaagctggccgaggccatcttccggctgacgtaccagaacaaggtggtgcgcgtccagcggcccacgccccggggcaccgtgatggacatcatcagccggcgcgaccagcgcgggtccggccaggtggtcacctacggcctcaacacgttcaccaacatggaggcccagctgatccggcagatggagggggagggcgtgttcaagagcatccagcacctgaccgtgaccgaggagatcgccgtcaagaactggctcgagcgcgtggggcgggagcgcctgtcccggatggcgatcagcggcgacgactgcgtggtcaagcccctggacgaccgcttcgcctccgccctcacggccctgaacgacatgggcaaggtgcggaaggacatccagcagtgggagccgagccgcgggtggaacgactggacccaggtgcccttctgctcccaccacttccacgagctgatcatgaaggacggccgggtcctcgtggtgccctgccgcaaccaggacgagctgatcgggcgggcccgcatcagccagggcgcggggtggtccctgcgggagaccgcctgcctcggcaagagctacgcccagatgtggtccctgatgtacttccaccgccgggacctgcgcctcgccgccaacgcgatctgcagcgccgtcccctcccactgggtgccgatcagccggaccacgtggtccatccacgccacccacgagtggatgaccaccgaggacatgctgaccgcctggaaccgcgtgtggatccaggagaacccctggatggaggacaagacgcccgtcgagagctgggaggagatcccctacctgggcaagcgggaggaccagtggtgcgggagcctcatcggcctgacctcccgcgcgacctgggccaagaacatccagaccgccatcaaccaggtgcgcagcctgatcgggaacgaggagtacacggactacatgccgtccatgaagcggttccgccgggaggaggaggaggccggcgtgctctggtga

SEQ ID NO: 9053 - RNA, 9876 nt, synthetic construct
  misc_feature 1..9876: note = derived and/or modified CDS sequence (opt1) from DENV-2__KX380821__SS-prME
  source 1..9876: mol_type = other RNA
accgccggcatcatcatcatgatgatccccaccgtgatggccttccacctgaccacccgcaacggggagccccacatgatcgtgtcccggcaggagaagggcaagtccctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcaccgtgatggcggccatcctggcctacaccatcggcaccacctacttccagcgggtgctgatcttcatcctcctgacggccgtcgcgccctccatgaccatgcgctgcatcgggatcagcaaccgggacttcgtggagggcgtgtccggcgggagctgggtcgacatcgtgctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtctgcaagcacagcatggtggaccggggctggggcaacgggtgcggcctgttcgggaagggcgggatcgtgacgtgcgccatgttcacgtgcaagaagaacatggagggcaagatcgtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgccacgatggagtgcagcccccgcaccggcctggacttcaacgagatggtgctcctgcagatggagaacaaggcgtggctggtgcaccggcagtggttcctcgacctgcccctgccctggctcccgggcgccgacacccaggggtccaactggatccagaaggagaccctggtcacgttcaagaacccccacgccaagaagcaggacgtggtcgtgctgggcagccaggagggggccatgcacaccgccctcaccggcgcgaccgagatccagatgagctccgggaacctgctgttcacgggccacctcaagtgccgcctgcggatggacaagctgcagctcaagggcatgagctactccatgtgcaccgggaagttcaaggtggtcaaggagatcgccgagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcgtgggacttcgggagcctgggcggggtgttcacctccatcggcaaggccctgcaccaggtcttcggggccatctacggcgccgcgttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggccgactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgaccgagaacgaggtcaagctgacgatcatgaccggggacatcaagggcatcatgcaggcggggaagcggaccctccgcccgcagcccaccgagctgaagtactcctggaaggcctggggcaaggccaagatgctgagcacggagctccacaaccacaccttcctgatcgacggccccgagaccgccgagtgcccgaacaccaaccgggcctggaactccctggaggtggaggactacgggttcggcgtgttcacgaccaacatctggctcaagctgaaggagcgccaggacgtcttctgcgacagcaagctgatgtccgcggccatcaaggacaaccgggccgtgcacgccgacatggggtactggatcgagagcgccctcaacgacacctggaagatcgagaaggcgtccttcatcgaggtcaagagctgccactggcccaagtcccacaccctgtggagcaacggcgtgctggagtccgagatgatcatccccaagaacttcgccggccccgtgagccagcacaactaccgcccggggtaccacacccagacggccggcccctggcacctcgggcggctggagatggacttcgacttctgcgagggcaccaccgtggtcgtgaccgaggactgcgggaaccgcggcccctccctgcggacgaccaccgccagcggcaagctcatcaccgagtggtgctgccgcagctgcacgctgcccccgctgcggtaccgcggggaggacggctgctggtacgggatggagatccggcccctcaaggagaaggaggagaacctggtgaactccctggtcaccgcgggccacgggcagatcgacaacttcagcctcggcgtgctgggcatggccctgttcctcgaggagatgctgcgcacccgggtggggaccaagcacgccatcctgctcgtcgccgtgtccttcgtgacgctgatcaccggcaacatgagcttccgcgacctggggcgcgtcatggtgatggtgggcgccaccatgaccgacgacatcgggatgggcgtcacgtacctcgcgctgctggccgccttcaagatccggcccaccttcgccgccggcctcctgctgcgcaagctcacctccaaggagctgatgatgaccacgatcgggatcgtgctgctcagccagtccaccatccccgagagcatcctggagctgaccgacgcgctcgccctgggcatgatggtgctgaagatcgtccggaacatggagaagtaccagctcgccgtgaccatcatggccatcctgtgcgtcccgaacgccgtgatcctgcagaacgcgtggaaggtgtcctgcacgaccctcgccgtcgtgagcgtgagccccctgctgctcaccagctcccagcagaaggccgactggatccccctggccctgaccatcaaggggctcaaccccacggcgatcttcctgaccaccctgagccgcacctccaagaagcggagctggccgctcaacgaggccatcatggccgtcggcatggtgtccatcctggccagctccctgctcaagaacgacatccccatgacgggccccctggtggccgggggcctgctcaccgtctgctacgtgctgaccgggcgcagcgcggacctggagctcgagcgggccgccgacgtgcgctgggaggagcaggccgagatcagcggctccagccccatcctgtccatcaccatcagcgaggacgggtccatgagcatcaagaacgaggaggaggagcagacgctgaccatcctcatccggaccggcctgctggtcatctccggcctcttcccggtgagcatccccatcaccgccgcggcctggtacctgtgggaggtgaagaagcagcgcgccggggtcctgtgggacgtgcccagcccgccgcccgtgggcaaggccgagctcgaggacggggcctaccggatcaagcagaagggcatcctggggtacagccagatcggcgcgggcgtctacaaggaggggaccttccacacgatgtggcacgtgacccgcggcgccgtgctgatgcacaaggggaagcggatcgagccctcctgggccgacgtcaagaaggacctcatcagctacggcgggggctggaagctggagggcgagtggaaggagggggaggaggtccaggtgctggccctcgagcccggcaagaacccccgcgccgtccagaccaagcccgggctgttcaagaccaacacgggcaccatcggggcggtgtccctggacttcagccccggcacctccggcagccccatcgtggacaagaaggggaaggtcgtgggcctctacgggaacggcgtggtcacccggtccggcacgtacgtgagcgccatcgcccagaccgagaagtccatcgaggacaaccccgagatcgaggacgacatcttccgcaagaagcggctgaccatcatggacctgcaccccggggccggcaagaccaagcgctacctgcccgcgatcgtgcgggaggccatcaagcgcgggctccggacgctgatcctggccccgacccgcgtcgtggccgccgagatggaggaggcgctccgcggcctgcccatccggtaccagacccccgccatccgcgccgagcacaccgggcgggagatcgtggacctgatgtgccacgccacgttcaccatgcgcctcctgagccccatccgggtcccgaactacaacctgatcatcatggacgaggcccacttcaccgaccccgcgagcatcgccgcccgcggctacatctccacccgggtggagatgggcgaggccgccgggatcttcatgacggcgacgccgcccggcagccgcgacccgttcccccagtccaacgcccccatcatggacgaggagaaggagatccccgagcggagctggaactccgggcacgagtgggtgaccgacttcaagggcaagaccgtctggttcgtgccgagcatcaaggccgggaacgacatcgccgcgtgcctccgcaagaacggcaagaaggtgatccagctgtcccggaagacgttcgacagcgagtacatcaagacccgcaccaacgactgggacttcgtcgtgaccacggacatctccgagatgggcgccaacttcaaggccgagcgggtgatcgacccccgccggtgcatgaagcccgtcatcctgaccgacggggaggagcgcgtgatcctcgccggccccatgccggtgacccacagctccgccgcgcagcggcgcgggcgggtcggccgcaaccccaagaacgagaacgaccagtacatctacatgggggagcccctggagaacgacgaggactgcgcccactggaaggaggccaagatgctgctcgacaacatcaacacccccgagggcatcatcccgagcatgttcgagcccgagcgcgagaaggtggacgccatcgacggcgagtaccggctgcgcggggaggcccggaagacgttcgtggacctgatgcgccggggcgacctccccgtctggctggcgtaccgcgtggccgccgaggggatcaactacgccgaccggcgctggtgcttcgacggcgtcaagaacaaccagatcctggaggagaacgtggaggtggagatctggaccaaggagggggagcggaagaagctcaagccgcgctggctggacgcccggatctactccgaccccctggcgctcaaggagttcaaggagttcgccgccggccgcaagagcctgaccctgaacctcatcaccgagatgggccggctgcccacgttcatgacccagaaggccaagaacgcgctggacaacctcgccgtcctgcacaccgccgaggccgggggccgcgcctacaaccacgcgctgtccgagctccccgagaccctggagacgctgctcctgctgaccctcctggccaccgtgaccgggggcatcttcctgttcctcatgagcggcaaggggatcggcaagatgaccctggggatgtgctgcatcatcacggcctccatcctgctctggtacgcccagatccagccgcactggatcgccgcgagcatcatcctggagttcttcctgatcgtgctcctgatccccgagcccgagaagcagcggacgccccaggacaaccagctgacctacgtcgtgatcgccatcctcaccgtggtcgccgccacgatggccaacgagatgggcttcctggagaagaccaagaaggacttcgggctgggctccatcaccacccagcagccggagagcaacatcctcgacatcgacctgcgccccgcgagcgcctggacgctgtacgccgtggccaccaccttcatcacccccatgctccggcactccatcgagaacagctccgtgaacgtcagcctgacggccatcgcgaaccaggccaccgtgctgatgggcctcgggaagggctggcccctgtccaagatggacatcggggtgccgctgctcgccatcggctgctacagccaggtcaaccccatcaccctgaccgccgcgctgctcctgctggtggcccactacgccatcatcgggcccggcctccaggccaaggccacgcgcgaggcgcagaagcgggccgccgccggcatcatgaagaaccccaccgtggacgggatgaccgtcatcgacctggacccgatcccctacgaccccaagttcgagaagcagctgggccaggtgatgctcctggtgctgtgcgtcacccaggtgctcatgatgcgcacgacctgggccctgtgcgaggcgctgaccctcgccaccgggcccatctccacgctgtgggagggcaacccggggcggttctggaacaccaccatcgccgtgagcatggccaacatcttccgcggctcctacctggccggcgcggggctcctgttcagcatcatgaagaacaccgccaacacgcgccggggcaccgggaacaccggcgagaccctgggcgagaagtggaagaaccgcctcaacgccctggggaagtccgagttccagatctacaagaagtccggcatccaggaggtcgaccggacgctggccaaggaggggatcaagcgcggcgagaccgaccaccacgcggtgtcccgggggagcgccaagctccgctggttcgtggagcggaacctggtcacccccgagggcaaggtggtggacctgggctgcgggcgcggcgggtggtcctactactgcggcgggctcaagaacgtcaaggaggtgaagggcctgaccaagggcgggcccggccacgaggagcccatcccgatgagcacgtacgggtggaacctggtgcggctccagtccggcgtcgacgtgttcttcacgccgcccgagaagtgcgacaccctgctgtgcgacatcggggagagctcccccaacccgaccgtggaggccggccgcaccctccgggtcctgaacctggtggagaactggctcaacaacaacacgcagttctgcatcaaggtgctgaacccctacatgcccagcgtcatcgagaagatggaggccctgcagcgcaagtacggcggggccctggtgcggaacccgctcagccgcaactccacccacgagatgtactgggtgagcaacgcgtccggcaacatcgtcagctccgtgaacatgatcagccggatgctgatcaaccgcttcaccatgcggcacaagaaggccacctacgagcccgacgtggacctggggtccggcacgcgcaacatcgggatcgagagcgagacccccaacctcgacatcatcggcaagcggatcgagaagatcaagcaggagcacgagacctcctggcactacgaccaggaccacccctacaagacctgggcctaccacggcagctacgagacgaagcagaccgggtccgccagctccatggtcaacggcgtggtgcgcctgctgaccaagccgtgggacgtcatccccatggtgacccagatggccatgacggacaccacccccttcgggcagcagcgcgtgttcaaggagaaggtcgacacccggacgcaggagcccaaggagggcaccaagaagctcatgaagatcaccgcggagtggctgtggaaggagctgggcaagaagaagaccccgcgcatgtgcacgcgggaggagttcacccgcaaggtgcggagcaacgccgccctcggggccatcttcaccgacgagaacaagtggaagtccgcccgcgaggcggtcgaggacagcggcttctgggagctggtggacaaggagcggaacctgcacctcgaggggaagtgcgagacctgcgtgtacaacatgatgggcaagcgcgagaagaagctgggggagttcggcaaggccaagggctcccgggccatctggtacatgtggctgggggcccgcttcctcgagttcgaggcgctgggcttcctgaacgaggaccactggttcagccgggagaactccctcagcggggtcgagggcgaggggctgcacaagctgggctacatcctccgcgacgtgagcaagaaggagggcggggccatgtacgccgacgacacggccggctgggacacccggatcaccctggaggacctgaagaacgaggagatggtgaccaaccacatggagggggagcacaagaagctcgccgaggcgatcttcaagctgacgtaccagaacaaggtcgtgcgcgtgcagcggcccacgccccgcggcaccgtcatggacatcatctcccggcgcgaccagcgggggagcggccaggtggtgacctacggcctgaacacgttcaccaacatggaggcccagctcatccgccagatggagggggagggcgtcttcaagtccatccagcagctgaccgtgaaggaggagatcgccgtgaagaactggctgatccgggtcgggcgcgagcgcctcagccggatggccatctccggcgacgactgcgtggtgaagcccctggacgaccgcttcgccagcgcgctgaccgccctcaacgacatgggcaaggtccggaaggacatccagcagtgggagccgtcccgcgggtggaacgactggacccaggtgcccttctgcagccaccacttccacgagctgatcatgaaggacggccgggtgctggtcgtgccctgccgcaaccaggacgagctcatcgggcgggcccgcatctcccagggcgccgggtggagcctgcgggagaccgcctgcctgggcaagtcctacgcgcagatgtggagcctcatgtacttccaccgccgggacctgcgcctggccgccaacgccatctgctccgccgtgcccagccactggatcccgacctcccggaccacctggagcatccacgcgacgcacgagtggatgaccaccgaggacatgctcaccgtctggaaccgcgtgtggatccaggagaacccctggatggaggacaagacgcccgtggagtcctgggaggagatcccctacctgggcaagcgggaggaccagtggtgcgggagcctgatcggcctcaccagccgcgccacctgggccaagaacatccagaccgccatcaaccaggtccggtccctgatcgggaacgaggagtacacggactacatgccgagcatgaagcgcttccggcgcgaggaggaggaggcgggcgtgctgtggtga

SEQ ID NO: 9054 - RNA, 9876 nt, synthetic construct
  misc_feature 1..9876: note = derived and/or modified CDS sequence (opt1) from DENV-2__KX380822__SS-prME
  source 1..9876: mol_type = other RNA
accgccgggatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacgcgcaccgagacctggatgtccagcgagggcgcctggaagcacgcccagcggatcgagacctgggtcctccgccaccccgggttcacggtgatggcggccatcctggcctacaccatcggcaccacctacttccagcgggtgctgatcttcatcctcctgacggccgtcgcgccctccatgaccatgcgctgcatcgggatcagcaaccgggacttcgtggagggcgtgtccggcgggagctgggtcgacatcgtgctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtctgcaagcacagcatggtggaccggggctggggcaacgggtgcggcctgttcgggaagggcgggatcgtgacgtgcgccatgttcacgtgcaagaagaacatggagggcaagatcgtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgccacgatggagtgcagcccccgcaccggcctggacttcaacgagatggtgctcctgcagatggagaacaaggcgtggctggtgcaccggcagtggttcctcgacctgcccctgccctggctcccgggcgccgacacccaggggtccaactggatccagaaggagaccctggtcacgttcaagaacccccacgccaagaagcaggacgtggtcgtgctgggcagccaggagggggccatgcacaccgccctcaccggcgcgaccgagatccagatgagctccgggaacctgctgttcacgggccacctcaagtgccgcctgcggatggacaagctgcagctcaagggcatgagctactccatgtgcaccgggaagttcaaggtggtcaaggagatcgccgagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcgtgggacttcgggagcctgggcggggtgttcacctccatcggcaaggccctgcaccaggtcttcggggccatctacggcgccgcgttcagcggcgtgtcctggaccatgaagatcctcatcggggtggtcatcacctggatcggcatgaacagccgctccacgagcctgtccgtgagcctggtgctggtcgggatcgtgaccctctacctgggcgtgatggtccaggccgactccgggtgcgtggtgagctggaagaacaaggagctgaagtgcggcagcggcatcttcatcaccgacaacgtccacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtgaagctgaccatcatgacgggggacatcaagggcatcatgcaggcggggaagcggagcctccgcccgcagcccaccgagctgaagtactcctggaaggcctggggcaaggccaagatgctgagcaccgagctccacaaccacaccttcctgatcgacggccccgagacggccgagtgcccgaacaccaaccgggcctggaactccctggaggtcgaggactacgggttcggcgtgttcaccaccaacatctggctcaagctgaaggagcgccaggacgtgttctgcgacagcaagctgatgtccgcggccatcaaggacaaccgggccgtccacgccgacatggggtactggatcgagagcgccctcaacgacacgtggaagatcgagaaggcgtccttcatcgaggtcaagagctgccactggcccaagtcccacaccctgtggagcaacggcgtgctggagtccgagatgatcatccccaagaacttcgccggccccgtgagccagcacaactaccgcccggggtaccacacccagaccgccggcccctggcacctcgggcggctggagatggacttcgacttctgcgagggcaccacggtggtggtcaccgaggactgcgggaaccgcggccccagcctgcggaccaccacggcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtgaccgcgggccacgggcagatcgacaacttcagcctcggcgtcctgggcatggccctgttcctcgaggagatgctgcgcacgcgggtggggaccaagcacgccatcctgctcgtggccgtctccttcgtgaccctgatcaccggcaacatgagcttccgcgacctggggcgcgtgatggtcatggtgggcgccacgatgaccgacgacatcgggatgggcgtgacctacctcgcgctgctggccgccttcaaggtccggcccaccttcgccgccggcctcctgctgcgcaagctcacgtccaaggagctgatgatgaccaccatcgggatcgtgctgctcagccagtccaccatccccgagacgatcctggagctgaccgacgcgctcgccctgggcatgatggtgctgaagatcgtccggaacatggagaagtaccagctcgccgtgaccatcatgaccatcctgtgcgtcccgaacgccgtgatcctgcagaacgcctggaaggtgagctgcacgatcctcgcggtcgtgtccgtgagccccctgctgctcacctccagccagcagaaggccgactggatccccctggccctgaccatcaaggggctcaaccccaccgccatcttcctgacgaccctgtcccgcaccagcaagaagcggtcctggccgctcaacgaggcgatcatggccgtcggcatggtgagcatcctggcctccagcctgctcaagaacgacatccccatgaccggccccctggtggccgggggcctgctcacggtctgctacgtgctgaccgggcgcagcgccgacctggagctcgagcgggcggccgacgtgcgctgggaggagcaggccgagatctccggcagctcccccatcctgagcatcaccatctccgaggacgggagcatgtccatcaagaacgaggaggaggagcagaccctgacgatcctcatccggaccggcctgctggtcatcagcggcctcttcccggtgtccatccccatcaccgccgccgcgtggtacctgtgggaggtgaagaagcagcgcgccggggtcctgtgggacgtgcccagcccgccgcccgtgggcaaggccgagctcgaggacggggcctaccggatcaagcagaagggcatcctggggtactcccagatcggcgccggcgtctacaaggaggggaccttccacaccatgtggcacgtgacgcgcggcgcggtgctgatgcacaaggggaagcggatcgagcccagctgggccgacgtcaagaaggacctcatctcctacggcgggggctggaagctggagggcgagtggaaggagggggaggaggtccaggtgctggccctcgagcccggcaagaacccccgcgccgtccagaccaagcccgggctgttcaagaccaacaccggcacgatcggggccgtgagcctggacttctcccccggcaccagcggctcccccatcgtggacaagaaggggaaggtcgtgggcctctacgggaacggcgtggtcacccggagcggcacctacgtgtccgcgatcgcccagacggagaagtccatcgaggacaaccccgagatcgaggacgacatcttccgcaagaagcggctgaccatcatggacctgcaccccggggccggcaagaccaagcgctacctgcccgccatcgtgcgggaggcgatcaagcgcgggctccggaccctgatcctggccccgacgcgcgtcgtggccgccgagatggaggaggccctccgcggcctgcccatccggtaccagacccccgcgatccgcgccgagcacaccgggcgggagatcgtggacctgatgtgccacgccaccttcacgatgcgcctcctgagccccatccgggtcccgaactacaacctgatcatcatggacgaggcccacttcaccgaccccgcctccatcgcggcccgcggctacatcagcacccgggtggagatgggcgaggccgccgggatcttcatgaccgccacgccgcccggctcccgcgacccgttcccccagagcaacgcgcccatcatggacgaggagcgggagatccccgagcgctcctggaacagcgggcacgagtgggtgaccgacttcaagggcaagaccgtctggttcgtgccgtccatcaaggccgggaacgacatcaccgcctgcctccggaagaacggcaagaaggtgatccagctgagccgcaagacgttcgactccgagtacatcaagacccggaccaacgactgggacttcgtcgtgaccacggacatcagcgagatgggcgccaacttcaaggcggagcgcgtgatcgacccccggcgctgcatgaagcccgtcatcctgaccgacggggaggagcgggtgatcctcgccggccccatgccggtgacccactccagcgccgcccagcgccgggggcgcgtcggccgcaaccccaagaacgagaacgaccagtacatctacatgggggagcccctggagaacgacgaggactgcgcccactggaaggaggcgaagatgctgctcgacaacatcaacacccccgagggcatcatcccgtccatgttcgagcccgagcgggagaaggtggacgccatcgacggcgagtaccgcctgcgcggggaggcccgcaagacgttcgtggacctgatgcggcgcggcgacctccccgtctggctggcctaccgggtggccgcggaggggatcaactacgccgaccgccggtggtgcttcgacggcgtcaagaacaaccagatcctggaggagaacgtggaggtggagatctggaccaaggagggggagcgcaagaagctcaagccgcggtggctggacgcccgcatctacagcgaccccctggccctcaaggagttcaaggagttcgccgcgggccggaagtccctgaccctgaacctcatcaccgagatgggccgcctgcccacgttcatgacccagaaggcccggaacgccctggacaacctcgccgtcctgcacaccgcggaggccgggggccgcgcctacaaccacgccctgagcgagctccccgagaccctggagacgctgctcctgctgaccctcctggccaccgtgaccgggggcatcttcctgttcctcatgtccggcaaggggatcggcaagatgaccctggggatgtgctgcatcatcacggcgagcatcctgctctggtacgcccagatccagccgcactggatcgccgcctccatcatcctggagttcttcctgatcgtgctcctgatccccgagcccgagaagcagcggacgccccaggacaaccagctgacctacgtcgtgatcgccatcctcaccgtggtcgcggccacgatggccaacgagatgggcttcctggagaagaccaagaaggacttcgggctgggcagcatcaccacccagcagccggacagcaacatcctcgacatcgacctgcgccccgcctccgcctggacgctgtacgcggtggccaccaccttcatcacccccatgctccggcacagcatcgagaactccagcgtgaacgtctccctgacggccatcgccaaccaggccaccgtgctgatgggcctcgggaagggctggcccctgagcaagatggacatcggggtgccgctgctcgcgatcggctgctactcccaggtcaaccccatcaccctgaccgccgccctgctcctgctggtggcccactacgcgatcatcgggcccggcctccaggccaaggccacgcgcgaggcccagaagcgggccgcggccggcatcatgaagatccccgccgccgacgggatgaccgtgatcgacctggacccgatcccctacgaccccaagttcgagaagcagctgggccaggtcatgctcctggtgctgtgcgtgacccaggtcctcatgatgcgcaccacgtgggccctgtgcgaggcgctgaccctcgccaccgggcccatcagcaccctgtgggagggcaacccggggcgcttctggaacacgaccatcgccgtgtccatggccaacatcttccggggcagctacctggccggcgcggggctcctgttctccatcatgaagaacaccgccaacacccgccggggcacggggaacaccggcgagaccctgggcgagaagtggaagaaccgcctcaacgccctgggcaagagcgagttccagatctacaagaagtccggcatccaggaggtggaccggaccctggccaaggaggggatcaagcgcggcgagacggaccaccacgcggtcagccgggggtccgccaagctccgctggttcgtggagcggaacctggtgacccccgagggcaaggtcgtggacctgggctgcgggcgcggcgggtggagctactactgcggcgggctcaagaacgtgaaggaggtcaagggcctgaccaagggcgggcccggccacgaggagcccatcccgatgtccacctacgggtggaacctggtgcggctccagagcggcgtggacgtcttcttcacgccgcccgagaagtgcgacaccctgctgtgcgacatcggggagtccagccccaacccgaccgtggaggccggccgcaccctccgggtgctgaacctggtcgagaactggctcaacaacaacacccagttctgcatcaaggtgctgaacccctacatgcccagcgtgatcgagaagatggaggccctgcagcgcaagtacggcggggccctggtccggaacccgctctcccgcaacagcacgcacgagatgtactgggtgtccaacgcgagcggcaacatcgtgtccagcgtcaacatgatctcccggatgctgatcaaccgcttcaccatgaagcacaagaaggccacctacgagcccgacgtggacctggggagcggcacccggaacatcgggatcgagtccgagacgcccaacctcgacatcatcggcaagcgcatcgagaagatcaagcaggagcacgagaccagctggcactacgaccaggaccacccctacaagacctgggcctaccacggctcctacgagaccaagcagacggggagcgcctccagcatggtgaacggcgtcgtgcgcctgctgaccaagccgtgggacgtgatccccatggtcacccagatggccatgaccgacacgacccccttcgggcagcagcgggtgttcaaggagaaggtggacacccgcacccaggagcccaaggagggcacgaagaagctcatgaagatcaccgcggagtggctgtggaaggagctgggcaagaagaagaccccgcggatgtgcacccgcgaggagttcacgcggaaggtccgctccaacgccgccctcggggccatcttcaccgacgagaacaagtggaagtccgcccgggaggcggtggaggactccggcttctgggagctggtcgacaaggagcgcaacctgcacctcgaggggaagtgcgagacctgcgtgtacaacatgatgggcaagcgggagaagaagctgggggagttcggcaaggccaagggcagccgcgccatctggtacatgtggctgggggcccggttcctcgagttcgaggcgctgggcttcctgaacgaggaccactggttctcccgcgagaacagcctcagcggggtggagggcgaggggctgcacaagctgggctacatcctccgggacgtctccaagaaggagggcggggccatgtacgccgacgacaccgccggctgggacacgcgcatcaccctggaggacctgaagaacgaggagatggtgaccaaccacatggagggggagcaccggaagctcgccgaggcgatcttccgcctgacctaccagaacaaggtggtccgggtgcagcgccccacgccccggggcaccgtgatggacatcatcagccgccgggaccagcgcgggtccggccaggtcgtgacctacggcctgaacaccttcacgaacatggaggcccagctcatccgccagatggagggggagggcgtgttcaagagcatccagcacctgaccgtcaccgaggagatcgccgtgaagaactggctggagcgggtggggcgcgagcggctctcccgcatggccatcagcggcgacgactgcgtcgtgaagcccctggacgaccggttcgcctccgcgctgaccgccctcaacgacatgggcaaggtgcgcaaggacatccagcagtgggagccgagccgggggtggaacgactggacgcaggtccccttctgctcccaccacttccacgagctgatcatgaaggacggccgcgtgctggtggtcccctgccggaaccaggacgagctcatcgggcgcgcccggatcagccagggcgccgggtggtccctgcgcgagaccgcctgcctgggcaagagctacgcgcagatgtggtccctcatgtacttccaccggcgcgacctgcggctggccgccaacgccatctgcagcgccgtgccctcccactgggtgccgaccagccgcaccacctggtccatccacgcgacgcacgagtggatgaccaccgaggacatgctcaccgtctggaaccgggtgtggatccaggagaacccctggatggaggacaagacgcccgtggagagctgggaggagatcccctacctgggcaagcgcgaggaccagtggtgcgggagcctgatcggcctcacctcccgggccacctgggccaagaacatccagaccgccatcaaccaggtccgcagcctgatcgggaacgaggagtacacggactacatgccgtccatgaagcgcttccggcgcgaggaggaggaggcgggcgtgctgtggtga

SEQ ID NO: 9055 - RNA, 9876 nt, synthetic construct
  misc_feature 1..9876: note = derived and/or modified CDS sequence (opt1) from DENV-2__KX380828__SS-prME
  source 1..9876: mol_type = other RNA
accgcgggcgtgatcatcatgctgatccccaccgccatggcgttccacctcaccacccgcaacggggagccccacatgatcgtgagccggcaggagaagggcaagagcctgctgttcaagaccgaggacggggtgaacatgtgcaccctcatggccatggacctgggcgagctgtgcgaggacaccatcacctacaactgccccctcctgcgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctcgagacccgcaccgagacctggatgtccagcgagggcgcctggaagcacgcgcagcggatcgagacctggatcctgcgccaccccgggttcacgatcatggccgccatcctggcctacaccatcggcaccacctacttccagcgggtcctcatcttcatcctgctgacggcggtggccccctccatgaccatgcgctgcatcgggatcagcaaccgggacttcgtggagggcgtctccggcgggagctgggtggacatcgtgctcgagcacggctcctgcgtcaccaccatggccaagaacaagcccacgctggacttcgagctgatcaagaccgaggccaagcagcccgccaccctccgcaagtactgcatcgaggcgaagctgaccaacacgaccaccgccagccggtgcccgacccagggggagccctccctgaacgaggagcaggacaagcgcttcgtgtgcaagcacagcatggtggaccggggctggggcaacgggtgcggcctcttcgggaagggcgggatcgtcacgtgcgccatgttcacgtgcaagaagaacatggagggcaagatcgtgcagcccgagaacctggagtacaccatcgtggtcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctcgacttcaacgagatggtgctgctgcagatggagaacaaggcgtggctcgtgcaccggcagtggttcctggacctgcccctcccctggctgccgggcgccgacacccaggggtccaactggatccagaaggagatgctggtcaccttcaagaacccccacgccaagaagcaggacgtggtcgtgctcggcagccaggagggggccatgcacacggccctgaccggcgcgaccgagatccagatgagctccgggaacctcctgttcaccggccacctgaagtgccgcctgcggatggacaagctccagctgaagggcatgagctactccatgtgcacggggaagttcaaggtggtcaaggagatcgccgagacccagcacggcaccatcgtggtgcgcgtccagtacgagggggacggcagcccctgcaagatccccttcgagatcatggacctggagaagcggcacgtgctcggccgcctgatcaccgtgaacccgatcgtcacggagaaggactcccccgtgaacatcgaggccgagccgcccttcggggacagctacatcatcatcggcgtggagccggggcagctgaagctctcctggttcaagaagggcagctccatcgggcagatgttcgagaccaccatgcgcggcgccaagcggatggccatcctgggcgacaccgcgtgggacttcgggagcctgggcggggtcttcacgtccatcggcaaggccctccaccaggtgttcggggccatctacggcgccgcgttcagcggcgtgtcctggaccatgaagatcctgatcggggtcgtgatcacctggatcggcatgaacagccgctccaccagcctgtccgtgagcctggtcctcgtgggggtggtcacgctgtacctgggcgtgatggtgcaggccgactccgggtgcgtcgtgagctggaagaacaaggagctcaagtgcggcagcggcatcttcatcaccgacaacgtgcacacctggaccgagcagtacaagttccagcccgagtcccccagcaagctggcctccgccatccagaaggcccacgaggaggggatctgcggcatccggagcgtcacgcgcctggagaacctcatgtggaagcagatcacccccgagctgaaccacatcctgtccgagaacgaggtgaagctcaccatcatgaccggggacatcaagggcatcatgcaggcggggaagcggagcctgcgcccgcagcccacggagctgaagtactcctggaagacctggggcaaggccaagatgctcagcaccgagccccacaaccagaccttcctgatcgacggcccggagacggccgagtgccccaacaccaaccgggcctggaactccctggaggtggaggactacgggttcggcgtcttcaccaccaacatctggctcaagctgaaggagcgccaggacgtgttctgcgacagcaagctgatgtccgccgcgatcaaggacaaccgggccgtgcacgccgacatggggtactggatcgagagcgccctcaacgacacgtggaagatcgagaaggcctccttcatcgaggtcaagagctgccactggcccaagtcccacaccctgtggagcaacggcgtgctggagtccgagatgatcatccccaagaacttcgcgggcccggtgagccagcacaactaccgccccgggtaccacacccagaccgccggcccctggcacctcgggaagctggagatggacttcgacttctgcgagggcaccacggtcgtggtgaccgaggactgcgggaaccggggccccagcctgcgcaccaccacggcctccggcaagctcatcaccgagtggtgctgccggagctgcaccctgccgcccctgcgctacaagggggaggacggctgctggtacgggatggagatccggcccctcaaggagaaggaggagaacctggtcaactccctggtgaccgccggccacgggcagatcgacaacttcagcctcggcgtgctgggcatggcgctgttcctcgaggagatgctgcgcacgcgggtcgggaccaagcacgccgtgctgctcgtggccgtctccttcatgaccctgatcaccggcaacatgagcttccgcgacctggggcgggtgatggtgatggtcggcgccgccatgacggacgacatcgggatgggcgtgacctacctcgcgctgctggccgccttcaaggtgcgccccaccttcgccgccggcctcctgctgcgcaagctcacctccaaggagctgatgatgacgaccatcgggatcgtcctgctcagccagtccaccatcccggagaccatcctggagctgacggacgcgctcgccctgggcatgatgatcctgaagatcgtgcggaacatggagaagtaccagctcgccgtcaccatcatggccatcctgtgcgcccccaacgcggtgatcctgcagaacgcctggaaggtgagctgcaccatcctcgccgtcgtgtccgtgagccccctgctgctcacctccagccagcagaaggccgactggatccccctggcgctgacgatcaaggggctcaacccgaccgccatcttcctgaccaccctgtcccgcacgaacaagaagcggagctggcccctcaacgaggccatcatggccgtcggcatggtgtccatcctggccagctccctgctcaagaacgacatccccatgaccggccccctggtggccggcgggctgctcaccgtctgctacgtgctgaccgggcgcagcgccgacctggagctcgagcgggccgccgacgtgcgctgggaggaccaggccgagatcagcgggtccagcccgatcctgtccatcacgatcagcgaggacgggtccatgagcatcaagaacgaggaggaggagcagaccctgaccatcctcatccggaccggcctgctggtcatctccggcctcttccccgtgagcatccccatcacggcggccgcctggtacctgtgggaggtgaagaagcagcgcgccggggtcctgtgggacgtgccctccccgccgcccgtgggcaaggccgagctcgaggacggggcgtaccggatcaagcagaagggcatcctggggtacagccagatcggcgccggcgtctacaaggaggggaccttccacaccatgtggcacgtgacccgcggcgccgtgctgatgcacaaggggaagcggatcgagccgtcctgggccgacgtccgcaaggacctcatcagctacggcgggggctggaagctggagggcgagtggaaggagggggaggaggtccaggtgctggccctcgagcccggcaagaacccccgggcggtccagaccaagcccgggctgttcaagacgaacaccggcaccatcggggccgtgtccctggacttcagcccgggcacctccggcagccccatcgtggacaagaaggggaaggtcgtgggcctctacgggaacggcgtggtcacgcgctccggcacctacgtgagcgccatcgcccagaccgagaagtccatcgaggacaaccccgagatcgaggacgacatcttccggaagaagcgcctgaccatcatggacctgcaccccggggcgggcaagacgaagcggtacctgccggccatcgtgcgcgaggccatcaagcgggggctccgcaccctgatcctggcccccacccgggtcgtggccgcggagatggaggaggccctccgcggcctgcccatccgctaccagacccccgccatccgggccgagcacacggggcgcgagatcgtggacctgatgtgccacgccaccttcaccatgcggctcctgagcccggtccgcgtgcccaactacaacctgatcatcatggacgaggcgcacttcaccgaccccgccagcatcgccgcccggggctacatctccacgcgcgtggagatgggcgaggccgcggggatcttcatgaccgccacgccgcccggcagccgggaccccttcccccagtccaacgcccccatcatggacgaggagcgcgagatccccgagcggagctggaactccgggcacgagtgggtcaccgacttcaagggcaagacggtgtggttcgtgcccagcatcaaggccgggaacgacatcgcggcctgcctccgcaagaacggcaagaaggtcatccagctgtcccggaagaccttcgacagcgagtacatcaagacccgcaccaacgactgggacttcgtggtgacgaccgacatctccgagatgggcgccaacttcaaggccgagcgggtcatcgacccccgccggtgcatgaagcccgtgatcctgaccgacggggaggagcgcgtgatcctcgccggcccgatgcccgtcacccacagctccgcggcccagcggcgcgggcggatcggccgcaaccccaagaacgagaacgaccagtacatctacatgggggagcccctggagaacgacgaggactgcgcccactggaaggaggccaagatgctgctcgacaacatcaacacgccggagggcatcatccccagcatgttcgagcccgagcgcgagaaggtggacgccatcgacggcgagtaccggctgcgcggggaggcgcggaagaccttcgtggagctgatgcgccggggcgacctcccggtctggctggcctaccgcgtggccgccgaggggatcaactacgccgaccggcgctggtgcttcgacggcatcaagaacaaccagatcctggaggagaacgtcgaggtggagatctggaccaaggagggggagaagaagaagctcaagccccggtggctggacgcgcgcatctactccgaccccctggccctcaaggagttcaaggagttcgccgccggccgcaagagcctgaccatgaacctgatcacggagatgggccgcctccccaccttcatgacccagaaggcgcggaacgccctggacaacctggccgtgctccacaccgccgaggccgggggccgcgcgtacaaccacgccctgtccgagctgccggagacgctcgagaccctgctgctcctgaccctgctcgccaccgtcaccgggggcatcttcctgttcctgatgagcggcaaggggatcggcaagatgaccctcgggatgtgctgcatcatcaccgcctccatcctgctgtggtacgcccagatccagccccactggatcgcggccagcatcatcctcgagttcttcctgatcgtgctgctcatccccgagcccgagaagcagcggaccccgcaggacaaccagctgacctacgtggtcatcgccatcctgacggtggtggccgccaccatggcgaacgagatgggcttcctcgagaagaccaagaaggacttcgggctgggctccatcgtcgcccagcagcccgagagcaacatcctggacatcgacctccgccccgccagcgcctggaccctgtacgccgtggcgacgaccttcatcacccccatgctgcggcactccatcgagaacagctccgtgaacgtcagcctcaccgccatcgccaaccaggccacggtgctgatgggcctggggaagggctggccgctctccaagatggacatcggggtgcccctgctggcgatcggctgctacagccaggtcaaccccatcaccctcaccgccgccctgctgctcctggtggcccactacgccatcatcgggcccggcctgcaggcgaaggccacccgcgaggcccagaagcgggccgccgcgggcatcatgaagatcccgacggtggacgggatcaccgtcatcgacctcgaccccatcccctacgaccccaagttcgagaagcagctgggccaggtgatgctgctcgtgctgtgcgtcacccaggtgctgatgatgcgcaccacgtgggccctctgcgaggccctgaccctggccaccgggccgatctccaccctctgggagggcaaccccgggcggttctggaacacgaccatcgccgtgagcatggcgaacatcttccgcggctcctacctggccggcgccgggctcctgttcagcatcatgaagaacaccaccaacacgcgccggggcaccgggaacaccggcgagaccctgggcgagaagtggaagaaccgcctgaactccctcggcaagagcgagttccagatctacaagcggtccggcatccaggaggtcgaccgcacgctggccaaggaggggatcaagcggggcgagaccgaccaccacgcggtgagccgcgggtccgccaagctgcggtggttcgtggagcgcaacctcgtcacccccgagggcaaggtgatggacctgggctgcgggcggggcgggtggagctactactgcggcgggctgaagaacgtgcgcgaggtcaagggcctcaccaagggcgggcccggccacgaggagccgatccccatgtccacgtacgggtggaacctggtgcggctgcagagcggcgtggacgtcttcttcacgccgcccgagaagtgcgacaccctcctgtgcgacatcggggagtccagcccgaaccccaccgtggaggccggccgcacgctgcgggtgctcaacctggtcgagaactggctgaacaacaacacccagttctgcatcaaggtgctcaacccctacatgccgagcgtgatcgagaagatggagaccctgcagcgcaagtacggcggggccctggtccggaaccccctgtcccgcaacagcacccacgagatgtactgggtgtccaacgccagcggcaacatcgtgtccagcgtcaacatgatctcccggatgctcatcaaccgcttcaccatgcggcacaagaaggcgacgtacgagcccgacgtggacctggggagcggcacccgcaacatcgggatcgagtccgagacccccaacctggacatcatcggcaagcgcatcgagaagatcaagcaggagcacgagaccagctggcactacgaccaggaccacccgtacaagacgtgggcctaccacggctcctacgagaccaagcagaccgggagcgcctccagcatggtgaacggcgtcgtgcggctcctgaccaagccctgggacgtgatccccatggtcacgcagatggccatgaccgacaccacccccttcgggcagcagcgcgtgttcaaggagaaggtggacacgcggacccaggagccgaaggagggcaccaagaagctgatgaagatcaccgccgagtggctctggaaggagctgggcaagaagaagacgccccgcatgtgcacccgggaggagttcacccgcaaggtccggtccaacgcggccctgggggccatcttcaccgacgagaacaagtggaagtccgcccgcgaggccgtggaggactcccggttctgggagctcgtcgacaaggagcgcaacctgcacctggagggcaagtgcgagacgtgcgtgtacaacatgatggggaagcgggagaagaagatcggcgagttcgggcgcgcgaagggcagccgggccatctggtacatgtggctcggcgcccgcttcctggagttcgaggccctggggttcctcaacgaggaccactggttctcccgggagaacagcctgagcggcgtggagggggagggcctgcacaagctcgggtacatcctgcgcgaggtctccaagaaggagggcggcgcgatgtacgccgacgacaccgccgggtgggacacccggatcaccctggaggacctcaagaacgaggagatggtgacgaaccacatggagggcgagcacaagaagctggccgaggccatcttcaagctgacctaccagaacaaggtggtccgcgtgcagcggcccacgccccgggggaccgtgatggacatcatcagccggcgcgaccagcgcggctccgggcaggtcggcacgtacggcctcaacaccttcaccaacatgggggcgcagctgatccggcagatggagggcgagggggtgttcaagagcatccagcacctgaccacgaccgaggaggtggccgtccaggactggctcgcccgcgtgggccgggagcgcctgtcccggatggccatcagcggcgacgactgcgtggtcaagccgctggacgaccgcttcgcctccgcgctcaccgccctgaacgacatggggaaggtgcggaaggacatccagcagtgggagcccagcaagggctggaacgactggacccaggtgcccttctgctcccaccacttccacgagctgatcatgaaggacgggcgcgtcctcgtggtgccctgccggaaccaggacgagctgatcggccgcgcccggatcagccagggggccggctggtccctgcgcgagacggcctgcctcggcaagagctacgcgcagatgtggtccctgatgtacttccaccggcgcgacctgcggctcgccgccaacgccatctgcagcgccgtcccgtcccactgggtgcccaccagccgcaccacctggtccatccacgcgcggcacgagtggatgaccacggaggacatgctgaccgtgtggaaccgcgtctggatccaggagaacccctggatggaggacaagacccccgtggagagctgggaggagatcccgtacctggggaagcgggaggaccagtggtgcggcagcctcatcgggctgacctcccgcgccacgtgggccaagaacatccagaccgccatcaaccaggtgcgcagcctgatcggctccgaggagtacaccgactacatgcccagcatgaagcggttccgccgggaggaggaggaggcgggggtcctctggtga

SEQ ID NO: 9056 - RNA, 9876 nt, synthetic construct
  misc_feature 1..9876: note = derived and/or modified CDS sequence (opt1) from DENV-2__KX380829__SS-prME
  source 1..9876: mol_type = other RNA
accgcgggcgtgatcatcatgctgatccccaccgccatggcgttccacctcaccacccgcaacggggagccccacatgatcgtgagccggcaggagaagggcaagagcctgctgttcaagaccgaggacggggtgaacatgtgcaccctcatggccatggacctgggcgagctgtgcgaggacaccatcacctacaactgccccctcctgcgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctcgagacccgcaccgagacctggatgtccagcgagggcgcctggaagcacgcgcagcggatcgagacctggatcctgcgccaccccgggttcacgatcatggccgccatcctggcctacaccatcggcaccacctacttccagcgggtcctcatcttcatcctgctgacggcggtggccccctccatgaccatgcgctgcatcgggatcagcaaccgggacttcgtggagggcgtctccggcgggagctgggtggacatcgtgctcgagcacggctcctgcgtcaccaccatggccaagaacaagcccacgctggacttcgagctgatcaagaccgaggccaagcagcccgccaccctccgcaagtactgcatcgaggcgaagctgaccaacacgaccaccgccagccggtgcccgacccagggggagccctccctgaacgaggagcaggacaagcgcttcgtgtgcaagcacagcatggtggaccggggctggggcaacgggtgcggcctcttcgggaagggcgggatcgtcacgtgcgccatgttcacgtgcaagaagaacatggagggcaagatcgtgcagcccgagaacctggagtacaccatcgtggtcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctcgacttcaacgagatggtgctgctgcagatggagaacaaggcgtggctcgtgcaccggcagtggttcctggacctgcccctcccctggctgccgggcgccgacacccaggggtccaactggatccagaaggagatgctggtcaccttcaagaacccccacgccaagaagcaggacgtggtcgtgctcggcagccaggagggggccatgcacacggccctgaccggcgcgaccgagatccagatgagctccgggaacctcctgttcaccggccacctgaagtgccgcctgcggatggacaagctccagctgaagggcatgagctactccatgtgcacggggaagttcaaggtggtcaaggagatcgccgagacccagcacggcaccatcgtggtgcgcgtccagtacgagggggacggcagcccctgcaagatccccttcgagatcatggacctggagaagcggcacgtgctcggccgcctgatcaccgtgaacccgatcgtcacggagaaggactcccccgtgaacatcgaggccgagccgcccttcggggacagctacatcatcatcggcgtggagccggggcagctgaagctctcctggttcaagaagggcagctccatcgggcagatgttcgagaccaccatgcgcggcgccaagcggatggccatcctgggcgacaccgcgtgggacttcgggagcctgggcggggtcttcacgtccatcggcaaggccctccaccaggtgttcggggccatctacggcgccgcgttcagcggcgtgtcctggaccatgaagatcctgatcggggtcgtgatcacctggatcggcatgaacagccgctccaccagcctgtccgtgagcctggtcctcgtgggggtggtcacgctgtacctgggcgtgatggtgcaggccgactccgggtgcgtcgtgagctggaagaacaaggagctcaagtgcggcagcggcatcttcatcaccgacaacgtgcacacctggaccgagcagtacaagttccagcccgagtcccccagcaagctggcctccgccatccagaaggcccacgaggaggggatctgcggcatccggagcgtcacgcgcctggagaacctcatgtggaagcagatcacccccgagctgaaccacatcctgtccgagaacgaggtgaagctcaccatcatgaccggggacatcaagggcatcatgcaggcggggaagcggagcctgcgcccgcagcccacggagctgaagtactcctggaagacctggggcaaggccaagatgctcagcaccgagccccacaaccagaccttcctgatcgacggcccggagacggccgagtgccccaacaccaaccgggcctggaactccctggaggtggaggactacgggttcggcgtcttcaccaccaacatctggctcaagctgaaggagcgccaggacgtgttctgcgacagcaagctgatgtccgccgcgatcaaggacaaccgggccgtgcacgccgacatggggtactggatcgagagcgccctcaacgacacgtggaagatcgagaaggcctccttcatcgaggtcaagagctgccactggcccaagtcccacaccctgtggagcaacggcgtgctggagtccgagatgatcatccccaagaacttcgcgggcccggtgagccagcacaactaccgccccgggtaccacacccagaccgccggcccctggcacctcgggaagctggagatggacttcgacttctgcgagggcaccacggtcgtggtgaccgaggactgcgggaaccggggccccagcctgcgcaccaccacggcctccggcaagctcatcaccgagtggtgctgccggagctgcaccctgccgcccctgcgctacaagggggaggacggctgctggtacgggatggagatccggcccctcaaggagaaggaggagaacctggtcaactccctggtgaccgccggccacgggcagatcgacaacttcagcctcggcgtgctgggcatggcgctgttcctcgaggagatgctgcgcacgcgggtcgggaccaagcacgccgtgctgctcgtggccgtctccttcatgaccctgatcaccggcaacatgagcttccgcgacctggggcgggtgatggtgatggtcggcgccgccatgacggacgacatcgggatgggcgtgacctacctcgcgctgctggccgccttcaaggtgcgccccaccttcgccgccggcctcctgctgcgcaagctcacctccaaggagctgatgatgacgaccatcgggatcgtcctgctcagccagtccaccatcccggagaccatcctggagctgacggacgcgctcgccctgggcatgatgatcctgaagatcgtgcggaacatggagaagtaccagctcgccgtcaccatcatggccatcctgtgcgcccccaacgcggtgatcctgcagaacgcctggaaggtgagctgcaccatcctcgccgtcgtgtccgtgagccccctgctgctcacctccagccagcagaaggccgactggatccccctggcgctgacgatcaaggggctcaacccgaccgccatcttcctgaccaccctgtcccgcacgaacaagaagcggagctggcccctcaacgaggccatcatggccgtcggcatggtgtccatcctggccagctccctgctcaagaacgacatccccatgaccggccccctggtggccggcgggctgctcaccgtctgctacgtgctgaccgggcgcagcgccgacctggagctcgagcgggccgccgacgtgcgctgggaggaccaggccgagatcagcgggtccagcccgatcctgtccatcacgatcagcgaggacgggtccatgagcatcaagaacgaggaggaggagcagaccctgaccatcctcatccggaccggcctgctggtcatctccggcctcttccccgtgagcatccccatcacggcggccgcctggtacctgtgggaggtgaagaagcagcgcgccggggtcctgtgggacgtgccctccccgccgcccgtgggcaaggccgagctcgaggacggggcgtaccggatcaagcagaagggcatcctggggtacagccagatcggcgccggcgtctacaaggaggggaccttccacaccatgtggcacgtgacccgcggcgccgtgctgatgcacaaggggaagcggatcgagccgtcctgggccgacgtccgcaaggacctcatcagctacggcgggggctggaagctggagggcgagtggaaggagggggaggaggtccaggtgctggccctcgagcccggcaagaacccccgggcggtccagaccaagcccgggctgttcaagacgaacaccggcaccatcggggccgtgtccctggacttcagcccgggcacctccggcagccccatcgtggacaagaaggggaaggtcgtgggcctctacgggaacggcgtggtcacgcgctccggcacctacgtgagcgccatcgcccagaccgagaagtccatcgaggacaaccccgagatcgaggacgacatcttccggaagaagcgcctgaccatcatggacctgcaccccggggcgggcaagacgaagcggtacctgccggccatcgtgcgcgaggccatcaagcgggggctccgcaccctgatcctggcccccacccgggtcgtggccgcggagatggaggaggccctccgcggcctgcccatccgctaccagacccccgccatccgggccgagcacacggggcgcgagatcgtggacctgatgtgccacgccaccttcaccatgcggctcctgagcccggtccgcgtgcccaactacaacctgatcatcatggacgaggcgcacttcaccgaccccgccagcatcgccgcccggggctacatctccacgcgcgtggagatgggcgaggccgcggggatcttcatgaccgccacgccgcccggcagccgggaccccttcccccagtccaacgcccccatcatggacgaggagcgcgagatccccgagcggagctggaactccgggcacgagtgggtcaccgacttcaagggcaagacggtgtggttcgtgcccagcatcaaggccgggaacgacatcgcggcctgcctccgcaagaacggcaagaaggtcatccagctgtcccggaagaccttcgacagcgagtacatcaagacccgcaccaacgactgggacttcgtggtgacgaccgacatctccgagatgggcgccaacttcaaggccgagcgggtcatcgacccccgccggtgcatgaagcccgtgatcctgaccgacggggaggagcgcgtgatcctcgccggcccgatgcccgtcacccacagctccgcggcccagcggcgcgggcggatcggccgcaaccccaagaacgagaacgaccagtacatctacatgggggagcccctggagaacgacgaggactgcgcccactggaaggaggccaagatgctgctcgacaacatcaacacgccggagggcatcatccccagcatgttcgagcccgagcgcgagaaggtggacgccatcgacggcgagtaccggctgcgcggggaggcgcggaagaccttcgtggagctgatgcgccggggcgacctcccggtctggctggcctaccgcgtggccgccgaggggatcaactacgccgaccggcgctggtgcttcgacggcatcaagaacaaccagatcctggaggagaacgtcgaggtggagatctggaccaaggagggggagaagaagaagctcaagccccggtggctggacgcgcgcatctactccgaccccctggccctcaaggagttcaaggagttcgccgccggccgcaagagcctgaccatgaacctgatcacggagatgggccgcctccccaccttcatgacccagaaggcgcggaacgccctggacaacctggccgtgctccacaccgccgaggccgggggccgcgcgtacaaccacgccctgtccgagctgccggagacgctcgagaccctgctgctcctgaccctgctcgccaccgtcaccgggggcatcttcctgttcctgatgagcggcaaggggatcggcaagatgaccctcgggatgtgctgcatcatcaccgcctccatcctgctgtggtacgcccagatccagccccactggatcgcggccagcatcatcctcgagttcttcctgatcgtgctgctcatccccgagcccgagaagcagcggaccccgcaggacaaccagctgacctacgtggtcatcgccatcctgacggtggtggccgccaccatggcgaacgagatgggcttcctcgagaagaccaagaaggacttcgggctgggctccatcgtcgcccagcagcccgagagcaacatcctggacatcgacctccgccccgccagcgcctggaccctgtacgccgtggcgacgaccttcatcacccccatgctgcggcactccatcgagaacagctccgtgaacgtcagcctcaccgccatcgccaaccaggccacggtgctgatgggcctggggaagggctggccgctctccaagatggacatcggggtgcccctgctggcgatcggctgctacagccaggtcaaccccatcaccctcaccgccgccctgctgctcctggtggcccactacgccatcatcgggcccggcctgcaggcgaaggccacccgcgaggcccagaagcgggccgccgcgggcatcatgaagaacccgacggtggacgggatgaccgtcatcgacctcgaccccatcccctacgaccccaagttcgagaagcagctgggccaggtgatgctgctcgtgctgtgcgtcacccaggtgctgatgatgcgcaccacgtgggccctctgcgaggccctgaccctggccaccgggccgatctccaccctctgggagggcaaccccgggcggttctggaacacgaccatcgccgtgagcatggcgaacatcttccgcggctcctacctggccggcgccgggctcctgttcagcatcatgaagaacaccaccaacacgcgccggggcaccgggaacaccggcgagaccctgggcgagaagtggaagaaccgcctgaactccctcggcaagagcgagttccagatctacaagcggtccggcatccaggaggtcgaccgcacgctggccaaggaggggatcaagcggggcgagaccgaccaccacgcggtgagccgcgggtccgccaagctgcggtggttcgtggagcgcaacctcgtcacccccgagggcaaggtgatggacctgggctgcgggcggggcgggtggagctactactgcggcgggctgaagaacgtgcgcgaggtcaagggcctcaccaagggcgggcccggccacgaggagccgatccccatgtccacgtacgggtggaacctggtgcggctgcagagcggcgtggacgtcttcttcacgccgcccgagaagtgcgacaccctcctgtgcgacatcggggagtccagcccgaaccccaccgtggaggccggccgcacgctgcgggtgctcaacctggtcgagaactggctgaacaacaacacccagttctgcatcaaggtgctcaacccctacatgccgagcgtgatcgagaagatggagaccctgcagcgcaagtacggcggggccctggtccggaaccccctgtcccgcaacagcacccacgagatgtactgggtgtccaacgccagcggcaacatcgtgtccagcgtcaacatgatctcccggatgctcatcaaccgcttcaccatgcggcacaagaaggcgacgtacgagcccgacgtggacctggggagcggcacccgcaacatcgggatcgagtccgagacccccaacctggacatcatcggcaagcgcatcgagaagatcaagcaggagcacgagaccagctggcactacgaccaggaccacccgtacaagacgtgggcctaccacggctcctacgagaccaagcagaccgggagcgcctccagcatggtgaacggcgtcgtgcggctcctgaccaagccctgggacgtgatccccatggtcacgcagatggccatgaccgacaccacccccttcgggcagcagcgcgtgttcaaggagaaggtggacacgcggacccaggagccgaaggagggcaccaagaagctgatgaagatcaccgccgagtggctctggaaggagctgggcaagaagaagacgccccgcatgtgcacccgggaggagttcacccgcaaggtccggtccaacgcggccctgggggccatcttcaccgacgagaacaagtggaagtccgcccgcgaggccgtggaggactcccggttctgggagctcgtcgacaaggagcgcaacctgcacctggagggcaagtgcgagacgtgcgtgtacaacatgatggggaagcgggagaagaagatcggcgagttcgggcgcgcgaagggcagccgggccatctggtacatgtggctcggcgcccgcttcctggagttcgaggccctggggttcctcaacgaggaccactggttctcccgggagaacagcctgagcggcgtggagggggagggcctgcacaagctcgggtacatcctgcgcgaggtctccaagaaggagggcggcgcgatgtacgccgacgacaccgccgggtgggacacccggatcaccctggaggacctcaagaacgaggagatggtgacgaaccacatggagggcgagcacaagaagctggccgaggccatcttcaagctgacctaccagaacaaggtggtccgcgtgcagcggcccacgccccgggggaccgtgatggacatcatcagccggcgcgaccagcgcggctccgggcaggtcggcacgtacggcctcaacaccttcaccaacatgggggcgcagctgatccggcagatggagggcgagggggtgttcaagagcatccagcacctgaccacgaccgaggaggtggccgtccaggactggctcgcccgcgtgggccgggagcgcctgtcccggatggccatcagcggcgacgactgcgtggtcaagccgctggacgaccgcttcgcctccgcgctcaccgccctgaacgacatggggaaggtgcggaaggacatccagcagtgggagcccagcaagggctggaacgactggacccaggtgcccttctgctcccaccacttccacgagctgatcatgaaggacgggcgcgtcctcgtggtgccctgccggaaccaggacgagctgatcggccgcgcccggatcagccagggggccggctggtccctgcgcgagacggcctgcctcggcaagagctacgcgcagatgtggtccctgatgtacttccaccggcgcgacctgcggctcgccgccaacgccatctgcagcgccgtcccgtcccactgggtgcccaccagccgcaccacctggtccatccacgcgcggcacgagtggatgaccacggaggacatgctgaccgtgtggaaccgcgtctggatccaggagaacccctggatggaggacaagacccccgtggagagctgggaggagatcccgtacctggggaagcgggaggaccagtggtgcggcagcctcatcgggctgacctcccgcgccacgtgggccaagaacatccagaccgccatcaaccaggtgcgcagcctgatcggctccgaggagtacaccgactacatgcccagcatgaagcggttccgccgggaggaggaggaggcgggggtcctctggtga

SEQ ID NO: 9057 - RNA, 9876 nt, synthetic construct
  misc_feature 1..9876: note = derived and/or modified CDS sequence (opt1) from DENV-2__KX380830__SS-prME
  source 1..9876: mol_type = other RNA
accgccgggatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcaccgtgatggcggccatcctggcctacaccatcggcaccacctacttccagcgggtgctgatcttcatcctcctgaccgccgtcgcgccctccatgaccatgcgctgcatcgggatcagcaaccgggacttcgtggagggcgtgtccggcgggagctgggtcgacatcgtgctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtctgcaagcacagcatggtggaccggggctggggcaacgggtgcggcctgttcgggaagggcgggatcgtgacgtgcgccatgttcacgtgcaagaagaacatggagggcaagatcgtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgccacgatggagtgcagcccccgcaccggcctggacttcaacgagatggtgctcctgcagatggagaacaaggcgtggctggtgcaccggcagtggttcctcgacctgcccctgccctggctcccgggcgccgacacccaggggtccaactggatccagaaggagaccctggtcacgttcaagaacccccacgccaagaagcaggacgtggtcgtgctgggcagccaggagggggccatgcacaccgccctcaccggcgcgaccgagatccagatgagctccgggaacctgctgttcacgggccacctcaagtgccgcctgcggatggacaagctgcagctcaagggcatgagctactccatgtgcaccgggaagttcaaggtggtcaaggagatcgccgagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcgtgggacttcgggagcctgggcggggtgttcacctccatcggcaaggccctgcaccaggtcttcggggccatctacggcgccgcgttcagcggcgtgtcctggaccatgaagatcctcatcggggtggtcatcacctggatcggcatgaacagccgctccacgagcctgtccgtgagcctggtgctggtcgggatcgtgaccctctacctgggcgtgatggtccaggccgactccgggtgcgtggtgagctggaagaacaaggagctgaagtgcggcagcggcatcttcatcaccgacaacgtccacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtgaagctgaccatcatgacgggggacatcaagggcatcatgcaggcggggaagcggagcctccgcccgcagcccaccgagctgaagtactcctggaaggcctggggcaaggccaagatgctgagcaccgagctccacaaccacaccttcctgatcgacggccccgagacggccgagtgcccgaacaccaaccgggcctggaactccctggaggtcgaggactacgggttcggcgtgttcaccaccaacatctggctcaagctgaaggagcgccaggacgtgttctgcgacagcaagctgatgtccgcggccatcaaggacaaccgggccgtccacgccgacatggggtactggatcgagagcgccctcaacgacacgtggaagatcgagaaggcgtccttcatcgaggtcaagagctgccactggcccaagtcccacaccctgtggagcaacggcgtgctggagtccgagatgatcatccccaagaacttcgccggccccgtgagccagcacaactaccgcccggggtaccacacccagaccgccggcccctggcacctcgggcggctggagatggacttcgacttctgcgagggcaccacggtggtggtcaccgaggactgcgggaaccgcggccccagcctgcggaccaccacggcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtgaccgcgggccacgggcagatcgacaacttcagcctcggcgtcctgggcatggccctgttcctcgaggagatgctgcgcacgcgggtggggaccaagcacgccatcctgctcgtggccgtctccttcgtgaccctgatcaccggcaacatgagcttccgcgacctggggcgcgtgatggtcatggtgggcgccacgatgaccgacgacatcgggatgggcgtgacctacctcgcgctgctggccgccttcaaggtccggcccaccttcgccgccggcctcctgctgcgcaagctcacgtccaaggagctgatgatgaccaccatcgggatcgtgctgctcagccagtccaccatccccgagacgatcctggagctgaccgacgcgctcgccctgggcatgatggtgctgaagatcgtccggaacatggagaagtaccagctcgccgtgaccatcatggccatcctgtgcgtcccgaacgccgtgatcctgcagaacgcgtggaaggtgagctgcaccatcctcgccgtcgtgtccgtgagccccctgctgctcacgtccagccagcagaaggccgactggatccccctggccctgaccatcaaggggctcaaccccaccgcgatcttcctgaccacgctgtcccgcaccagcaagaagcggtcctggccgctcaacgaggccatcatggccgtcggcatggtgagcatcctggcctccagcctgctcaagaacgacatccccatgaccggccccctggtggccgggggcctgctcaccgtctgctacgtgctgacggggcgcagcgcggacctggagctcgagcgggccgccgacgtgcgctgggaggagcaggccgagatctccggcagctcccccatcctgagcatcaccatctccgaggacgggagcatgtccatcaagaacgaggaggaggagcagaccctgaccatcctcatccggacgggcctgctggtcatcagcggcctcttcccggtgtccatccccatcaccgccgcggcctggtacctgtgggaggtgaagaagcagcgcgccggggtcctgtgggacgtgcccagcccgccgcccgtgggcaaggccgagctcgaggacggggcctaccggatcaagcagaagggcatcctggggtactcccagatcggcgcgggcgtctacaaggaggggaccttccacaccatgtggcacgtgacccgcggcgccgtgctgatgcacaaggggaagcggatcgagcccagctgggccgacgtcaagaaggacctcatctcctacggcgggggctggaagctggagggcgagtggaaggagggggaggaggtccaggtgctggccctcgagcccggcaagaacccccgcgccgtccagacgaagcccgggctgttcaagaccaacaccggcaccatcggggcggtgagcctggacttctcccccggcacgagcggctcccccatcgtggacaagaaggggaaggtcgtgggcctctacgggaacggcgtggtcacccggagcggcacctacgtgtccgccatcgcccagaccgagaagtccatcgaggacaaccccgagatcgaggacgacatcttccgcaagaagcggctgacgatcatggacctgcaccccggggccggcaagaccaagcgctacctgcccgcgatcgtgcgggaggccatcaagcgcgggctccggaccctgatcctggccccgacccgcgtcgtggccgccgagatggaggaggcgctccgcggcctgcccatccggtaccagacgcccgccatccgcgccgagcacaccgggcgggagatcgtggacctgatgtgccacgccaccttcaccatgcgcctcctgagccccatccgggtcccgaactacaacctgatcatcatggacgaggcccacttcacggaccccgcgtccatcgccgcccgcggctacatcagcacccgggtggagatgggcgaggccgccgggatcttcatgaccgcgacgccgcccggctcccgcgacccgttcccccagagcaacgcccccatcatggacgaggagcgggagatccccgagcgctcctggaacagcgggcacgagtgggtgacggacttcaagggcaagaccgtctggttcgtgccgtccatcaaggccgggaacgacatcgccgcgtgcctccggaagaacggcaagaaggtgatccagctgagccgcaagaccttcgactccgagtacatcaagacccggacgaacgactgggacttcgtcgtgaccaccgacatcagcgagatgggcgccaacttcaaggccgagcgcgtgatcgacccccggcgctgcatgaagcccgtcatcctgaccgacggggaggagcgggtgatcctcgccggccccatgccggtgacgcactccagcgccgcgcagcgccgggggcgcgtcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgccatcgacggcgagtaccgcctgcgcggggaggcccgcaagaccttcgtggacctgatgcggcgcggcgacctccccgtctggctggcgtaccgggtggccgccgaggggatcaactacgccgaccgccggtggtgcttcgacggcgtcaagaacaaccagatcctggaggagaacgtggaggtggagatctggaccaaggagggggagcgcaagaagctcaagccgcggtggctggacgcccgcatctacagcgaccccctggcgctcaaggagttcaaggagttcgccgccggccggaagtccctgacgctgaacctcatcaccgagatgggccgcctgcccaccttcatgacccagaaggcccggaacgcgctggacaacctcgccgtcctgcacacggccgaggccgggggccgcgcctacaaccacgcgctgagcgagctccccgagaccctggagaccctgctcctgctgaccctcctggccacggtgaccgggggcatcttcctgttcctcatgtccggcaaggggatcggcaagatgaccctggggatgtgctgcatcatcaccgccagcatcctgctctggtacgcccagatccagccgcactggatcgccgcgtccatcatcctggagttcttcctgatcgtgctcctgatccccgagcccgagaagcagcggacgccccaggacaaccagctgacgtacgtcgtgatcgccatcctcaccgtggtcgccgccaccatggccaacgagatgggcttcctggagaagaccaagaaggacttcgggctgggcagcatcacgacccagcagccggacagcaacatcctcgacatcgacctgcgccccgcgtccgcctggaccctgtacgccgtggccaccacgttcatcacccccatgctccggcacagcatcgagaactccagcgtgaacgtctccctgaccgccatcgcgaaccaggccaccgtgctgatgggcctcgggaagggctggcccctgagcaagatggacatcggggtgccgctgctcgccatcggctgctactcccaggtcaaccccatcacgctgaccgccgcgctgctcctgctggtggcccactacgccatcatcgggcccggcctccaggccaaggccacccgcgaggcgcagaagcgggccgccgccggcatcatgaagatccccgccgcggacgggatgaccgtgatcgacctggacccgatcccctacgaccccaagttcgagaagcagctgggccaggtcatgctcctggtgctgtgcgtgacgcaggtcctcatgatgcgcaccacctgggccctgtgcgaggccctgaccctcgccacggggcccatcagcaccctgtgggagggcaacccggggcgcttctggaacaccaccatcgccgtgtccatggcgaacatcttccggggcagctacctggccggcgccgggctcctgttctccatcatgaagaacacggccaacacccgccggggcaccgggaacaccggcgagacgctgggcgagaagtggaagaaccgcctcaacgcgctgggcaagagcgagttccagatctacaagaagtccggcatccaggaggtggaccggaccctggccaaggaggggatcaagcgcggcgagaccgaccaccacgccgtcagccgggggtccgccaagctccgctggttcgtggagcggaacctggtgacccccgagggcaaggtcgtggacctgggctgcgggcgcggcgggtggagctactactgcggcgggctcaagaacgtgaaggaggtcaagggcctgacgaagggcgggcccggccacgaggagcccatcccgatgtccacctacgggtggaacctggtgcggctccagagcggcgtggacgtcttcttcacgccgcccgagaagtgcgacaccctgctgtgcgacatcggggagtccagccccaacccgacggtggaggccggccgcaccctccgggtgctgaacctggtcgagaactggctcaacaacaacacccagttctgcatcaaggtgctgaacccctacatgcccagcgtgatcgagaagatggaggcgctgcagcgcaagtacggcggggccctggtccggaacccgctctcccgcaacagcacccacgagatgtactgggtgtccaacgccagcggcaacatcgtgtccagcgtcaacatgatctcccggatgctgatcaaccgcttcaccatgaagcacaagaaggccacgtacgagcccgacgtggacctggggagcggcacccggaacatcgggatcgagtccgagacccccaacctcgacatcatcggcaagcgcatcgagaagatcaagcaggagcacgagaccagctggcactacgaccaggaccacccctacaagacgtgggcctaccacggctcctacgagaccaagcagaccgggagcgcgtccagcatggtgaacggcgtcgtgcgcctgctgaccaagccgtgggacgtgatccccatggtcacgcagatggccatgaccgacaccacccccttcgggcagcagcgggtgttcaaggagaaggtggacacgcgcacccaggagcccaaggagggcaccaagaagctcatgaagatcaccgccgagtggctgtggaaggagctgggcaagaagaagacgccgcggatgtgcacccgcgaggagttcacccggaaggtccgctccaacgccgccctcggggcgatcttcaccgacgagaacaagtggaagtccgcccgggaggccgtggaggactccggcttctgggagctggtcgacaaggagcgcaacctgcacctcgaggggaagtgcgagacgtgcgtgtacaacatgatgggcaagcgggagaagaagctgggggagttcggcaaggccaagggcagccgcgcgatctggtacatgtggctgggggcccggttcctcgagttcgaggccctgggcttcctgaacgaggaccactggttctcccgcgagaacagcctcagcggggtggagggcgaggggctgcacaagctgggctacatcctccgggacgtctccaagaaggagggcggggccatgtacgccgacgacaccgcgggctgggacacccgcatcaccctggaggacctgaagaacgaggagatggtgacgaaccacatggagggggagcaccggaagctcgccgaggccatcttccgcctgacctaccagaacaaggtggtccgggtgcagcgccccacgccccggggcaccgtgatggacatcatcagccgccgggaccagcgcgggtccggccaggtcgtgacgtacggcctgaacaccttcaccaacatggaggcccagctcatccgccagatggagggggagggcgtgttcaagagcatccagcacctgaccgtcacggaggagatcgccgtgaagaactggctggagcgggtggggcgcgagcggctctcccgcatggcgatcagcggcgacgactgcgtcgtgaagcccctggacgaccggttcgcctccgccctgaccgccctcaacgacatgggcaaggtgcgcaaggacatccagcagtgggagccgagccgggggtggaacgactggacccaggtccccttctgctcccaccacttccacgagctgatcatgaaggacggccgcgtgctggtggtcccctgccggaaccaggacgagctcatcgggcgcgcccggatcagccagggcgcggggtggtccctgcgcgagaccgcctgcctgggcaagagctacgcccagatgtggtccctcatgtacttccaccggcgcgacctgcggctggccgccaacgcgatctgcagcgccgtgccctcccactgggtgccgatcagccgcacgacctggtccatccacgccacccacgagtggatgaccaccgaggacatgctcacggtctggaaccgggtgtggatccaggagaacccctggatggaggacaagacccccgtggagagctgggaggagatcccctacctgggcaagcgcgaggaccagtggtgcgggagcctgatcggcctcacctcccgggccacctgggcgaagaacatccagacggccatcaaccaggtccgcagcctgatcgggaacgaggagtacaccgactacatgccgtccatgaagcgcttccggcgcgaggaggaggaggccggcgtgctgtggtga

SEQ ID NO: 9058 - RNA, 9876 nt, synthetic construct
  misc_feature 1..9876: note = derived and/or modified CDS sequence (opt1) from DENV-2__KX380831__SS-prME
  source 1..9876: mol_type = other RNA
accgcggggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgagcagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggtccctgcgcccccagccgaccgagctgaagtacagctggaaggcgtggggcaaggccaagatgctctccaccgagctgcacaaccacacgttcctgatcgacggccccgagaccgccgagtgccccaacaccaaccgggcctggaacagcctcgaggtggaggactacgggttcggcgtcttcaccacgaacatctggctgaagctgaaggagcgccaggacgtgttctgcgactccaacctcatgagcgccgcgatcaaggacaaccgggccgtgcacgccgacatggggtactggatcgagtccgccctgaacgacacctggaagatcgagaaggccagcttcatcgaggtcaagtcctgccactggcccaagagccacaccctgtggtccaacggcgtgctcgagagcgagatgatcatccccaagaacttcgcgggccccgtgtcccagcacaactaccgccccgggtaccacacccagaccgccggcccgtggcacctggggcggctggagatggacttcgacttctgcgagggcacgaccgtcgtggtgaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtcaacagcctcgtgacggccggccacgggcagatcgacaacttctccctgggcgtgctgggcatggccctcttcctggaggagatgctgcgcacccgggtcgggaccaagcacgccatcctcctggtggccgtgagcttcgtcaccctgatcacgggcaacatgtccttccgcgacctcgggcgcgtgatggtgatggtcggcgccaccatgaccgacgacatcgggatgggcgtgacctacctggccctgctcgcggccttcaaggtgcggcccacgttcgccgccggcctgctgctccgcaagctgaccagcaaggagctgatgatgaccaccatcgggatcgtcctcctgtcccagagcacgatccccgagtccatcctggagctcaccgacgccctggcgctgggcatgatggtgctcaagatcgtccggaacatggagaagtaccagctggccgtgaccatcatggccatcctgtgcgtgcccaacgccgtcatcctccagaacgcctggaaggtgagctgcaccacgctggcggtggtctccgtgagcccgctgctcctgacctccagccagcagaaggccgactggatccccctggccctcaccatcaaggggctgaaccccaccgccatcttcctgacgaccctctcccgcaccagcaagaagcggtcctggcccctgaacgaggcgatcatggccgtgggcatggtcagcatcctggcctccagcctcctgaagaacgacatcccgatgaccggccccctggtggccgggggcctcctgacggtgtgctacgtcctgaccgggcgcagcgccgacctcgagctggagcgggcggccgacgtgcgctgggaggagcaggccgagatctccggcagctcccccatcctgagcatcaccatctccgaggacgggagcatgtccatcaagaacgaggaggaggagcagaccctcacgatcctgatccggaccggcctgctcgtgatcagcggcctgttccccgtctccatcccgatcaccgccgccgcgtggtacctgtgggaggtgaagaagcagcgcgccggggtgctctgggacgtcccctccccgccgcccgtgggcaaggccgagctggaggacggggcctaccggatcaagcagaagggcatcctggggtactcccagatcggcgccggcgtgtacaaggaggggaccttccacaccatgtggcacgtcacgcgcggcgcggtgctcatgcacaaggggaagcggatcgagcccagctgggccgacgtgaagaaggacctgatctcctacggcgggggctggaagctggagggcgagtggaaggagggggaggaggtccaggtgctcgccctggagcccggcaagaacccgcgcgccgtgcagaccaagcccgggctgttcaagaccaacaccggcacgatcggggccgtcagcctcgacttctcccccggcaccagcggctcccccatcgtggacaagaaggggaaggtggtcggcctgtacgggaacggcgtggtgacccggagcggcacctacgtctccgcgatcgcccagacggagaagtccatcgaggacaacccggagatcgaggacgacatcttccgcaagaagcggctgaccatcatggacctgcaccccggggccggcaagaccaagcgctacctccccgccatcgtgcgggaggcgatcaagcgcgggctgcggaccctgatcctcgcccccacgcgcgtggtcgccgccgagatggaggaggccctgcgcggcctgccgatccggtaccagacccccgcgatccgcgccgagcacaccgggcgggagatcgtggacctcatgtgccacgccaccttcacgatgcgcctgctgagccccatccgggtgcccaactacaacctcatcatcatggacgaggcccacttcaccgacccggcctccatcgcggcccgcggctacatcagcacccgggtcgagatgggcgaggccgccgggatcttcatgaccgccacgccgcccggctcccgcgaccccttcccgcagagcaacgcgcccatcatggacgaggagcgggagatccccgagcgctcctggaacagcgggcacgagtgggtgaccgacttcaagggcaagaccgtgtggttcgtcccctccatcaaggccgggaacgacatcgccgcctgcctgcggaagaacggcaagaaggtgatccagctgagccgcaagaccttcgactccgagtacatcaagacgcggaccaacgactgggacttcgtggtcaccaccgacatcagcgagatgggcgcgaacttcaaggccgagcgcgtgatcgacccgcggcgctgcatgaagcccgtgatcctcacggacggggaggagcgggtcatcctggccggccccatgcccgtgacccactccagcgccgcccagcgccgggggcgcgtgggccgcaacccgaagaacgagaacgaccagtacatctacatgggggagcccctggagaacgacgaggactgcgcgcactggaaggaggccaagatgctcctggacaacatcaacacccccgagggcatcatcccctccatgttcgagccggagcgggagaaggtcgacgccatcgacggcgagtaccgcctgcgcggggaggcccgcaagaccttcgtggacctcatgcggcgcggcgacctgcccgtctggctggcctaccgggtggcggccgaggggatcaactacgccgaccgccggtggtgcttcgacggcgtgaagaacaaccagatcctcgaggagaacgtcgaggtggagatctggacgaaggagggggagcgcaagaagctgaagccccggtggctggacgcccgcatctacagcgacccgctcgccctgaaggagttcaaggagttcgcggccggccggaagtccctgaccctcaacctgatcaccgagatgggccgcctgcccaccttcatgacgcagaaggccaagaacgccctcgacaacctggcggtgctgcacaccgccgaggccgggggccgggcctacaaccacgccctcagcgagctgcccgagaccctggagaccctcctgctgctcacgctgctggcgaccgtcaccgggggcatcttcctcttcctgatgtccggcaaggggatcggcaagatgaccctggggatgtgctgcatcatcaccgccagcatcctcctgtggtacgcccagatccagccccactggatcgccgcctccatcatcctggagttcttcctcatcgtgctgctgatcccggagcccgagaagcagcgcacgccccaggacaaccagctcacctacgtggtcatcgcgatcctgaccgtggtggccgccaccatggccaacgagatgggcttcctggagaagacgaagaaggacttcgggctcggcagcatcaccacccagcagcccgagagcaacatcctggacatcgacctgcggccggcctccgcgtggaccctctacgccgtcgccacgaccttcatcacccccatgctgcgccacagcatcgagaactccagcgtgaacgtgtccctgaccgccatcgccaaccaggcgacggtcctcatgggcctggggaagggctggcccctgagcaagatggacatcggggtgcccctcctggccatcggctgctactcccaggtgaacccgatcaccctgaccgccgccctcctgctgctcgtcgcgcactacgccatcatcgggcccggcctgcaggccaaggccacccgggaggcccagaagcgcgcggccgccggcatcatgaagaaccccacggtggacgggatgaccgtgatcgacctggaccccatcccgtacgaccccaagttcgagaagcagctcggccaggtcatgctgctggtgctctgcgtgacccaggtcctgatgatgcggaccacgtgggccctgtgcgaggccctcaccctggcgaccgggcccatcagcaccctgtgggagggcaaccccgggcgcttctggaacacgaccatcgccgtgtccatggccaacatcttccgcggcagctacctcgccggcgccgggctgctgttctccatcatgaagaacaccgcgaacacccggcgcggcacggggaacaccggcgagaccctcggcgagaagtggaagaaccggctgaacgccctgggcaagagcgagttccagatctacaagaagtccggcatccaggaggtggaccgcaccctcgccaaggaggggatcaagcggggcgagacggaccaccacgccgtcagccgcgggtccgcgaagctgcggtggttcgtggagcgcaacctggtgaccccggagggcaaggtcgtggacctcggctgcgggcggggcgggtggagctactactgcggcgggctgaagaacgtgaaggaggtcaagggcctgaccaagggcgggcccggccacgaggagcccatccccatgtccacctacgggtggaacctcgtgcgcctgcagagcggcgtggacgtcttcttcacgccgcccgagaagtgcgacaccctgctctgcgacatcggggagtccagccccaaccccaccgtggaggccggccggaccctgcgcgtgctgaacctcgtcgagaactggctgaacaacaacacccagttctgcatcaaggtgctgaacccgtacatgcccagcgtgatcgagaagatggaggccctgcagcggaagtacggcggggccctcgtccgcaaccccctgtcccggaacagcacgcacgagatgtactgggtgtccaacgccagcggcaacatcgtgtccagcgtcaacaccatctcccgcatgctgatcaaccggttcaccatgcgccacaagaaggcgacctacgagccggacgtggacctcgggagcggcacgcggaacatcgggatcgagtccgagacccccaacctggacatcatcggcaagcgcatcgagaagatcaagcaggagcacgagaccagctggcactacgaccaggaccacccctacaagacctgggcctaccacggctcctacgagacgaagcagaccgggagcgcctccagcatggtgaacggcgtcgtgcgcctgctcaccaagccctgggacgtgatcccgatggtcacccagatggccatgacggacaccacccccttcgggcagcagcgggtgttcaaggagaaggtcgacacccgcacgcaggagcccaaggagggcaccaagaagctgatgaagatcaccgccgagtggctgtggaaggagctcggcaagaagaagacgccccggatgtgcacgcgcgaggagttcacccggaaggtgcgctccaacgcggccctgggggccatcttcaccgacgagaacaagtggaagtccgcccgggaggccgtggaggactccggcttctgggagctggtcgacaaggagcgcaacctccacctggaggggaagtgcgagacctgcgtgtacaacatgatgggcaagcgggagaagaagctgggggagttcggcaaggcgaagggcagccgcgccatctggtacatgtggctcggggcccggttcctggagttcgaggccctgggcttcctcaacgaggaccactggttctcccgcgagaacagcctgagcggggtggagggcgaggggctgcacaagctcggctacatcctgcgggacgtctccaagaaggagggcggggcgatgtacgccgacgacacggccggctgggacacccgcatcaccctggaggacctcaagaacgaggagatggtgaccaaccacatggagggggagcacaagaagctggccgaggccatcttcaagctgacgtaccagaacaaggtggtccgggtgcagcgcccgacgccccggggcaccgtgatggacatcatcagccgccgggaccagcgcgggtccggccaggtcgtgacctacggcctcaacaccttcaccaacatggaggcgcagctgatccggcagatggagggggagggcgtgttcaagagcatccagcagctgaccgtcaaggaggagatcgccgtgaagaactggctcatccgcgtggggcgcgagcggctgtcccgcatggccatcagcggcgacgactgcgtcgtgaagcccctggacgaccggttcgcctccgccctcaccgcgctgaacgacatgggcaaggtgcgcaaggacatccagcagtgggagcccagccgggggtggaacgactggacgcaggtcccgttctgctcccaccacttccacgagctgatcatgaaggacggccgcgtgctcgtggtcccctgccggaaccaggacgagctgatcgggcgcgcccggatcagccagggcgccgggtggtccctgcgcgagaccgcctgcctcggcaagagctacgcccagatgtggtccctgatgtacttccaccggcgcgacctgcggctcgcggccaacgccatctgcagcgccgtgccctcccactggatccccaccagccgcaccacctggtccatccacgccacgcacgagtggatgaccaccgaggacatgctgaccgtgtggaaccgggtctggatccaggagaacccgtggatggaggacaagacgcccgtggagagctgggaggagatcccctacctgggcaagcgcgaggaccagtggtgcgggagcctcatcggcctgacctcccgggcgacctgggccaagaacatccagaccgccatcaaccaggtgcgcagcctgatcgggaacgaggagtacacggactacatgccctccatgaagcggttccgccgcgaggaggaggaggccggcgtcctctggtga

SEQ ID NO: 9059 - RNA, 9876 nt, synthetic construct
  misc_feature 1..9876: note = derived and/or modified CDS sequence (opt1) from DENV-2__KX380808__SS-prME
  source 1..9876: mol_type = other RNA
accgccggcatcatcatcatgatgatccccaccgtgatggccttccacctgaccacccgcaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctcaagcagaacgagcccgaggacatcgactgctggtgcaacagcaccagcacctgggtgacctacgggacctgcaccgccaccggcgagcaccgccgggagaagcgcagcgtcgccctggtgccccacgtgggcatggggctggagacccggaccgagacctggatgtccagcgagggcgcctggaagcacgcccagcgcatcgagacctgggtcctccggcaccccgggttcaccatcatggcggccatcctggcctacaccatcggcaccacctacttccagcgcgtgctgatcttcatcctcctgacggccatcgcgccctccatgaccatgcggtgcatcgggatcagcaaccgcgacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcggaagtactgcatcgaggccaagctcaccaacacgaccaccgcgagccgctgcccgacccagggggagccctccctgaacgaggagcaggacaagcggttcgtgtgcaagcacagcatggtggaccgcggctggggcaacgggtgcggcctgttcgggaagggcgggatcgtcacgtgcgccatgttcacgtgcaagaagaacatggagggcaagatcgtgcagcccgagaacctcgagtacaccatcgtgatcacgccccactccggcgaggagaacgccgtcgggaacgacacgggcaagcacgggaaggagatcaaggtgaccccgcagagctccatcaccgaggccgagctgaccggctacgggaccgtgacgatggagtgcagcccccggaccggcctggacttcaacgagatggtcctcctgcagatggagaacaaggcctggctggtgcaccgccagtggttcctcgacctgcccctgccctggctcccgggcgcggacacccaggggtccaactggatccagaaggagaccctggtgacgttcaagaacccccacgccaagaagcaggacgtcgtggtcctgggcagccaggagggggccatgcacaccgccctcaccggcgccaccgagatccagatgagctccgggaacctgctgttcacgggccacctcaagtgccggctgcgcatggacaagctgcagctcaagggcatgagctactccatgtgcaccgggaagttcaaggtggtgaaggagatcgcggagacccagcacggcaccatcgtcatccgggtgcagtacgagggggacggcagcccctgcaagatccccttcgagatcatggacctggagaagcgccacgtgctgggccggctcatcacggtcaacccgatcgtgaccgagaaggactcccccgtgaacatcgaggccgagccgcccttcggggacagctacatcatcatcggcgtcgagccggggcagctgaagctgtcctggttcaagaagggcagctccatcgggcagatgttcgagaccaccatgcgcggcgccaagcgcatggccatcctcggcgacacggcctgggacttcgggagcctgggcggggtgttcacctccatcggcaaggcgctgcaccaggtgttcggggccatctacggcgccgccttcagcggcgtctcctggaccatgaagatcctcatcggggtggtgatcacctggatcggcatgaacagccggtccacgagcctgtccgtcagcctggtgctggtgggggtcgtgaccctctacctgggcgtgatggtccaggcggactccgggtgcgtggtgagctggaagaacaaggagctgaagtgcggcagcggcatcttcatcaccgacaacgtccacacctggacggagcagtacaagttccagcccgagtcccccagcaagctcgcctccgccatccagaaggcccacgaggaggggatctgcggcatccgcagcgtgacccggctggagaacctgatgtggaagcagatcacccccgagctcaaccacatcctgtccgagaacgaggtgaagctgaccatcatgacgggggacatcaagggcatcatgcaggccgggaagcgcagcctccggccgcagcccaccgagctgaagtactcctggaaggcgtggggcaaggccaagatgctgagcaccgagctccacaaccacaccttcctgatcgacggccccgagacggccgagtgcccgaacaccaaccgcgcctggaactccctggaggtcgaggactacgggttcggcgtgttcaccaccaacatctggctcaagctgaaggagcggcaggacgtgttctgcgacagcaagctgatgtccgccgcgatcaaggacaaccgcgccgtccacgccgacatggggtactggatcgagagcgccctcaacgacacgtggaagatcgagaaggcctccttcatcgagatcaagagctgccactggcccaagtcccacaccctgtggagcaacggcgtgctggagtccgagatgatcatccccaagaacttcgcgggccccgtgagccagcacaactaccggccggggtaccacacccagaccgccggcccctggcacctcgggcgcctggagatggacttcgacttctgcgagggcaccacggtcgtggtgaccgaggactgcgggaaccggggccccagcctgcgcaccaccacggcctccggcaagctcatcaccgagtggtgctgccggagctgcaccctgcccccgctgcgctaccgcggggaggacggctgctggtacgggatggagatccgccccctcaaggagaaggaggagaacctggtcaactccctggtgaccgccggccacgggcagatcgacaacttcagcctcggcgtgctgggcatggcgctgttcctcgaggagatgctgcggacgcgcgtcgggaccaagcacgccatcctgctcgtggccgtgtccttcgtcaccctgatcaccggcaacatgagcttccgggacctggggcgcgtgatggtgatggtcggcgccacgatgaccgacgacatcgggatgggcgtgacctacctcgccctgctggcggccttcaaggtgcgccccaccttcgccgccggcctcctgctgcggaagctcacgtccaaggagctgatgatgaccaccatcgggatcgtcctgctcagccagtccaccatccccgagacgatcctggagctgaccgacgccctcgcgctgggcatgatggtgctgaagatcgtgcgcaacatggagaagtaccagctcgccgtcaccatcatggccatcctgtgcgtgccgaacgccgtcatcctgcagaacgcctggaaggtgagctgcaccacgctcgcggtggtctccgtgagccccctgctgctcacctccagccagcagaaggccgactggatccccctggccctgaccatcaaggggctcaaccccaccgccatcttcctgacgaccctgtcccggaccagcaagaagcgctcctggccgctcaacgaggcgatcatggccgtgggcatggtcagcatcctggcctccagcctgctcaagaacgacatccccatgaccggccccctggtggccgggggcctgctcacggtgtgctacgtcctgaccgggcggagcgccgacctggagctcgagcgcgcggccgacgtgcggtgggaggagcaggccgagatctccggcagctcccccatcctgagcatcaccatctccgaggacgggagcatgtccatcaagaacgaggaggaggagcagaccctgacgatcctcatccgcaccggcctgctggtgatcagcggcctcttcccggtctccatccccatcaccgccgccgcgtggtacctgtgggaggtgaagaagcagcgggccggggtgctgtgggacgtccccagcccgccgcccgtgggcaaggccgagctcgaggacggggcctaccgcatcaagcagaagggcatcctggggtactcccagatcggcgccggcgtgtacaaggaggggaccttccacaccatgtggcacgtcacgcggggcgcggtgctgatgcacaaggggaagcgcatcgagcccagctgggccgacgtgaagaaggacctcatctcctacggcgggggctggaagctggagggcgagtggaaggagggggaggaggtccaggtgctggccctcgagcccggcaagaacccccgggccgtgcagaccaagcccgggctgttcaagaccaacaccggcacgatcggggccgtcagcctggacttctcccccggcaccagcggctcccccatcgtggacaagaaggggaaggtggtcggcctctacgggaacggcgtggtgacccgcagcggcacctacgtctccgcgatcgcccagacggagaagtccatcgaggacaaccccgagatcgaggacgacatcttccggaagaagcgcctgaccatcatggacctgcaccccggggccggcaagaccaagcggtacctgcccgccatcgtgcgcgaggcgatcaagcgggggctccgcaccctgatcctggccccgacgcgggtggtcgccgccgagatggaggaggccctccgcggcctgcccatccgctaccagacccccgcgatccgggccgagcacaccgggcgcgagatcgtggacctgatgtgccacgccaccttcacgatgcggctcctgagccccatccgcgtgccgaactacaacctgatcatcatggacgaggcccacttcaccgaccccgcctccatcgcggcccggggctacatcagcacccgcgtcgagatgggcgaggccgccgggatcttcatgaccgccacgccgcccggctcccgggacccgttcccccagagcaacgcgcccatcatggacgaggagcgcgagatccccgagcggtcctggaacagcgggcacgagtgggtgaccgacttcaagggcaagaccgtgtggttcgtcccgtccatcaaggccgggaacgacatcgccgcctgcctccgcaagaacggcaagaaggtgatccagctgagccggaagaccttcgacacggagtacatcaagacccgcaccaacgactgggacttcgtggtcaccacggacatctccgagatgggcgcgaacttcaaggccgagcgggtgatcgacccccgccggtgcatgaagcccgtgatcctgaccgacggggaggagcgcgtcatcctcgccggccccatgccggtgacccacagctccgccgcccagcggcgcgggcgggtgggccgcaaccccaagaacgagaacgaccagtacatctacatgggggagcccctggagaacgacgaggactgcgcgcactggaaggaggccaagatgctgctcgacaacatcaacacccccgagggcatcatcccgagcatgttcgagcccgagcgcgagaaggtcgacgccatcgacggcgagtaccggctgcgcggggaggcccggaagacgttcgtggacctgatgcgccggggcgacctccccgtgtggctggcctaccgcgtcgcggccgaggggatcaactacgccgaccggcgctggtgcttcgacggcgtgaagaacaaccagatcctggaggagaacgtcgaggtggagatctggaccaaggagggggagcggaagaagctcaagccgcgctggctggacgcccggatctactccgaccccctggccctcaaggagttcaaggagttcgcggccggccgcaagagcctgaccctgaacctcatcaccgagatgggccggctgcccacgttcatgacccagaaggcccgcaacgccctggacaacctcgcggtgctgcacaccgccgaggccgggggccgggcctacaaccacgccctgtccgagctccccgagaccctggagacgctgctcctgctgaccctcctggcgaccgtcaccgggggcatcttcctgttcctcatgagcggcaaggggatcggcaagatgaccctggggatgtgctgcatcatcacggcctccatcctgctctggtacgcccagatccagccgcactggatcgccgccagcatcatcctggagttcttcctgatcgtgctcctgatccccgagcccgagaagcagcgcacgccccaggacaaccagctgacctacgtggtcatcgcgatcctcaccgtggtggccgccacgatggccaacgagatgggcttcctggagaagaccaagaaggacttcgggctgggctccatcaccacccagcagccggagagcaacatcctcgacatcgacctgcggcccgccagcgcgtggacgctgtacgccgtcgccaccaccttcatcacccccatgctccgccactccatcgagaacagctccgtgaacgtgagcctgacggccatcgccaaccaggcgaccgtcctgatgggcctcgggaagggctggcccctgtccaagatggacatcggggtgccgctgctcgccatcggctgctacagccaggtgaaccccatcaccctgaccgccgccctgctcctgctggtcacgcactacgcgatcatcgggcccggcctccaggccaaggccacccgggaggcccagaagcgcgccgcggccggcatcatgaagatccccaccgtggacgggatcaccgtgatcgacctggacccgatcccctacgaccccaagttcgagaagcagctgggccaggtcatgctcctggtgctgtgcgtgacgcaggtcctcatgatgcggaccacctgggccctgtgcgaggccctgaccctcgccacggggcccatctccaccctgtgggagggcaacccggggcgcttctggaacaccaccatcgcggtgagcatggccaacatcttccgcggctcctacctggccggcgccgggctcctgttcagcatcatgaagaacacggccaacacccggcgcggcaccgggaacaccggcgagacgctgggcgagaagtggaagaaccggctcaacgcgctggggaagtccgagttccagatctacaagaagtccggcatccaggaggtggaccgcaccctggccaaggaggggatcaagcggggcgagaccgaccaccacgccgtctcccgcgggagcgccaagctccggtggttcgtggagcgcaacctggtgacccccgagggcaaggtcgtggacctgggctgcgggcggggcgggtggtcctactactgcggcgggctcaagaacgtgaaggaggtcaagggcctgacgaagggcgggcccggccacgaggagcccatcccgatgagcacctacgggtggaacctggtgcgcctccagtccggcgtggacgtcttcttcacgccgcccgagaagtgcgacaccctgctgtgcgacatcggggagagctcccccaacccgaccgtggaggcgggccggacgctccgcgtgctgaacctggtcgagaactggctcaacaacaacacccagttctgcatcaaggtgctgaacccctacatgcccagcgtgatcgagaagatggaggccctgcagcggaagtacggcggggccctggtccgcaacccgctcagccggaactccacccacgagatgtactgggtgagcaacgcctccggcaacatcgtgagctccgtcaacatgatcagccgcatgctgatcaaccggttcaccatgcgccacaagaaggccacgtacgagcccgacgtggacctggggtccggcacccggaacatcgggatcgagagcgagacccccaacctcgacatcatcggcaagcgcatcgagaagatcaagcaggagcacgagacctcctggcactacgaccaggaccacccctacaagacgtgggcgtaccacggcagctacgagaccaagcagaccgggtccgccagctccatggtgaacggcgtcgtgcgcctgctgaccaagccgtgggacgtgatccccatggtcacgcagatggccatgaccgacaccacccccttcgggcagcagcgggtgttcaaggagaaggtggacacgcgcacccaggagcccaaggagggcaccaagaagctcatgaagatcaccgccgagtggctgtggaaggagctgggcaagaagaagacgccgcggatgtgcacccgcgaggagttcacccggaaggtccgcagcaacgccgcgctcggggccatcttcaccgacgagaacaagtggaagtccgcccgggaggccgtggaggacagcggcttctgggagctggtcgacaaggagcgcaacctgcacctcgaggggaagtgcgagacgtgcgtgtacaacatgatgggcaagcgggagaagaagctgggggagttcggcaaggccaagggctcccgcgcgatctggtacatgtggctgggggcccggttcctcgagttcgaggccctgggcttcctgaacgaggaccactggttcagccgcgagaactccctcagcggggtggagggcgaggggctgcacaagctgggctacatcctccgggacgtcagcaagaaggagggcggggccatgtacgcggacgacaccgccggctgggacacccgcatcaccctggaggacctgaagaacgaggagatggtgacgaaccacatggagggggagcacaagaagctcgccgaggccatcttccggctgacctaccagaacaaggtggtccgcgtgcagcggcccacgccccggggcaccgtgatggacatcatctcccggcgcgaccagcgggggagcggccaggtcgtgacgtacggcctgaacaccttcaccaacatggaggcccagctcatccgccagatggagggggagggcctgttcaagtccatccagcacctgaccgtgacggaggagatcgcggtcaagaactggctcgtgcgcgtggggcgggagcgcctgagccggatggccatctccggcgacgactgcgtcgtgaagcccctggacgaccgcttcgccagcgccctcaccgccctgaacgacatgggcaaggtgcggaaggacatccagcagtgggagccgtcccgcgggtggaacgactggacccaggtccccttctgcagccaccacttccacgagctgatcatgaaggacggccgggtgctcgtggtcccctgccgcaaccaggacgagctgatcgggcgggcgcgcatctcccagggcgccgggtggagcctgcgggagaccgcctgcctcggcaagtcctacgcccagatgtggagcctgatgtacttccaccgccgggacctgcgcctcgccgcgaacgccatctgctccgccgtgcccagccactgggtgccgacctcccggacgacctggagcatccacgccacccacgagtggatgaccacggaggacatgctgaccgtctggaaccgcgtgtggatccaggagaacccctggatggaggacaagacccccgtggagtcctgggaggagatcccctacctgggcaagcgggaggaccagtggtgcgggagcctcatcggcctgaccagccgcgccacgtgggcgaagaacatccagaccgccatcaaccaggtccggtccctgatcgggaacgaggagtacaccgactacatgccgagcatgaagcgcttccgccgggaggaggaggaggccggcgtgctctggtga

SEQ ID NO: 9060 - RNA, 9876 nt, synthetic construct
  misc_feature 1..9876: note = derived and/or modified CDS sequence (opt1) from DENV-2__KX380832__SS-prME
  source 1..9876: mol_type = other RNA
accgccgggatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacgcgcaccgagacctggatgtccagcgagggcgcctggaagcacgcccagcggatcgagacctgggtcctccgccaccccgggttcacggtgatggcggccatcctggcctacaccatcggcaccacctacttccagcgggtgctgatcttcatcctcctgacggccgtcgcgccctccatgaccatgcgctgcatcgggatcagcaaccgggacttcgtggagggcgtgtccggcgggagctgggtcgacatcgtgctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtctgcaagcacagcatggtggaccggggctggggcaacgggtgcggcctgttcgggaagggcgggatcgtgacgtgcgccatgttcacgtgcaagaagaacatggagggcaagatcgtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgccacgatggagtgcagcccccgcaccggcctggacttcaacgagatggtgctcctgcagatggagaacaaggcgtggctggtgcaccggcagtggttcctcgacctgcccctgccctggctcccgggcgccgacacccaggggtccaactggatccagaaggagaccctggtcacgttcaagaacccccacgccaagaagcaggacgtggtcgtgctgggcagccaggagggggccatgcacaccgccctcaccggcgcgaccgagatccagatgagctccgggaacctgctgttcacgggccacctcaagtgccgcctgcggatggacaagctgcagctcaagggcatgagctactccatgtgcaccgggaagttcaaggtggtcaaggagatcgccgagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcgtgggacttcgggagcctgggcggggtgttcacctccatcggcaaggccctgcaccaggtcttcggggccatctacggcgccgcgttcagcggcgtgtcctggaccatgaagatcctcatcggggtggtcatcacctggatcggcatgaacagccgctccacgagcctgtccgtgagcctggtgctggtcgggatcgtgaccctctacctgggcgtgatggtccaggccgactccgggtgcgtggtgagctggaagaacaaggagctgaagtgcggcagcggcatcttcatcaccgacaacgtccacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtgaagctgaccatcatgacgggggacatcaagggcatcatgcaggcggggaagcggagcctccgcccgcagcccaccgagctgaagtactcctggaaggcctggggcaaggccaagatgctgagcaccgagctccacaaccacaccttcctgatcgacggccccgagacggccgagtgcccgaacaccaaccgggcctggaactccctggaggtcgaggactacgggttcggcgtgttcaccaccaacatctggctcaagctgaaggagcgccaggacgtgttctgcgacagcaagctgatgtccgcggccatcaaggacaaccgggccgtccacgccgacatggggtactggatcgagagcgccctcaacgacacgtggaagatcgagaaggcgtccttcatcgaggtcaagagctgccactggcccaagtcccacaccctgtggagcaacggcgtgctggagtccgagatgatcatccccaagaacttcgccggccccgtgagccagcacaactaccgcccggggtaccacacccagaccgccggcccctggcacctcgggcggctggagatggacttcgacttctgcgagggcaccacggtggtggtcaccgaggactgcgggaaccgcggccccagcctgcggaccaccacggcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtgaccgcgggccacgggcagatcgacaacttcagcctcggcgtcctgggcatggccctgttcctcgaggagatgctgcgcacgcgggtggggaccaagcacgccatcctgctcgtggccgtctccttcgtgaccctgatcaccggcaacatgagcttccgcgacctggggcgcgtgatggtcatggtgggcgccacgatgaccgacgacatcgggatgggcgtgacctacctcgcgctgctggccgccttcaaggtccggcccaccttcgccgccggcctcctgctgcgcaagctcacgtccaaggagctgatgatgaccaccatcgggatcgtgctgctcagccagtccaccatccccgagacgatcctggagctgaccgacgcgctcgccctgggcatgatggtgctgaagatcgtccggaacatggagaagtaccagctcgccgtgaccatcatgaccatcctgtgcgtcccgaacgccgtgatcctgcagaacgcctggaaggtgagctgcacgatcctcgcggtcgtgtccgtgagccccctgctgctcacctccagccagcagaaggccgactggatccccctggccctgaccatcaaggggctcaaccccaccgccatcttcctgacgaccctgtcccgcaccagcaagaagcggtcctggccgctcaacgaggcgatcatggccgtcggcatggtgagcatcctggcctccagcctgctcaagaacgacatccccatgaccggccccctggtggccgggggcctgctcacggtctgctacgtgctgaccgggcgcagcgccgacctggagctcgagcgggcggccgacgtgcgctgggaggagcaggccgagatctccggcagctcccccatcctgagcatcaccatctccgaggacgggagcatgtccatcaagaacgaggaggaggagcagaccctgacgatcctcatccggaccggcctgctggtcatcagcggcctcttcccggtgtccatccccatcaccgccgccgcgtggtacctgtgggaggtgaagaagcagcgcgccggggtcctgtgggacgtgcccagcccgccgcccgtgggcaaggccgagctcgaggacggggcctaccggatcaagcagaagggcatcctggggtactcccagatcggcgccggcgtctacaaggaggggaccttccacaccatgtggcacgtgacgcgcggcgcggtgctgatgcacaaggggaagcggatcgagcccagctgggccgacgtcaagaaggacctcatctcctacggcgggggctggaagctggagggcgagtggaaggagggggaggaggtccaggtgctggccctcgagcccggcaagaacccccgcgccgtccagaccaagcccgggctgttcaagaccaacaccggcacgatcggggccgtgagcctggacttctcccccggcaccagcggctcccccatcgtggacaagaaggggaaggtcgtgggcctctacgggaacggcgtggtcacccggagcggcacctacgtgtccgcgatcgcccagacggagaagtccatcgaggacaaccccgagatcgaggacgacatcttccgcaagaagcggctgaccatcatggacctgcaccccggggccggcaagaccaagcgctacctgcccgccatcgtgcgggaggcgatcaagcgcgggctccggaccctgatcctggccccgacgcgcgtcgtggccgccgagatggaggaggccctccgcggcctgcccatccggtaccagacccccgcgatccgcgccgagcacaccgggcgggagatcgtggacctgatgtgccacgccaccttcacgatgcgcctcctgagccccatccgggtcccgaactacaacctgatcatcatggacgaggcccacttcaccgaccccgcctccatcgcggcccgcggctacatcagcacccgggtggagatgggcgaggccgccgggatcttcatgaccgccacgccgcccggctcccgcgacccgttcccccagagcaacgcgcccatcatggacgaggagcgggagatccccgagcgctcctggaacagcgggcacgagtgggtgaccgacttcaagggcaagaccgtctggttcgtgccgtccatcaaggccgggaacgacatcaccgcctgcctccggaagaacggcaagaaggtgatccagctgagccgcaagacgttcgactccgagtacatcaagacccggaccaacgactgggacttcgtcgtgaccacggacatcagcgagatgggcgccaacttcaaggcggagcgcgtgatcgacccccggcgctgcatgaagcccgtcatcctgaccgacggggaggagcgggtgatcctcgccggccccatgccggtgacccactccagcgccgcccagcgccgggggcgcgtcggccgcaaccccaagaacgagaacgaccagtacatctacatgggggagcccctggagaacgacgaggactgcgcccactggaaggaggcgaagatgctgctcgacaacatcaacacccccgagggcatcatcccgtccatgttcgagcccgagcgggagaaggtggacgccatcgacggcgagtaccgcctgcgcggggaggcccgcaagacgttcgtggacctgatgcggcgcggcgacctccccgtctggctggcctaccgggtggccgcggaggggatcaactacgccgaccgccggtggtgcttcgacggcgtcaagaacaaccagatcctggaggagaacgtggaggtggagatctggaccaaggagggggagcgcaagaagctcaagccgcggtggctggacgcccgcatctacagcgaccccctggccctcaaggagttcaaggagttcgccgcgggccggaagtccctgaccctgaacctcatcaccgagatgggccgcctgcccacgttcatgacccagaaggcccggaacgccctggacaacctcgccgtcctgcacaccgcggaggccgggggccgcgcctacaaccacgccctgagcgagctccccgagaccctggagacgctgctcctgctgaccctcctggccaccgtgaccgggggcatcttcctgttcctcatgtccggcaaggggatcggcaagatgaccctggggatgtgctgcatcatcacggcgagcatcctgctctggtacgcccagatccagccgcactggatcgccgcctccatcatcctggagttcttcctgatcgtgctcctgatccccgagcccgagaagcagcggacgccccaggacaaccagctgacctacgtcgtgatcgccatcctcaccgtggtcgcggccacgatggccaacgagatgggcttcctggagaagaccaagaaggacttcgggctgggcagcatcaccacccagcagccggacagcaacatcctcgacatcgacctgcgccccgcctccgcctggacgctgtacgcggtggccaccaccttcatcacccccatgctccggcacagcatcgagaactccagcgtgaacgtctccctgacggccatcgccaaccaggccaccgtgctgatgggcctcgggaagggctggcccctgagcaagatggacatcggggtgccgctgctcgcgatcggctgctactcccaggtcaaccccatcaccctgaccgccgccctgctcctgctggtggcccactacgcgatcatcgggcccggcctccaggccaaggccacgcgcgaggcccagaagcgggccgcggccggcatcatgaagatccccgccgccgacgggatcaccgtgatcgacctggacccgatcccctacgaccccaagttcgagaagcagctgggccaggtcatgctcctggtgctgtgcgtgacccaggtcctcatgatgcgcaccacgtgggccctgtgcgaggcgctgaccctcgccaccgggcccatcagcaccctgtgggagggcaacccggggcgcttctggaacacgaccatcgccgtgtccatggccaacatcttccggggcagctacctggccggcgcggggctcctgttctccatcatgaagaacaccgccaacacccgccggggcacggggaacaccggcgagaccctgggcgagaagtggaagaaccgcctcaacgccctgggcaagagcgagttccagatctacaagaagtccggcatccaggaggtggaccggaccctggccaaggaggggatcaagcgcggcgagacggaccaccacgcggtcagccgggggtccgccaagctccgctggttcgtggagcggaacctggtgacccccgagggcaaggtcgtggacctgggctgcgggcgcggcgggtggagctactactgcggcgggctcaagaacgtgaaggaggtcaagggcctgaccaagggcgggcccggccacgaggagcccatcccgatgtccacctacgggtggaacctggtgcggctccagagcggcgtggacgtcttcttcacgccgcccgagaagtgcgacaccctgctgtgcgacatcggggagtccagccccaacccgaccgtggaggccggccgcaccctccgggtgctgaacctggtcgagaactggctcaacaacaacacccagttctgcatcaaggtgctgaacccctacatgcccagcgtgatcgagaagatggaggccctgcagcgcaagtacggcggggccctggtccggaacccgctctcccgcaacagcacgcacgagatgtactgggtgtccaacgcgagcggcaacatcgtgtccagcgtcaacatgatctcccggatgctgatcaaccgcttcaccatgaagcacaagaaggccacctacgagcccgacgtggacctggggagcggcacccggaacatcgggatcgagtccgagacgcccaacctcgacatcatcggcaagcgcatcgagaagatcaagcaggagcacgagaccagctggcactacgaccaggaccacccctacaagacctgggcctaccacggctcctacgagaccaagcagacggggagcgcctccagcatggtgaacggcgtcgtgcgcctgctgaccaagccgtgggacgtgatccccatggtcacccagatggccatgaccgacacgacccccttcgggcagcagcgggtgttcaaggagaaggtggacacccgcacccaggagcccaaggagggcacgaagaagctcatgaagatcaccgcggagtggctgtggaaggagctgggcaagaagaagaccccgcggatgtgcacccgcgaggagttcacgcggaaggtccgctccaacgccgccctcggggccatcttcaccgacgagaacaagtggaagtccgcccgggaggcggtggaggactccggcttctgggagctggtcgacaaggagcgcaacctgcacctcgaggggaagtgcgagacctgcgtgtacaacatgatgggcaagcgggagaagaagctgggggagttcggcaaggccaagggcagccgcgccatctggtacatgtggctgggggcccggttcctcgagttcgaggcgctgggcttcctgaacgaggaccactggttctcccgcgagaacagcctcagcggggtggagggcgaggggctgcacaagctgggctacatcctccgggacgtctccaagaaggagggcggggccatgtacgccgacgacaccgccggctgggacacgcgcatcaccctggaggacctgaagaacgaggagatggtgaccaaccacatggagggggagcaccggaagctcgccgaggcgatcttccgcctgacctaccagaacaaggtggtccgggtgcagcgccccacgccccggggcaccgtgatggacatcatcagccgccgggaccagcgcgggtccggccaggtcgtgacctacggcctgaacaccttcacgaacatggaggcccagctcatccgccagatggagggggagggcgtgttcaagagcatccagcacctgaccgtcaccgaggagatcgccgtgaagaactggctggagcgggtggggcgcgagcggctctcccgcatggccatcagcggcgacgactgcgtcgtgaagcccctggacgaccggttcgcctccgcgctgaccgccctcaacgacatgggcaaggtgcgcaaggacatccagcagtgggagccgagccgggggtggaacgactggacgcaggtccccttctgctcccaccacttccacgagctgatcatgaaggacggccgcgtgctggtggtcccctgccggaaccaggacgagctcatcgggcgcgcccggatcagccagggcgccgggtggtccctgcgcgagaccgcctgcctgggcaagagctacgcgcagatgtggtccctcatgtacttccaccggcgcgacctgcggctggccgccaacgccatctgcagcgccgtgccctcccactgggtgccgaccagccgcaccacctggtccatccacgcgacgcacgagtggatgaccaccgaggacatgctcaccgtctggaaccgggtgtggatccaggagaacccctggatggaggacaagacgcccgtggagagctgggaggagatcccctacctgggcaagcgcgaggaccagtggtgcgggagcctgatcggcctcacctcccgggccacctgggccaagaacatccagaccgccatcaaccaggtccgcagcctgatcgggaacgaggagtacacggactacatgccgtccatgaagcgcttccggcgcgaggaggaggaggcgggcgtgctgtggtga

SEQ ID NO: 9061 - RNA, 9876 nt, synthetic construct
  misc_feature 1..9876: note = derived and/or modified CDS sequence (opt1) from DENV-2__KX380833__SS-prME
  source 1..9876: mol_type = other RNA
accgccgggatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcaccgtgatggcggccatcctggcctacaccatcggcaccacctacttccagcgggtgctgatcttcatcctcctgaccgccgtcgcgccctccatgaccatgcgctgcatcgggatcagcaaccgggacttcgtggagggcgtgtccggcgggagctgggtcgacatcgtgctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtctgcaagcacagcatggtggaccggggctggggcaacgggtgcggcctgttcgggaagggcgggatcgtgacgtgcgccatgttcacgtgcaagaagaacatggagggcaagatcgtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgccacgatggagtgcagcccccgcaccggcctggacttcaacgagatggtgctcctgcagatggagaacaaggcgtggctggtgcaccggcagtggttcctcgacctgcccctgccctggctcccgggcgccgacacccaggggtccaactggatccagaaggagaccctggtcacgttcaagaacccccacgccaagaagcaggacgtggtcgtgctgggcagccaggagggggccatgcacaccgccctcaccggcgcgaccgagatccagatgagctccgggaacctgctgttcacgggccacctcaagtgccgcctgcggatggacaagctgcagctcaagggcatgagctactccatgtgcaccgggaagttcaaggtggtcaaggagatcgccgagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcgtgggacttcgggagcctgggcggggtgttcacctccatcggcaaggccctgcaccaggtcttcggggccatctacggcgccgcgttcagcggcgtgtcctggaccatgaagatcctcatcggggtggtcatcacctggatcggcatgaacagccgctccacgagcctgtccgtgagcctggtgctggtcgggatcgtgaccctctacctgggcgtgatggtccaggccgactccgggtgcgtggtgagctggaagaacaaggagctgaagtgcggcagcggcatcttcatcaccgacaacgtccacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtgaagctgaccatcatgacgggggacatcaagggcatcatgcaggcggggaagcggagcctccgcccgcagcccaccgagctgaagtactcctggaaggcctggggcaaggccaagatgctgagcaccgagctccacaaccacaccttcctgatcgacggccccgagacggccgagtgcccgaacaccaaccgggcctggaactccctggaggtcgaggactacgggttcggcgtgttcaccaccaacatctggctcaagctgaaggagcgccaggacgtgttctgcgacagcaagctgatgtccgcggccatcaaggacaaccgggccgtccacgccgacatggggtactggatcgagagcgccctcaacgacacgtggaagatcgagaaggcgtccttcatcgaggtcaagagctgccactggcccaagtcccacaccctgtggagcaacggcgtgctggagtccgagatgatcatccccaagaacttcgccggccccgtgagccagcacaactaccgcccggggtaccacacccagaccgccggcccctggcacctcgggcggctggagatggacttcgacttctgcgagggcaccacggtggtggtcaccgaggactgcgggaaccgcggccccagcctgcggaccaccacggcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtgaccgcgggccacgggcagatcgacaacttcagcctcggcgtcctgggcatggccctgttcctcgaggagatgctgcgcacgcgggtggggaccaagcacgccatcctgctcgtggccgtctccttcgtgaccctgatcaccggcaacatgagcttccgcgacctggggcgcgtgatggtcatggtgggcgccacgatgaccgacgacatcgggatgggcgtgacctacctcgcgctgctggccgccttcaaggtccggcccaccttcgccgccggcctcctgctgcgcaagctcacgtccaaggagctgatgatgaccaccatcgggatcgtgctgctcagccagtccaccatccccgagacgatcctggagctgaccgacgcgctcgccctgggcatgatggtgctgaagatcgtccggaacatggagaagtaccagctcgccgtgaccatcatggccatcctgtgcgtcccgaacgccgtgatcctgcagaacgcgtggaaggtgagctgcaccatcctcgccgtcgtgtccgtgagccccctgctgctcacgtccagccagcagaaggccgactggatccccctggccctgaccatcaaggggctcaaccccaccgcgatcttcctgaccacgctgtcccgcaccagcaagaagcggtcctggccgctcaacgaggccatcatggccgtcggcatggtgagcatcctggcctccagcctgctcaagaacgacatccccatgaccggccccctggtggccgggggcctgctcaccgtctgctacgtgctgacggggcgcagcgcggacctggagctcgagcgggccgccgacgtgcgctgggaggagcaggccgagatctccggcagctcccccatcctgagcatcaccatctccgaggacgggagcatgtccatcaagaacgaggaggaggagcagaccctgaccatcctcatccggacgggcctgctggtcatcagcggcctcttcccggtgtccatccccatcaccgccgcggcctggtacctgtgggaggtgaagaagcagcgcgccggggtcctgtgggacgtgcccagcccgccgcccgtgggcaaggccgagctcgaggacggggcctaccggatcaagcagaagggcatcctggggtactcccagatcggcgcgggcgtctacaaggaggggaccttccacaccatgtggcacgtgacccgcggcgccgtgctgatgcacaaggggaagcggatcgagcccagctgggccgacgtcaagaaggacctcatctcctacggcgggggctggaagctggagggcgagtggaaggagggggaggaggtccaggtgctggccctcgagcccggcaagaacccccgcgccgtccagacgaagcccgggctgttcaagaccaacaccggcaccatcggggcggtgagcctggacttctcccccggcacgagcggctcccccatcgtggacaagaaggggaaggtcgtgggcctctacgggaacggcgtggtcacccggagcggcacctacgtgtccgccatcgcccagaccgagaagtccatcgaggacaaccccgagatcgaggacgacatcttccgcaagaagcggctgacgatcatggacctgcaccccggggccggcaagaccaagcgctacctgcccgcgatcgtgcgggaggccatcaagcgcgggctccggaccctgatcctggccccgacccgcgtcgtggccgccgagatggaggaggcgctccgcggcctgcccatccggtaccagacgcccgccatccgcgccgagcacaccgggcgggagatcgtggacctgatgtgccacgccaccttcaccatgcgcctcctgagccccatccgggtcccgaactacaacctgatcatcatggacgaggcccacttcacggaccccgcgtccatcgccgcccgcggctacatcagcacccgggtggagatgggcgaggccgccgggatcttcatgaccgcgacgccgcccggctcccgcgacccgttcccccagagcaacgcccccatcatggacgaggagcgggagatccccgagcgctcctggaacagcgggcacgagtgggtgacggacttcaagggcaagaccgtctggttcgtgccgtccatcaaggccgggaacgacatcgccgcgtgcctccggaagaacggcaagaaggtgatccagctgagccgcaagaccttcgactccgagtacatcaagacccggacgaacgactgggacttcgtcgtgaccaccgacatcagcgagatgggcgccaacttcaaggccgagcgcgtgatcgacccccggcgctgcatgaagcccgtcatcctgaccgacggggaggagcgggtgatcctcgccggccccatgccggtgacgcactccagcgccgcgcagcgccgggggcgcgtcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgccatcgacggcgagtaccgcctgcgcggggaggcccgcaagaccttcgtggacctgatgcggcgcggcgacctccccgtctggctggcgtaccgggtggccgccgaggggatcaactacgccgaccgccggtggtgcttcgacggcgtcaagaacaaccagatcctggaggagaacgtggaggtggagatctggaccaaggagggggagcgcaagaagctcaagccgcggtggctggacgcccgcatctacagcgaccccctggcgctcaaggagttcaaggagttcgccgccggccggaagtccctgacgctgaacctcatcaccgagatgggccgcctgcccaccttcatgacccagaaggcccggaacgcgctggacaacctcgccgtcctgcacacggccgaggccgggggccgcgcctacaaccacgcgctgagcgagctccccgagaccctggagaccctgctcctgctgaccctcctggccacggtgaccgggggcatcttcctgttcctcatgtccggcaaggggatcggcaagatgaccctggggatgtgctgcatcatcaccgccagcatcctgctctggtacgcccagatccagccgcactggatcgccgcgtccatcatcctggagttcttcctgatcgtgctcctgatccccgagcccgagaagcagcggacgccccaggacaaccagctgacgtacgtcgtgatcgccatcctcaccgtggtcgccgccaccatggccaacgagatgggcttcctggagaagaccaagaaggacttcgggctgggcagcatcacgacccagcagccggacagcaacatcctcgacatcgacctgcgccccgcgtccgcctggaccctgtacgccgtggccaccacgttcatcacccccatgctccggcacagcatcgagaactccagcgtgaacgtctccctgaccgccatcgcgaaccaggccaccgtgctgatgggcctcgggaagggctggcccctgagcaagatggacatcggggtgccgctgctcgccatcggctgctactcccaggtcaaccccatcacgctgaccgccgcgctgctcctgctggtggcccactacgccatcatcgggcccggcctccaggccaaggccacccgcgaggcgcagaagcgggccgccgccggcatcatgaagatccccgccgcggacgggatcaccgtgatcgacctggacccgatcccctacgaccccaagttcgagaagcagctgggccaggtcatgctcctggtgctgtgcgtgacgcaggtcctcatgatgcgcaccacctgggccctgtgcgaggccctgaccctcgccacggggcccatcagcaccctgtgggagggcaacccggggcgcttctggaacaccaccatcgccgtgtccatggcgaacatcttccggggcagctacctggccggcgccgggctcctgttctccatcatgaagaacacggccaacacccgccggggcaccgggaacaccggcgagacgctgggcgagaagtggaagaaccgcctcaacgcgctgggcaagagcgagttccagatctacaagaagtccggcatccaggaggtggaccggaccctggccaaggaggggatcaagcgcggcgagaccgaccaccacgccgtcagccgggggtccgccaagctccgctggttcgtggagcggaacctggtgacccccgagggcaaggtcgtggacctgggctgcgggcgcggcgggtggagctactactgcggcgggctcaagaacgtgaaggaggtcaagggcctgacgaagggcgggcccggccacgaggagcccatcccgatgtccacctacgggtggaacctggtgcggctccagagcggcgtggacgtcttcttcacgccgcccgagaagtgcgacaccctgctgtgcgacatcggggagtccagccccaacccgacggtggaggccggccgcaccctccgggtgctgaacctggtcgagaactggctcaacaacaacacccagttctgcatcaaggtgctgaacccctacatgcccagcgtgatcgagaagatggaggcgctgcagcgcaagtacggcggggccctggtccggaacccgctctcccgcaacagcacccacgagatgtactgggtgtccaacgccagcggcaacatcgtgtccagcgtcaacatgatctcccggatgctgatcaaccgcttcaccatgaagcacaagaaggccacgtacgagcccgacgtggacctggggagcggcacccggaacatcgggatcgagtccgagacccccaacctcgacatcatcggcaagcgcatcgagaagatcaagcaggagcacgagaccagctggcactacgaccaggaccacccctacaagacgtgggcctaccacggctcctacgagaccaagcagaccgggagcgcgtccagcatggtgaacggcgtcgtgcgcctgctgaccaagccgtgggacgtgatccccatggtcacgcagatggccatgaccgacaccacccccttcgggcagcagcgggtgttcaaggagaaggtggacacgcgcacccaggagcccaaggagggcaccaagaagctcatgaagatcaccgccgagtggctgtggaaggagctgggcaagaagaagacgccgcggatgtgcacccgcgaggagttcacccggaaggtccgctccaacgccgccctcggggcgatcttcaccgacgagaacaagtggaagtccgcccgggaggccgtggaggactccggcttctgggagctggtcgacaaggagcgcaacctgcacctcgaggggaagtgcgagacgtgcgtgtacaacatgatgggcaagcgggagaagaagctgggggagttcggcaaggccaagggcagccgcgcgatctggtacatgtggctgggggcccggttcctcgagttcgaggccctgggcttcctgaacgaggaccactggttctcccgcgagaacagcctcagcggggtggagggcgaggggctgcacaagctgggctacatcctccgggacgtctccaagaaggagggcggggccatgtacgccgacgacaccgcgggctgggacacccgcatcaccctggaggacctgaagaacgaggagatggtgacgaaccacatggagggggagcaccggaagctcgccgaggccatcttccgcctgacctaccagaacaaggtggtccgggtgcagcgccccacgccccggggcaccgtgatggacatcatcagccgccgggaccagcgcgggtccggccaggtcgtgacgtacggcctgaacaccttcaccaacatggaggcccagctcatccgccagatggagggggagggcgtgttcaagagcatccagcacctgaccgtcacggaggagatcgccgtgaagaactggctggagcgggtggggcgcgagcggctctcccgcatggcgatcagcggcgacgactgcgtcgtgaagcccctggacgaccggttcgcctccgccctgaccgccctcaacgacatgggcaaggtgcgcaaggacatccagcagtgggagccgagccgggggtggaacgactggacccaggtccccttctgctcccaccacttccacgagctgatcatgaaggacggccgcgtgctggtggtcccctgccggaaccaggacgagctcatcgggcgcgcccggatcagccagggcgcggggtggtccctgcgcgagaccgcctgcctgggcaagagctacgcccagatgtggtccctcatgtacttccaccggcgcgacctgcggctggccgccaacgcgatctgcagcgccgtgccctcccactgggtgccgatcagccgcacgacctggtccatccacgccacccacgagtggatgaccaccgaggacatgctcacggtctggaaccgggtgtggatccaggagaacccctggatggaggacaagacccccgtggagagctgggaggagatcccctacctgggcaagcgcgaggaccagtggtgcgggagcctgatcggcctcacctcccgggccacctgggcgaagaacatccagacggccatcaaccaggtccgcagcctgatcgggaacgaggagtacaccgactacatgccgtccatgaagcgcttccggcgcgaggaggaggaggccggcgtgctgtggtga

SEQ ID NO: 9062 - RNA, 9876 nt, synthetic construct
  misc_feature 1..9876: note = derived and/or modified CDS sequence (opt1) from DENV-2__KX380834__SS-prME
  source 1..9876: mol_type = other RNA
accgcggggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgagcagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggtccctgcgcccccagccgaccgagctgaagtacagctggaaggcgtggggcaaggccaagatgctctccaccgagctgcacaaccacacgttcctgatcgacggccccgagaccgccgagtgccccaacaccaaccgggcctggaacagcctcgaggtggaggactacgggttcggcgtcttcaccacgaacatctggctgaagctgaaggagcgccaggacgtgttctgcgactccaacctcatgagcgccgcgatcaaggacaaccgggccgtgcacgccgacatggggtactggatcgagtccgccctgaacgacacctggaagatcgagaaggccagcttcatcgaggtcaagtcctgccactggcccaagagccacaccctgtggtccaacggcgtgctcgagagcgagatgatcatccccaagaacttcgcgggccccgtgtcccagcacaactaccgccccgggtaccacacccagaccgccggcccgtggcacctggggcggctggagatggacttcgacttctgcgagggcacgaccgtcgtggtgaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtcaacagcctcgtgacggccggccacgggcagatcgacaacttctccctgggcgtgctgggcatggccctcttcctggaggagatgctgcgcacccgggtcgggaccaagcacgccatcctcctggtggccgtgagcttcgtcaccctgatcacgggcaacatgtccttccgcgacctcgggcgcgtgatggtgatggtcggcgccaccatgaccgacgacatcgggatgggcgtgacctacctggccctgctcgcggccttcaaggtgcggcccacgttcgccgccggcctgctgctccgcaagctgaccagcaaggagctgatgatgaccaccatcgggatcgtcctcctgtcccagagcacgatccccgagtccatcctggagctcaccgacgccctggcgctgggcatgatggtgctcaagatcgtccggaacatggagaagtaccagctggccgtgaccatcatggccatcctgtgcgtgcccaacgccgtcatcctccagaacgcctggaaggtgagctgcaccacgctggcggtggtctccgtgagcccgctgctcctgacctccagccagcagaaggccgactggatccccctggccctcaccatcaaggggctgaaccccaccgccatcttcctgacgaccctctcccgcaccagcaagaagcggtcctggcccctgaacgaggcgatcatggccgtgggcatggtcagcatcctggcctccagcctcctgaagaacgacatcccgatgaccggccccctggtggccgggggcctcctgacggtgtgctacgtcctgaccgggcgcagcgccgacctcgagctggagcgggcggccgacgtgcgctgggaggagcaggccgagatctccggcagctcccccatcctgagcatcaccatctccgaggacgggagcatgtccatcaagaacgaggaggaggagcagaccctcacgatcctgatccggaccggcctgctcgtgatcagcggcctgttccccgtctccatcccgatcaccgccgccgcgtggtacctgtgggaggtgaagaagcagcgcgccggggtgctctgggacgtcccctccccgccgcccgtgggcaaggccgagctggaggacggggcctaccggatcaagcagaagggcatcctggggtactcccagatcggcgccggcgtgtacaaggaggggaccttccacaccatgtggcacgtcacgcgcggcgcggtgctcatgcacaaggggaagcggatcgagcccagctgggccgacgtgaagaaggacctgatctcctacggcgggggctggaagctggagggcgagtggaaggagggggaggaggtccaggtgctcgccctggagcccggcaagaacccgcgcgccgtgcagaccaagcccgggctgttcaagaccaacaccggcacgatcggggccgtcagcctcgacttctcccccggcaccagcggctcccccatcgtggacaagaaggggaaggtggtcggcctgtacgggaacggcgtggtgacccggagcggcacctacgtctccgcgatcgcccagacggagaagtccatcgaggacaacccggagatcgaggacgacatcttccgcaagaagcggctgaccatcatggacctgcaccccggggccggcaagaccaagcgctacctccccgccatcgtgcgggaggcgatcaagcgcgggctgcggaccctgatcctcgcccccacgcgcgtggtcgccgccgagatggaggaggccctgcgcggcctgccgatccggtaccagacccccgcgatccgcgccgagcacaccgggcgggagatcgtggacctcatgtgccacgccaccttcacgatgcgcctgctgagccccatccgggtgcccaactacaacctcatcatcatggacgaggcccacttcaccgacccggcctccatcgcggcccgcggctacatcagcacccgggtcgagatgggcgaggccgccgggatcttcatgaccgccacgccgcccggctcccgcgaccccttcccgcagagcaacgcgcccatcatggacgaggagcgggagatccccgagcgctcctggaacagcgggcacgagtgggtgaccgacttcaagggcaagaccgtgtggttcgtcccctccatcaaggccgggaacgacatcgccgcctgcctgcggaagaacggcaagaaggtgatccagctgagccgcaagaccttcgactccgagtacatcaagacgcggaccaacgactgggacttcgtggtcaccaccgacatcagcgagatgggcgcgaacttcaaggccgagcgcgtgatcgacccgcggcgctgcatgaagcccgtgatcctcacggacggggaggagcgggtcatcctggccggccccatgcccgtgacccactccagcgccgcccagcgccgggggcgcgtgggccgcaacccgaagaacgagaacgaccagtacatctacatgggggagcccctggagaacgacgaggactgcgcgcactggaaggaggccaagatgctcctggacaacatcaacacccccgagggcatcatcccctccatgttcgagccggagcgggagaaggtcgacgccatcgacggcgagtaccgcctgcgcggggaggcccgcaagaccttcgtggacctcatgcggcgcggcgacctgcccgtctggctggcctaccgggtggcggccgaggggatcaactacgccgaccgccggtggtgcttcgacggcgtgaagaacaaccagatcctcgaggagaacgtcgaggtggagatctggacgaaggagggggagcgcaagaagctgaagccccggtggctggacgcccgcatctacagcgacccgctcgccctgaaggagttcaaggagttcgcggccggccggaagtccctgaccctcaacctgatcaccgagatgggccgcctgcccaccttcatgacgcagaaggccaagaacgccctcgacaacctggcggtgctgcacaccgccgaggccgggggccgggcctacaaccacgccctcagcgagctgcccgagaccctggagaccctcctgctgctcacgctgctggcgaccgtcaccgggggcatcttcctcttcctgatgtccggcaaggggatcggcaagatgaccctggggatgtgctgcatcatcaccgccagcatcctcctgtggtacgcccagatccagccccactggatcgccgcctccatcatcctggagttcttcctcatcgtgctgctgatcccggagcccgagaagcagcgcacgccccaggacaaccagctcacctacgtggtcatcgcgatcctgaccgtggtggccgccaccatggccaacgagatgggcttcctggagaagacgaagaaggacttcgggctcggcagcatcaccacccagcagcccgagagcaacatcctggacatcgacctgcggccggcctccgcgtggaccctctacgccgtcgccacgaccttcatcacccccatgctgcgccacagcatcgagaactccagcgtgaacgtgtccctgaccgccatcgccaaccaggcgacggtcctcatgggcctggggaagggctggcccctgagcaagatggacatcggggtgcccctcctggccatcggctgctactcccaggtgaacccgatcaccctgaccgccgccctcctgctgctcgtcgcgcactacgccatcatcgggcccggcctgcaggccaaggccacccgggaggcccagaagcgcgcggccgccggcatcatgaagaaccccacggtggacgggatgaccgtgatcgacctggaccccatcccgtacgaccccaagttcgagaagcagctcggccaggtcatgctgctggtgctctgcgtgacccaggtcctgatgatgcggaccacgtgggccctgtgcgaggccctcaccctggcgaccgggcccatcagcaccctgtgggagggcaaccccgggcgcttctggaacacgaccatcgccgtgtccatggccaacatcttccgcggcagctacctcgccggcgccgggctgctgttctccatcatgaagaacaccgcgaacacccggcgcggcacggggaacaccggcgagaccctcggcgagaagtggaagaaccggctgaacgccctgggcaagagcgagttccagatctacaagaagtccggcatccaggaggtggaccgcaccctcgccaaggaggggatcaagcggggcgagacggaccaccacgccgtcagccgcgggtccgcgaagctgcggtggttcgtggagcgcaacctggtgaccccggagggcaaggtcgtggacctcggctgcgggcggggcgggtggagctactactgcggcgggctgaagaacgtgaaggaggtcaagggcctgaccaagggcgggcccggccacgaggagcccatccccatgtccacctacgggtggaacctcgtgcgcctgcagagcggcgtggacgtcttcttcacgccgcccgagaagtgcgacaccctgctctgcgacatcggggagtccagccccaaccccaccgtggaggccggccggaccctgcgcgtgctgaacctcgtcgagaactggctgaacaacaacacccagttctgcatcaaggtgctgaacccgtacatgcccagcgtgatcgagaagatggaggccctgcagcggaagtacggcggggccctcgtccgcaaccccctgtcccggaacagcacgcacgagatgtactgggtgtccaacgccagcggcaacatcgtgtccagcgtcaacatgatctcccgcatgctgatcaaccggttcaccatgcgccacaagaaggcgacctacgagccggacgtggacctcgggagcggcacccggaacatcgggatcgagtccgagacgcccaacctggacatcatcggcaagcgcatcgagaagatcaagcaggagcacgagaccagctggcactacgaccaggaccacccctacaagacctgggcctaccacggctcctacgagaccaagcagacggggagcgcctccagcatggtgaacggcgtcgtgcgcctgctcaccaagccctgggacgtgatcccgatggtcacccagatggccatgaccgacacgacccccttcgggcagcagcgggtgttcaaggagaaggtcgacacccgcacccaggagcccaaggagggcacgaagaagctgatgaagatcaccgccgagtggctgtggaaggagctcggcaagaagaagacgccccggatgtgcacccgcgaggagttcacgcggaaggtgcgctccaacgcggccctgggggccatcttcaccgacgagaacaagtggaagtccgcccgggaggccgtggaggactccggcttctgggagctggtcgacaaggagcgcaacctccacctggaggggaagtgcgagacctgcgtgtacaacatgatgggcaagcgggagaagaagctgggggagttcggcaaggcgaagggcagccgcgccatctggtacatgtggctcggggcccggttcctggagttcgaggccctgggcttcctcaacgaggaccactggttctcccgcgagaacagcctgagcggggtggagggcgaggggctgcacaagctcggctacatcctgcgggacgtctccaagaaggagggcggggcgatgtacgccgacgacaccgccggctgggacacgcgcatcaccctggaggacctcaagaacgaggagatggtgaccaaccacatggagggggagcacaagaagctggccgaggccatcttcaagctgacctaccagaacaaggtggtccgggtgcagcgcccgacgccccggggcaccgtgatggacatcatcagccgccgggaccagcgcgggtccggccaggtcgtgacctacggcctcaacaccttcacgaacatggaggcgcagctgatccggcagatggagggggagggcgtgttcaagagcatccagcagctgaccgtcaaggaggagatcgccgtgaagaactggctcatccgcgtggggcgcgagcggctgtcccgcatggccatcagcggcgacgactgcgtcgtgaagcccctggacgaccggttcgcctccgccctcaccgcgctgaacgacatgggcaaggtgcgcaaggacatccagcagtgggagcccagccgggggtggaacgactggacccaggtcccgttctgctcccaccacttccacgagctgatcatgaaggacggccgcgtgctcgtggtcccctgccggaaccaggacgagctgatcgggcgcgcccggatcagccagggcgccgggtggtccctgcgcgagacggcctgcctcggcaagagctacgcccagatgtggtccctgatgtacttccaccggcgcgacctgcggctcgcggccaacgccatctgcagcgccgtgccctcccactggatccccaccagccgcaccacctggtccatccacgccacccacgagtggatgacgaccgaggacatgctgaccgtgtggaaccgggtctggatccaggagaacccgtggatggaggacaagacccccgtggagagctgggaggagatcccctacctgggcaagcgcgaggaccagtggtgcgggagcctcatcggcctgacgtcccgggcgacctgggccaagaacatccagaccgccatcaaccaggtgcgcagcctgatcgggaacgaggagtacaccgactacatgccctccatgaagcggttccgccgcgaggaggaggaggccggcgtcctctggtga

SEQ ID NO: 9063 - RNA, 9876 nt, synthetic construct
  misc_feature 1..9876: note = derived and/or modified CDS sequence (opt1) from DENV-2__KX380835__SS-prME
  source 1..9876: mol_type = other RNA
accgccgggatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcaccgtgatggcggccatcctggcctacaccatcggcaccacctacttccagcgggtgctgatcttcatcctcctgaccgccgtcgcgccctccatgaccatgcgctgcatcgggatcagcaaccgggacttcgtggagggcgtgtccggcgggagctgggtcgacatcgtgctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtctgcaagcacagcatggtggaccggggctggggcaacgggtgcggcctgttcgggaagggcgggatcgtgacgtgcgccatgttcacgtgcaagaagaacatggagggcaagatcgtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgccacgatggagtgcagcccccgcaccggcctggacttcaacgagatggtgctcctgcagatggagaacaaggcgtggctggtgcaccggcagtggttcctcgacctgcccctgccctggctcccgggcgccgacacccaggggtccaactggatccagaaggagaccctggtcacgttcaagaacccccacgccaagaagcaggacgtggtcgtgctgggcagccaggagggggccatgcacaccgccctcaccggcgcgaccgagatccagatgagctccgggaacctgctgttcacgggccacctcaagtgccgcctgcggatggacaagctgcagctcaagggcatgagctactccatgtgcaccgggaagttcaaggtggtcaaggagatcgccgagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcgtgggacttcgggagcctgggcggggtgttcacctccatcggcaaggccctgcaccaggtcttcggggccatctacggcgccgcgttcagcggcgtgtcctggaccatgaagatcctcatcggggtggtcatcacctggatcggcatgaacagccgctccacgagcctgtccgtgagcctggtgctggtcgggatcgtgaccctctacctgggcgtgatggtccaggccgactccgggtgcgtggtgagctggaagaacaaggagctgaagtgcggcagcggcatcttcatcaccgacaacgtccacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtgaagctgaccatcatgacgggggacatcaagggcatcatgcaggcggggaagcggagcctccgcccgcagcccaccgagctgaagtactcctggaaggcctggggcaaggccaagatgctgagcaccgagctccacaaccacaccttcctgatcgacggccccgagacggccgagtgcccgaacaccaaccgggcctggaactccctggaggtcgaggactacgggttcggcgtgttcaccaccaacatctggctcaagctgaaggagcgccaggacgtgttctgcgacagcaagctgatgtccgcggccatcaaggacaaccgggccgtccacgccgacatggggtactggatcgagagcgccctcaacgacacgtggaagatcgagaaggcgtccttcatcgaggtcaagagctgccactggcccaagtcccacaccctgtggagcaacggcgtgctggagtccgagatgatcatccccaagaacttcgccggccccgtgagccagcacaactaccgcccggggtaccacacccagaccgccggcccctggcacctcgggcggctggagatggacttcgacttctgcgagggcaccacggtggtggtcaccgaggactgcgggaaccgcggccccagcctgcggaccaccacggcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtgaccgcgggccacgggcagatcgacaacttcagcctcggcgtcctgggcatggccctgttcctcgaggagatgctgcgcacgcgggtggggaccaagcacgccatcctgctcgtggccgtctccttcgtgaccctgatcaccggcaacatgagcttccgcgacctggggcgcgtgatggtcatggtgggcgccacgatgaccgacgacatcgggatgggcgtgacctacctcgcgctgctggccgccttcaaggtccggcccaccttcgccgccggcctcctgctgcgcaagctcacgtccaaggagctgatgatgaccaccatcgggatcgtgctgctcagccagtccaccatccccgagacgatcctggagctgaccgacgcgctcgccctgggcatgatggtgctgaagatcgtccggaacatggagaagtaccagctcgccgtgaccatcatggccatcctgtgcgtcccgaacgccgtgatcctgcagaacgcgtggaaggtgagctgcaccatcctcgccgtcgtgtccgtgagccccctgctgctcacgtccagccagcagaaggccgactggatccccctggccctgaccatcaaggggctcaaccccaccgcgatcttcctgaccacgctgtcccgcaccagcaagaagcggtcctggccgctcaacgaggccatcatggccgtcggcatggtgagcatcctggcctccagcctgctcaagaacgacatccccatgaccggccccctggtggccgggggcctgctcaccgtctgctacgtgctgacggggcgcagcgcggacctggagctcgagcgggccgccgacgtgcgctgggaggagcaggccgagatctccggcagctcccccatcctgagcatcaccatctccgaggacgggagcatgtccatcaagaacgaggaggaggagcagaccctgaccatcctcatccggacgggcctgctggtcatcagcggcctcttcccggtgtccatccccatcaccgccgcggcctggtacctgtgggaggtgaagaagcagcgcgccggggtcctgtgggacgtgcccagcccgccgcccgtgggcaaggccgagctcgaggacggggcctaccggatcaagcagaagggcatcctggggtactcccagatcggcgcgggcgtctacaaggaggggaccttccacaccatgtggcacgtgacccgcggcgccgtgctgatgcacaaggggaagcggatcgagcccagctgggccgacgtcaagaaggacctcatctcctacggcgggggctggaagctggagggcgagtggaaggagggggaggaggtccaggtgctggccctcgagcccggcaagaacccccgcgccgtccagacgaagcccgggctgttcaagaccaacaccggcaccatcggggcggtgagcctggacttctcccccggcacgagcggctcccccatcgtggacaagaaggggaaggtcgtgggcctctacgggaacggcgtggtcacccggagcggcacctacgtgtccgccatcgcccagaccgagaagtccatcgaggacaaccccgagatcgaggacgacatcttccgcaagaagcggctgacgatcatggacctgcaccccggggccggcaagaccaagcgctacctgcccgcgatcgtgcgggaggccatcaagcgcgggctccggaccctgatcctggccccgacccgcgtcgtggccgccgagatggaggaggcgctccgcggcctgcccatccggtaccagacgcccgccatccgcgccgagcacaccgggcgggagatcgtggacctgatgtgccacgccaccttcaccatgcgcctcctgagccccatccgggtcccgaactacaacctgatcatcatggacgaggcccacttcacggaccccgcgtccatcgccgcccgcggctacatcagcacccgggtggagatgggcgaggccgccgggatcttcatgaccgcgacgccgcccggctcccgcgacccgttcccccagagcaacgcccccatcatggacgaggagcgggagatccccgagcgctcctggaacagcgggcacgagtgggtgacggacttcaagggcaagaccgtctggttcgtgccgtccatcaaggccgggaacgacatcgccgcgtgcctccggaagaacggcaagaaggtgatccagctgagccgcaagaccttcgactccgagtacatcaagacccggacgaacgactgggacttcgtcgtgaccaccgacatcagcgagatgggcgccaacttcaaggccgagcgcgtgatcgacccccggcgctgcatgaagcccgtcatcctgaccgacggggaggagcgggtgatcctcgccggccccatgccggtgacgcactccagcgccgcgcagcgccgggggcgcgtcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgccatcgacggcgagtaccgcctgcgcggggaggcccgcaagaccttcgtggacctgatgcggcgcggcgacctccccgtctggctggcgtaccgggtggccgccgaggggatcaactacgccgaccgccggtggtgcttcgacggcgtcaagaacaaccagatcctggaggagaacgtggaggtggagatctggaccaaggagggggagcgcaagaagctcaagccgcggtggctggacgcccgcatctacagcgaccccctggcgctcaaggagttcaaggagttcgccgccggccggaagtccctgacgctgaacctcatcaccgagatgggccgcctgcccaccttcatgacccagaaggcccggaacgcgctggacaacctcgccgtcctgcacacggccgaggccgggggccgcgcctacaaccacgcgctgagcgagctccccgagaccctggagaccctgctcctgctgaccctcctggccacggtgaccgggggcatcttcctgttcctcatgtccggcaaggggatcggcaagatgaccctggggatgtgctgcatcatcaccgccagcatcctgctctggtacgcccagatccagccgcactggatcgccgcgtccatcatcctggagttcttcctgatcgtgctcctgatccccgagcccgagaagcagcggacgccccaggacaaccagctgacgtacgtcgtgatcgccatcctcaccgtggtcgccgccaccatggccaacgagatgggcttcctggagaagaccaagaaggacttcgggctgggcagcatcacgacccagcagccggacagcaacatcctcgacatcgacctgcgccccgcgtccgcctggaccctgtacgccgtggccaccacgttcatcacccccatgctccggcacagcatcgagaactccagcgtgaacgtctccctgaccgccatcgcgaaccaggccaccgtgctgatgggcctcgggaagggctggcccctgagcaagatggacatcggggtgccgctgctcgccatcggctgctactcccaggtcaaccccatcacgctgaccgccgcgctgctcctgctggtggcccactacgccatcatcgggcccggcctccaggccaaggccacccgcgaggcgcagaagcgggccgccgccggcatcatgaagaaccccaccgtggacgggatgacggtcatcgacctggacccgatcccctacgaccccaagttcgagaagcagctgggccaggtgatgctcctggtgctgtgcgtcacccaggtgctcatgatgcgcaccacctgggccctgtgcgaggcgctgacgctcgccaccgggcccatcagcaccctgtgggagggcaacccggggcgcttctggaacaccacgatcgccgtgtccatggccaacatcttccggggcagctacctggccggcgcggggctcctgttctccatcatgaagaacaccgccaacacccgccggggcaccgggaacacgggcgagaccctgggcgagaagtggaagaaccgcctcaacgccctgggcaagagcgagttccagatctacaagaagtccggcatccaggaggtcgaccggaccctggccaaggaggggatcaagcgcggcgagaccgaccaccacgcggtgagccgggggtccgccaagctccgctggttcgtggagcggaacctggtcacgcccgagggcaaggtggtggacctgggctgcgggcgcggcgggtggagctactactgcggcgggctcaagaacgtcaaggaggtgaagggcctgaccaagggcgggcccggccacgaggagcccatcccgatgtccacctacgggtggaacctggtgcggctccagagcggcgtcgacgtgttcttcacgccgcccgagaagtgcgacacgctgctgtgcgacatcggggagtccagccccaacccgaccgtggaggccggccgcaccctccgggtcctgaacctggtggagaactggctcaacaacaacacccagttctgcatcaaggtgctgaacccctacatgcccagcgtcatcgagaagatggaggccctgcagcgcaagtacggcggggccctggtgcggaacccgctctcccgcaacagcacccacgagatgtactgggtgtccaacgcgagcggcaacatcgtctccagcgtgaacatgatctcccggatgctgatcaaccgcttcacgatgaagcacaagaaggccacctacgagcccgacgtggacctggggagcggcacccggaacatcgggatcgagtccgagacccccaacctcgacatcatcggcaagcgcatcgagaagatcaagcaggagcacgagacgagctggcactacgaccaggaccacccctacaagacctgggcctaccacggctcctacgagaccaagcagaccgggagcgcctccagcatggtcaacggcgtggtgcgcctgctgacgaagccgtgggacgtcatccccatggtgacccagatggccatgaccgacaccacgcccttcgggcagcagcgggtgttcaaggagaaggtcgacacccgcacccaggagcccaaggagggcaccaagaagctcatgaagatcacggcggagtggctgtggaaggagctgggcaagaagaagaccccgcggatgtgcacccgcgaggagttcacccggaaggtgcgctccaacgccgccctcggggccatcttcacggacgagaacaagtggaagtccgcccgggaggcggtcgaggactccggcttctgggagctggtggacaaggagcgcaacctgcacctcgaggggaagtgcgagacctgcgtgtacaacatgatgggcaagcgggagaagaagctgggggagttcggcaaggccaagggcagccgcgccatctggtacatgtggctgggggcccggttcctcgagttcgaggcgctgggcttcctgaacgaggaccactggttctcccgcgagaacagcctcagcggggtcgagggcgaggggctgcacaagctgggctacatcctccgggacgtgtccaagaaggagggcggggccatgtacgccgacgacaccgccggctgggacacccgcatcacgctggaggacctgaagaacgaggagatggtgaccaaccacatggagggggagcaccggaagctcgccgaggcgatcttccgcctgacctaccagaacaaggtcgtgcgggtgcagcgccccacgccccggggcacggtcatggacatcatcagccgccgggaccagcgcgggtccggccaggtggtgacctacggcctgaacaccttcaccaacatggaggcccagctcatccgccagatggagggggagggcgtcttcaagagcatccagcacctgacggtgaccgaggagatcgccgtgaagaactggctggagcgggtcgggcgcgagcggctctcccgcatggccatcagcggcgacgactgcgtggtgaagcccctggacgaccggttcgcctccgcgctgaccgccctcaacgacatgggcaaggtccgcaaggacatccagcagtgggagccgagccgggggtggaacgactggacccaggtgcccttctgctcccaccacttccacgagctgatcatgaaggacggccgcgtgctggtcgtgccctgccggaaccaggacgagctcatcgggcgcgcccggatcagccagggcgccgggtggtccctgcgcgagacggcctgcctgggcaagagctacgcgcagatgtggtccctcatgtacttccaccggcgcgacctgcggctggccgccaacgccatctgcagcgccgtgccctcccactgggtcccgatcagccgcaccacctggtccatccacgcgacccacgagtggatgaccacggaggacatgctcaccgtgtggaaccgggtgtggatccaggagaacccctggatggaggacaagacccccgtcgagagctgggaggagatcccctacctgggcaagcgcgaggaccagtggtgcgggagcctgatcggcctcacctcccgggccacgtgggccaagaacatccagaccgccatcaaccaggtgcgcagcctgatcgggaacgaggagtacaccgactacatgccgtccatgaagcgcttccggcgcgaggaggaggaggcgggcgtgctgtggtga

SEQ ID NO: 9064 - RNA, 9876 nt, synthetic construct
  misc_feature 1..9876: note = derived and/or modified CDS sequence (opt1) from DENV-2__KX380836__SS-prME
  source 1..9876: mol_type = other RNA
accgccgggatcatcatcatgatgatccccaccgtgatggccttccacctgaccacccgcaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcaccgtgatggcggccatcctggcctacaccatcggcaccacctacttccagcgggtgctgatcttcatcctcctgaccgccgtcgcgccctccatgaccatgcgctgcatcgggatcagcaaccgggacttcgtggagggcgtgtccggcgggagctgggtcgacatcgtgctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtctgcaagcacagcatggtggaccggggctggggcaacgggtgcggcctgttcgggaagggcgggatcgtgacgtgcgccatgttcacgtgcaagaagaacatggagggcaagatcgtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgccacgatggagtgcagcccccgcaccggcctggacttcaacgagatggtgctcctgcagatggagaacaaggcgtggctggtgcaccggcagtggttcctcgacctgcccctgccctggctcccgggcgccgacacccaggggtccaactggatccagaaggagaccctggtcacgttcaagaacccccacgccaagaagcaggacgtggtcgtgctgggcagccaggagggggccatgcacaccgccctcaccggcgcgaccgagatccagatgagctccgggaacctgctgttcacgggccacctcaagtgccgcctgcggatggacaagctgcagctcaagggcatgagctactccatgtgcaccgggaagttcaaggtggtcaaggagatcgccgagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcgtgggacttcgggagcctgggcggggtgttcacctccatcggcaaggccctgcaccaggtcttcggggccatctacggcgccgcgttcagcggcgtgtcctggaccatgaagatcctcatcggggtggtcatcacctggatcggcatgaacagccgctccacgagcctgtccgtgagcctggtgctggtcgggatcgtgaccctctacctgggcgtgatggtccaggccgactccgggtgcgtggtgagctggaagaacaaggagctgaagtgcggcagcggcatcttcatcaccgacaacgtccacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtgaagctgaccatcatgacgggggacatcaagggcatcatgcaggcggggaagcggagcctccgcccgcagcccaccgagctgaagtactcctggaaggcctggggcaaggccaagatgctgagcaccgagctccacaaccacaccttcctgatcgacggccccgagacggccgagtgcccgaacaccaaccgggcctggaactccctggaggtcgaggactacgggttcggcgtgttcaccaccaacatctggctcaagctgaaggagcgccaggacgtgttctgcgacagcaagctgatgtccgcggccatcaaggacaaccgggccgtccacgccgacatggggtactggatcgagagcgccctcaacgacacgtggaagatcgagaaggcgtccttcatcgaggtcaagagctgccactggcccaagtcccacaccctgtggagcaacggcgtgctggagtccgagatgatcatccccaagaacttcgccggccccgtgagccagcacaactaccgcccggggtaccacacccagaccgccggcccctggcacctcgggcggctggagatggacttcgacttctgcgagggcaccacggtggtggtcaccgaggactgcgggaaccgcggccccagcctgcggaccaccacggcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtgaccgcgggccacgggcagatcgacaacttcagcctcggcgtcctgggcatggccctgttcctcgaggagatgctgcgcacgcgggtggggaccaagcacgccatcctgctcgtggccgtctccttcgtgaccctgatcaccggcaacatgagcttccgcgacctggggcgcgtgatggtcatggtgggcgccacgatgaccgacgacatcgggatgggcgtgacctacctcgcgctgctggccgccttcaaggtccggcccaccttcgccgccggcctcctgctgcgcaagctcacgtccaaggagctgatgatgaccaccatcgggatcgtgctgctcagccagtccaccatccccgagacgatcctggagctgaccgacgcgctcgccctgggcatgatggtgctgaagatcgtccggaacatggagaagtaccagctcgccgtgaccatcatggccatcctgtgcgtcccgaacgccgtgatcctgcagaacgcgtggaaggtgagctgcaccatcctcgccgtcgtgtccgtgagccccctgctgctcacgtccagccagcagaaggccgactggatccccctggccctgaccatcaaggggctcaaccccaccgcgatcttcctgaccacgctgtcccgcaccagcaagaagcggtcctggccgctcaacgaggccatcatggccgtcggcatggtgagcatcctggcctccagcctgctcaagaacgacatccccatgaccggccccctggtggccgggggcctgctcaccgtctgctacgtgctgacggggcgcagcgcggacctggagctcgagcgggccgccgacgtgcgctgggaggagcaggccgagatctccggcagctcccccatcctgagcatcaccatctccgaggacgggagcatgtccatcaagaacgaggaggaggagcagaccctgaccatcctcatccggacgggcctgctggtcatcagcggcctcttcccggtgtccatccccatcaccgccgcggcctggtacctgtgggaggtgaagaagcagcgcgccggggtcctgtgggacgtgcccagcccgccgcccgtgggcaaggccgagctcgaggacggggcctaccggatcaagcagaagggcatcctggggtactcccagatcggcgcgggcgtctacaaggaggggaccttccacaccatgtggcacgtgacccgcggcgccgtgctgatgcacaaggggaagcggatcgagcccagctgggccgacgtcaagaaggacctcatctcctacggcgggggctggaagctggagggcgagtggaaggagggggaggaggtccaggtgctggccctcgagcccggcaagaacccccgcgccgtccagacgaagcccgggctgttcaagaccaacaccggcaccatcggggcggtgagcctggacttctcccccggcacgagcggctcccccatcgtggacaagaaggggaaggtcgtgggcctctacgggaacggcgtggtcacccggagcggcacctacgtgtccgccatcgcccagaccgagaagtccatcgaggacaaccccgagatcgaggacgacatcttccgcaagaagcggctgacgatcatggacctgcaccccggggccggcaagaccaagcgctacctgcccgcgatcgtgcgggaggccatcaagcgcgggctccggaccctgatcctggccccgacccgcgtcgtggccgccgagatggaggaggcgctccgcggcctgcccatccggtaccagacgcccgccatccgcgccgagcacaccgggcgggagatcgtggacctgatgtgccacgccaccttcaccatgcgcctcctgagccccatccgggtcccgaactacaacctgatcatcatggacgaggcccacttcacggaccccgcgtccatcgccgcccgcggctacatcagcacccgggtggagatgggcgaggccgccgggatcttcatgaccgcgacgccgcccggctcccgcgacccgttcccccagagcaacgcccccatcatggacgaggagcgggagatccccgagcgctcctggaacagcgggcacgagtgggtgacggacttcaagggcaagaccgtctggttcgtgccgtccatcaaggccgggaacgacatcgccgcgtgcctccggaagaacggcaagaaggtgatccagctgagccgcaagaccttcgactccgagtacatcaagacccggacgaacgactgggacttcgtcgtgaccaccgacatcagcgagatgggcgccaacttcaaggccgagcgcgtgatcgacccccggcgctgcatgaagcccgtcatcctgaccgacggggaggagcgggtgatcctcgccggccccatgccggtgacgcactccagcgccgcgcagcgccgggggcgcgtcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgccatcgacggcgagtaccgcctgcgcggggaggcccgcaagaccttcgtggacctgatgcggcgcggcgacctccccgtctggctggcgtaccgggtggccgccgaggggatcaactacgccgaccgccggtggtgcttcgacggcgtcaagaacaaccagatcctggaggagaacgtggaggtggagatctggaccaaggagggggagcgcaagaagctcaagccgcggtggctggacgcccgcatctacagcgaccccctggcgctcaaggagttcaaggagttcgccgccggccggaagtccctgacgctgaacctcatcaccgagatgggccgcctgcccaccttcatgacccagaaggccaagaacgcgctggacaacctcgccgtcctgcacacggccgaggccgggggccgggcctacaaccacgcgctgagcgagctccccgagaccctggagaccctgctcctgctgaccctcctggccacggtgaccgggggcatcttcctgttcctcatgtccggcaaggggatcggcaagatgaccctggggatgtgctgcatcatcaccgccagcatcctgctctggtacgcccagatccagccgcactggatcgccgcgtccatcatcctggagttcttcctgatcgtgctcctgatccccgagcccgagaagcagcgcacgccccaggacaaccagctgacgtacgtcgtgatcgccatcctcaccgtggtcgccgccaccatggccaacgagatgggcttcctggagaagaccaagaaggacttcgggctgggcagcatcacgacccagcagccggagagcaacatcctcgacatcgacctgcggcccgcgtccgcctggaccctgtacgccgtggccaccacgttcatcacccccatgctccgccacagcatcgagaactccagcgtgaacgtctccctgaccgccatcgcgaaccaggccaccgtgctgatgggcctcgggaagggctggcccctgagcaagatggacatcggggtgccgctgctcgccatcggctgctactcccaggtcaaccccatcacgctgaccgccgcgctgctcctgctggtggcccactacgccatcatcgggcccggcctccaggccaaggccacccgggaggcgcagaagcgcgccgccgccggcatcatgaagaaccccaccgtggacgggatgacggtcatcgacctggacccgatcccctacgaccccaagttcgagaagcagctgggccaggtgatgctcctggtgctgtgcgtcacccaggtgctcatgatgcggaccacctgggccctgtgcgaggcgctgacgctcgccaccgggcccatcagcaccctgtgggagggcaacccggggcgcttctggaacaccacgatcgccgtgtccatggccaacatcttccgcggcagctacctggccggcgcggggctcctgttctccatcatgaagaacaccgccaacacccggcgcggcaccgggaacacgggcgagaccctgggcgagaagtggaagaaccggctcaacgccctgggcaagagcgagttccagatctacaagaagtccggcatccaggaggtcgaccgcaccctggccaaggaggggatcaagcggggcgagaccgaccaccacgcggtgagccgcgggtccgccaagctccggtggttcgtggagcgcaacctggtcacgcccgagggcaaggtggtggacctgggctgcgggcggggcgggtggagctactactgcggcgggctcaagaacgtcaaggaggtgaagggcctgaccaagggcgggcccggccacgaggagcccatcccgatgtccacctacgggtggaacctggtgcgcctccagagcggcgtcgacgtgttcttcacgccgcccgagaagtgcgacacgctgctgtgcgacatcggggagtccagccccaacccgaccgtggaggccggccggaccctccgcgtcctgaacctggtggagaactggctcaacaacaacacccagttctgcatcaaggtgctgaacccctacatgcccagcgtcatcgagaagatggaggccctgcagcggaagtacggcggggccctggtgcgcaacccgctctcccggaacagcacccacgagatgtactgggtgtccaacgcgagcggcaacatcgtctccagcgtgaacatgatctcccgcatgctgatcaaccggttcacgatgaagcacaagaaggccacctacgagcccgacgtggacctggggagcggcacccgcaacatcgggatcgagtccgagacccccaacctcgacatcatcggcaagcggatcgagaagatcaagcaggagcacgagacgagctggcactacgaccaggaccacccctacaagacctgggcctaccacggctcctacgagaccaagcagaccgggagcgcctccagcatggtcaacggcgtggtgcgcctgctgacgaagccgtgggacgtcatccccatggtgacccagatggccatgaccgacaccacgcccttcgggcagcagcgcgtgttcaaggagaaggtcgacacccggacccaggagcccaaggagggcaccaagaagctcatgaagatcacggcggagtggctgtggaaggagctgggcaagaagaagaccccgcgcatgtgcacccgggaggagttcacccgcaaggtgcggtccaacgccgccctcggggccatcttcacggacgagaacaagtggaagtccgcccgcgaggcggtcgaggactccggcttctgggagctggtggacaaggagcggaacctgcacctcgaggggaagtgcgagacctgcgtgtacaacatgatgggcaagcgcgagaagaagctgggggagttcggcaaggccaagggcagccgggccatctggtacatgtggctgggggcccgcttcctcgagttcgaggcgctgggcttcctgaacgaggaccactggttctcccgggagaacagcctcagcggggtcgagggcgaggggctgcacaagctgggctacatcctccgcgacgtgtccaagaaggagggcggggccatgtacgccgacgacaccgccggctgggacacccggatcacgctggaggacctgaagaacgaggagatggtgaccaaccacatggagggggagcaccgcaagctcgccgaggcgatcttccggctgacctaccagaacaaggtcgtgcgcgtgcagcggcccacgccccggggcacggtcatggacatcatcagccggcgcgaccagcgggggtccggccaggtggtgacctacggcctgaacaccttcaccaacatggaggcccagctcatccgccagatggagggggagggcgtcttcaagagcatccagcacctgacggtgaccgaggagatcgccgtgaagaactggctggagcgcgtcgggcgggagcgcctctcccggatggccatcagcggcgacgactgcgtggtgaagcccctggacgaccgcttcgcctccgcgctgaccgccctcaacgacatgggcaaggtccggaaggacatccagcagtgggagccgagccgcgggtggaacgactggacccaggtgcccttctgctcccaccacttccacgagctgatcatgaaggacggccgggtgctggtcgtgccctgccgcaaccaggacgagctcatcgggcgggcccgcatcagccagggcgccgggtggtccctgcgggagacggcctgcctgggcaagagctacgcgcagatgtggtccctcatgtacttccaccgccgggacctgcgcctggccgccaacgccatctgcagcgccgtgccctcccactgggtcccgatcagccggaccacctggtccatccacgcgacccacgagtggatgaccacggaggacatgctcaccgtgtggaaccgcgtgtggatccaggagaacccctggatggaggacaagacccccgtcgagagctgggaggagatcccctacctgggcaagcgggaggaccagtggtgcgggagcctgatcggcctcacctcccgcgccacgtgggccaagaacatccagaccgccatcaaccaggtgcggagcctgatcgggaacgaggagtacaccgactacatgccgtccatgaagcgcttccgccgggaggaggaggaggcgggcgtgctgtggtga

SEQ ID NO: 9065 - RNA, 9876 nt, synthetic construct
  misc_feature 1..9876: note = derived and/or modified CDS sequence (opt1) from DENV-2__KX380838__SS-prME
  source 1..9876: mol_type = other RNA
accgccgggatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcacggtgatggcggccatcctggcctacaccatcggcaccacctacttccagcgggtgctgatcttcatcctcctgacggccgtcgcgccctccatgaccatgcgctgcatcgggatcagcaaccgggacttcgtggagggcgtgtccggcgggagctgggtcgacatcgtgctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtctgcaagcacagcatggtggaccggggctggggcaacgggtgcggcctgttcgggaagggcgggatcgtgacgtgcgccatgttcacgtgcaagaagaacatggagggcaagatcgtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgccacgatggagtgcagcccccgcaccggcctggacttcaacgagatggtgctcctgcagatggagaacaaggcgtggctggtgcaccggcagtggttcctcgacctgcccctgccctggctcccgggcgccgacacccaggggtccaactggatccagaaggagaccctggtcacgttcaagaacccccacgccaagaagcaggacgtggtcgtgctgggcagccaggagggggccatgcacaccgccctcaccggcgcgaccgagatccagatgagctccgggaacctgctgttcacgggccacctcaagtgccgcctgcggatggacaagctgcagctcaagggcatgagctactccatgtgcaccgggaagttcaaggtggtcaaggagatcgccgagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcgtgggacttcgggagcctgggcggggtgttcacctccatcggcaaggccctgcaccaggtcttcggggccatctacggcgccgcgttcagcggcgtgtcctggaccatgaagatcctcatcggggtggtcatcacctggatcggcatgaacagccgctccacgagcctgtccgtgagcctggtgctggtcgggatcgtgaccctctacctgggcgtgatggtccaggccgactccgggtgcgtggtgagctggaagaacaaggagctgaagtgcggcagcggcatcttcatcaccgacaacgtccacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtgaagctgaccatcatgacgggggacatcaagggcatcatgcaggcggggaagcggagcctccgcccgcagcccaccgagctgaagtactcctggaaggcctggggcaaggccaagatgctgagcaccgagctccacaaccacaccttcctgatcgacggccccgagacggccgagtgcccgaacaccaaccgggcctggaactccctggaggtcgaggactacgggttcggcgtgttcaccaccaacatctggctcaagctgaaggagcgccaggacgtgttctgcgacagcaagctgatgtccgcggccatcaaggacaaccgggccgtccacgccgacatggggtactggatcgagagcgccctcaacgacacgtggaagatcgagaaggcgtccttcatcgaggtcaagagctgccactggcccaagtcccacaccctgtggagcaacggcgtgctggagtccgagatgatcatccccaagaacttcgccggccccgtgagccagcacaactaccgcccggggtaccacacccagaccgccggcccctggcacctcgggcggctggagatggacttcgacttctgcgagggcaccacggtggtggtcaccgaggactgcgggaaccgcggccccagcctgcggaccaccacggcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtgaccgcgggccacgggcagatcgacaacttcagcctcggcgtcctgggcatggccctgttcctcgaggagatgctgcgcacgcgggtggggaccaagcacgccatcctgctcgtggccgtctccttcgtgaccctgatcaccggcaacatgagcttccgcgacctggggcgcgtgatggtcatggtgggcgccacgatgaccgacgacatcgggatgggcgtgacctacctcgcgctgctggccgccttcaaggtccggcccaccttcgccgccggcctcctgctgcgcaagctcacgtccaaggagctgatgatgaccaccatcgggatcgtgctgctcagccagtccaccatccccgagacgatcctggagctgaccgacgcgctcgccctgggcatgatggtgctgaagatcgtccggaacatggagaagtaccagctcgccgtgaccatcatggccaccctgtgcgtcccgaacgccgtgatcctgcagaacgcgtggaaggtgagctgcacgatcctcgccgtcgtgtccgtgagccccctgctgctcacctccagccagcagaaggccgactggatccccctggccctgaccatcaaggggctcaaccccaccgcgatcttcctgacgaccctgtcccgcaccagcaagaagcggtcctggccgctcaacgaggccatcatggccgtcggcatggtgagcatcctggcctccagcctgctcaagaacgacatccccatgaccggccccctggtggccgggggcctgctcacggtctgctacgtgctgaccgggcgcagcgcggacctggagctcgagcgggccgccgacgtgcgctgggaggagcaggccgagatctccggcagctcccccatcctgagcatcaccatctccgaggacgggagcatgtccatcaagaacgaggaggaggagcagaccctgacgatcctcatccggaccggcctgctggtcatcagcggcctcttcccggtgtccatccccatcaccgccgcggcctggtacctgtgggaggtgaagaagcagcgcgccggggtcctgtgggacgtgcccagcccgccgcccgtgggcaaggccgagctcgaggacggggcctaccggatcaagcagaagggcatcctggggtactcccagatcggcgcgggcgtctacaaggaggggaccttccacaccatgtggcacgtgacgcgcggcgccgtgctgatgcacaaggggaagcggatcgagcccagctgggccgacgtcaagaaggacctcatctcctacggcgggggctggaagctggagggcgagtggaaggagggggaggaggtccaggtgctggccctcgagcccggcaagaacccccgcgccgtccagaccaagcccgggctgttcaagaccaacaccggcacgatcggggcggtgagcctggacttctcccccggcaccagcggctcccccatcgtggacaagaaggggaaggtcgtgggcctctacgggaacggcgtggtcacccggagcggcacctacgtgtccgccatcgcccagacggagaagtccatcgaggacaaccccgagatcgaggacgacatcttccgcaagaagcggctgaccatcatggacctgcaccccggggccggcaagaccaagcgctacctgcccgcgatcgtgcgggaggccatcaagcgcgggctccggaccctgatcctggccccgacgcgcgtcgtggccgccgagatggaggaggcgctccgcggcctgcccatccggtaccagacccccgccatccgcgccgagcacaccgggcgggagatcgtggacctgatgtgccacgccaccttcacgatgcgcctcctgagccccatccgggtcccgaactacaacctgatcatcatggacgaggcccacttcaccgaccccgcgtccatcgccgcccgcggctacatcagcacccgggtggagatgggcgaggccgccgggatcttcatgaccgcgacgccgcccggctcccgcgacccgttcccccagagcaacgcccccatcatggacgaggagcgggagatccccgagcgctcctggaacagcgggcacgagtgggtgaccgacttcaagggcaagaccgtctggttcgtgccgtccatcaaggccgggaacgacatcgccgcgtgcctccggaagaacggcaagaaggtgatccagctgagccgcaagaccttcgactccgagtacatcaagacgcggaccaacgactgggacttcgtcgtgaccaccgacatcagcgagatgggcgccaacttcaaggccgagcgcgtgatcgacccccggcgctgcatgaagcccgtcatcctgacggacggggaggagcgggtgatcctcgccggccccatgccggtgacccactccagcgccgcgcagcgccgggggcgcgtcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgccatcgacggcgagtaccgcctgcgcggggaggcccgcaagaccttcgtggacctgatgcggcgcggcgacctccccgtctggctggcgtaccgggtggccgccgaggggatcaactacgccgaccgccggtggtgcttcgacggcgtcaagaacaaccagatcctggaggagaacgtggaggtggagatctggacgaaggagggggagcgcaagaagctcaagccgcggtggctggacgcccgcatctacagcgaccccctggcgctcaaggagttcaaggagttcgccgccggccggaagtccctgaccctgaacctcatcaccgagatgggccgcctgcccaccttcatgacgcagaaggcccggaacgcgctggacaacctcgccgtcctgcacaccgccgaggccgggggccgcgcctacaaccacgcgctgagcgagctccccgagaccctggagaccctgctcctgctgacgctcctggccaccgtgaccgggggcatcttcctgttcctcatgtccggcaaggggatcggcaagatgaccctggggatgtgctgcatcatcaccgccagcatcctgctctggtacgcccagatccagccgcactggatcgccgcgtccatcatcctggagttcttcctgatcgtgctcctgatccccgagcccgagaagcagcggacgccccaggacaaccagctgacctacgtcgtgatcgccatcctcaccgtggtcgccgccaccatggccaacgagatgggcttcctggagaagacgaagaaggacttcgggctgggcagcatcaccacccagcagccggacagcaacatcctcgacatcgacctgcgccccgcgtccgcctggaccctgtacgccgtggccacgaccttcatcacccccatgctccggcacagcatcgagaactccagcgtgaacgtctccctgaccgccatcgcgaaccaggccacggtgctgatgggcctcgggaagggctggcccctgagcaagatggacatcggggtgccgctgctcgccatcggctgctactcccaggtcaaccccatcaccctgaccgccgcgctgctcctgctggtggcccactacgccatcatcgggcccggcctccaggccaaggccacccgcgaggcgcagaagcgggccgccgccggcatcatgaagatccccgccgcggacgggatcacggtgatcgacctggacccgatcccctacgaccccaagttcgagaagcagctgggccaggtcatgctcctggtgctgtgcgtgacccaggtcctcatgatgcgcaccacctgggccctgtgcgaggccctgacgctcgccaccgggcccatcagcaccctgtgggagggcaacccggggcgcttctggaacaccacgatcgccgtgtccatggcgaacatcttccggggcagctacctggccggcgccgggctcctgttctccatcatgaagaacaccgccaacacccgccggggcaccgggaacacgggcgagaccctgggcgagaagtggaagaaccgcctcaacgcgctgggcaagagcgagttccagatctacaagaagtccggcatccaggaggtggaccggaccctggccaaggaggggatcaagcgcggcgagaccgaccaccacgccgtcagccgggggtccgccaagctccgctggttcgtggagcggaacctggtgacgcccgagggcaaggtcgtggacctgggctgcgggcgcggcgggtggagctactactgcggcgggctcaagaacgtgaaggaggtcaagggcctgaccaagggcgggcccggccacgaggagcccatcccgatgtccacctacgggtggaacctggtgcggctccagagcggcgtggacgtcttcttcacgccgcccgagaagtgcgacacgctgctgtgcgacatcggggagtccagccccaacccgaccgtggaggccggccgcaccctccgggtgctgaacctggtcgagaactggctcaacaacaacacccagttctgcatcaaggtgctgaacccctacatgcccagcgtgatcgagaagatggaggcgctgcagcgcaagtacggcggggccctggtccggaacccgctctcccgcaacagcacccacgagatgtactgggtgtccaacgccagcggcaacatcgtgtccagcgtcaacatgatctcccggatgctgatcaaccgcttcacgatgaagcacaagaaggccacctacgagcccgacgtggacctggggagcggcacccggaacatcgggatcgagtccgagacccccaacctcgacatcatcggcaagcgcatcgagaagatcaagcaggagcacgagacgagctggcactacgaccaggaccacccctacaagacctgggcctaccacggctcctacgagaccaagcagaccgggagcgcgtccagcatggtgaacggcgtcgtgcgcctgctgacgaagccgtgggacgtgatccccatggtcacccagatggccatgaccgacaccacgcccttcgggcagcagcgggtgttcaaggagaaggtggacacccgcacccaggagcccaaggagggcaccaagaagctcatgaagatcacggccgagtggctgtggaaggagctgggcaagaagaagaccccgcggatgtgcacccgcgaggagttcacccggaaggtccgctccaacgccgccctcggggcgatcttcacggacgagaacaagtggaagtccgcccgggaggccgtggaggactccggcttctgggagctggtcgacaaggagcgcaacctgcacctcgaggggaagtgcgagacctgcgtgtacaacatgatgggcaagcgggagaagaagctgggggagttcggcaaggccaagggcagccgcgcgatctggtacatgtggctgggggcccggttcctcgagttcgaggccctgggcttcctgaacgaggaccactggttctcccgcgagaacagcctcagcggggtggagggcgaggggctgcacaagctgggctacatcctccgggacgtctccaagaaggagggcggggccatgtacgccgacgacaccgcgggctgggacacccgcatcacgctggaggacctgaagaacgaggagatggtgaccaaccacatggagggggagcaccggaagctcgccgaggccatcttccgcctgacctaccagaacaaggtggtccgggtgcagcgccccacgccccggggcacggtgatggacatcatcagccgccgggaccagcgcgggtccggccaggtcgtgacctacggcctgaacaccttcaccaacatggaggcccagctcatccgccagatggagggggagggcgtgttcaagagcatccagcacctgacggtcaccgaggagatcgccgtgaagaactggctggagcgggtggggcgcgagcggctctcccgcatggcgatcagcggcgacgactgcgtcgtgaagcccctggacgaccggttcgcctccgccctgaccgccctcaacgacatgggcaaggtgcgcaaggacatccagcagtgggagccgagccgggggtggaacgactggacccaggtccccttctgctcccaccacttccacgagctgatcatgaaggacggccgcgtgctggtggtcccctgccggaaccaggacgagctcatcgggcgcgcccggatcagccagggcgcggggtggtccctgcgcgagacggcctgcctgggcaagagctacgcccagatgtggtccctcatgtacttccaccggcgcgacctgcggctggccgccaacgcgatctgcagcgccgtgccctcccactgggtgccgatcagccgcaccacctggtccatccacgccacccacgagtggatgaccacggaggacatgctcaccgtctggaaccgggtgtggatccaggagaacccctggatggaggacaagacccccgtggagagctgggaggagatcccctacctgggcaagcgcgaggaccagtggtgcgggagcctgatcggcctcacctcccgggccacgtgggcgaagaacatccagaccgccatcaaccaggtccgcagcctgatcgggaacgaggagtacaccgactacatgccgtccatgaagcgcttccggcgcgaggaggaggaggccggcgtgctgtggtga

SEQ ID NO: 9066 - RNA, 9876 nt, synthetic construct
  misc_feature 1..9876: note = derived and/or modified CDS sequence (opt1) from DENV-2__KM279515__SS-prME
  source 1..9876: mol_type = other RNA
accgccgggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgagcagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgccctcggccgcctgatcacggtgaaccccatcgtgaccgagaaggactccccggtcaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcgtgggacttcgggagcctgggcggggtgttcacctccatcggcaaggccctccaccaggtcttcggggccatctacggcgccgcgttcagcggcgtgtcctggaccatgaagatcctgatcggggtggtcatcacctggatcggcatgaacagccgctccacgagcctgtccgtgagcctggtgctcgtcggggtggtgaccctgtacctgggcgtcatggtgcaggccgactccgggtgcgtggtcagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtgacccgcctggagaacctcatgtggaagcagatcacccccgagctgaaccacatcctgaccgagaacgaggtcaagctcacgatcatgaccggggacatcaagggcatcatgcaggcggggaagcggtccctgcgcccccagccgaccgagctgaagtacagctggaaggcctggggcaaggccaagatgctctccaccgagctgcacaaccacacgttcctgatcgacggccccgagaccgccgagtgccccaacaccaaccgggcctggaacagcctcgaggtggaggactacgggttcggcgtgttcaccacgaacatctggctgaagctgaaggagcgccaggacgtcttctgcgactccaagctcatgagcgcggccatcaaggacaaccgggccgtgcacgccgacatggggtactggatcgagtccgccctgaacgacacctggaagatcgagaaggcgagcttcatcgaggtgaagtcctgccactggcccaagagccacaccctgtggtccaacggcgtcctcgagagcgagatgatcatccccaagaacttcgccggccccgtgtcccagcacaactaccgccccgggtaccacacccagaccgccggcccgtggcacctggggcggctggagatggacttcgacttctgcgagggcacgaccgtggtcgtgaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtgaacagcctcgtcacggcgggccacgggcagatcgacaacttctccctgggcgtgctgggcatggccctcttcctggaggagatgctgcgcacccgggtggggaccaagcacgccatcctcctggtcgccgtgagcttcgtgaccctgatcacgggcaacatgtccttccgcgacctcgggcgcgtcatggtgatggtgggcgccaccatgaccgacgacatcgggatgggcgtcacctacctggcgctgctcgccgccttcaaggtgcggcccacgttcgccgccggcctgctgctccgcaagctgaccagcaaggagctgatgatgaccaccatcgggatcgtgctcctgtcccagagcacgatccccgagtccatcctggagctcaccgacgcgctggccctgggcatgatggtcctcaagatcgtgcggaacatggagaagtaccagctggccgtcaccatcatggccatcctgtgcgtgcccaacgccgtgatcctccagaacgcgtggaaggtcagctgcaccacgctggccgtggtgtccgtcagcccgctgctcctgacctccagccagcagaaggccgactggatccccctggccctcaccatcaaggggctgaaccccaccgcgatcttcctgacgaccctctcccgcaccagcaagaagcggtcctggcccctgaacgaggccatcatggccgtgggcatggtgagcatcctggcctccagcctcctgaagaacgacatcccgatgaccggccccctggtcgccgggggcctcctgacggtgtgctacgtgctgaccgggcgcagcgcggacctcgagctggagcgggccgccgacgtccgctgggaggagcaggccgagatctccggcagctcccccatcctgagcatcaccatctccgaggacgggagcatgtccatcaagaacgaggaggaggagcagaccctcacgatcctgatccggaccggcctgctcgtgatcagcggcctgttccccgtgtccatcccgatcaccgccgcggcctggtacctgtgggaggtcaagaagcagcgcgccggggtgctctgggacgtgccctccccgccgcccgtcggcaaggccgagctggaggacggggcctaccggatcaagcagaagggcatcctggggtactcccagatcggcgcgggcgtgtacaaggaggggaccttccacaccatgtggcacgtgacgcgcggcgccgtcctcatgcacaaggggaagcggatcgagcccagctgggccgacgtgaagaaggacctgatctcctacggcgggggctggaagctggagggcgagtggaaggagggggaggaggtgcaggtcctcgccctggagcccggcaagaacccgcgcgccgtgcagaccaagcccgggctgttcaagaccaacaccggcacgatcggggcggtgagcctcgacttctcccccggcaccagcggctcccccatcgtcgacaagaaggggaaggtggtgggcctgtacgggaacggcgtcgtgacccggagcggcacctacgtgtccgccatcgcccagacggagaagtccatcgaggacaacccggagatcgaggacgacatcttccgcaagaagcggctgaccatcatggacctgcaccccggggccggcaagaccaagcgctacctccccgcgatcgtccgggaggccatcaagcgcgggctgcggaccctgatcctcgcccccacgcgcgtggtggccgccgagatggaggaggcgctgcgcggcctgccgatccggtaccagacccccgccatccgcgccgagcacaccgggcgggagatcgtcgacctcatgtgccacgccaccttcacgatgcgcctgctgagccccatccgggtgcccaactacaacctcatcatcatggacgaggcccacttcaccgacccggcgtccatcgccgcccgcggctacatcagcacccgggtggagatgggcgaggccgccgggatcttcatgaccgcgacgccgcccggctcccgcgaccccttcccgcagagcaacgcccccatcatggacgaggagcgggagatccccgagcgctcctggaacagcgggcacgagtgggtcaccgacttcaagggcaagaccgtgtggttcgtgccctccatcaaggccgggaacgacatcgccgcgtgcctgcggaagaacggcaagaaggtcatccagctgagccgcaagaccttcgactccgagtacatcaagacgcggaccaacgactgggacttcgtggtgaccaccgacatcagcgagatgggcgccaacttcaaggccgagcgcgtcatcgacccgcggcgctgcatgaagcccgtgatcctcacggacggggaggagcgggtgatcctggccggccccatgcccgtcacccactccagcgccgcgcagcgccgggggcgcgtgggccgcaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgggagaaggtggacgccatcgacggcgagtaccgcctgcgcggggaggcccgcaagaccttcgtcgacctcatgcggcgcggcgacctgcccgtgtggctggcgtaccgggtcgccgccgaggggatcaactacgccgaccgccggtggtgcttcgacggcgtgaagaacaaccagatcctcgaggagaacgtggaggtcgagatctggacgaaggagggggagcgcaagaagctgaagccccggtggctggacgcccgcatctacagcgacccgctcgcgctgaaggagttcaaggagttcgccgccggccggaagtccctgaccctcaacctgatcaccgagatgggccgcctgcccaccttcatgacgcagaaggccaagaacgcgctcgacaacctggccgtgctgcacaccgccgaggccgggggccgggcctacaaccacgcgctcagcgagctgcccgagaccctggagaccctcctgctgctcacgctgctggccaccgtgaccgggggcatcttcctcttcctgatgtccggcaaggggatcggcaagatgaccctggggatgtgctgcatcatcaccgccagcatcctcctgtggtacgcccagatccagccccactggatcgccgcgtccatcatcctggagttcttcctcatcgtcctgctgatcccggagcccgagaagcagcgcacgccccaggacaaccagctcacctacgtggtgatcgccatcctgaccgtcgtggccgccaccatggccaacgagatgggcttcctggagaagacgaagaaggacttcgggctcggcagcatcaccacccagcagcccgagagcaacatcctggacatcgacctgcggccggcgtccgcctggaccctctacgccgtggccacgaccttcatcacccccatgctgcgccacagcatcgagaactccagcgtcaacgtgtccctgaccgccatcgcgaaccaggccacggtgctcatgggcctggggaagggctggcccctgagcaagatggacatcggggtccccctcctggccatcggctgctactcccaggtgaacccgatcaccctgaccgccgcgctcctgctgctcgtggcccactacgccatcatcgggcccggcctgcaggccaaggccacccgggaggcgcagaagcgcgccgccgccggcatcatgaagaaccccacggtcgacgggatgaccgtgatcgacctggaccccatcccgtacgaccccaagttcgagaagcagctcggccaggtgatgctgctggtcctctgcgtgacccaggtgctgatgatgcggaccacgtgggccctgtgcgaggcgctcaccctggccaccgggcccatcagcaccctgtgggagggcaaccccgggcgcttctggaacacgaccatcgccgtctccatggccaacatcttccgcggcagctacctcgccggcgcggggctgctgttctccatcatgaagaacaccgccaacacccggcgcggcacggggaacaccggcgagaccctcggcgagaagtggaagaaccggctgaacgccctgggcaagagcgagttccagatctacaagaagtccggcatccaggaggtggaccgcaccctcgccaaggaggggatcaagcggggcgagacggaccaccacgcggtgagccgcgggtccgccaagctgcggtggttcgtcgagcgcaacctggtgaccccggagggcaaggtggtcgacctcggctgcgggcggggcgggtggagctactactgcggcgggctgaagaacgtgaaggaggtgaagggcctgaccaagggcgggcccggccacgaggagcccatccccatgtccacctacgggtggaacctcgtccgcctgcagagcggcgtggacgtgttcttcacgccgcccgagaagtgcgacaccctgctctgcgacatcggggagtccagccccaaccccaccgtcgaggccggccggaccctgcgcgtgctgaacctcgtggagaactggctgaacaacaacacccagttctgcatcaaggtcctgaacccgtacatgcccagcgtgatcgagaagatggaggccctgcagcggaagtacggcggggccctcgtgcgcaaccccctgtcccggaacagcacgcacgagatgtactgggtctccaacgcgagcggcaacatcgtgtccagcgtgaacatgatctcccgcatgctgatcaaccggttcaccatgcgccacaagaaggccacctacgagccggacgtcgacctcgggagcggcacccggaacatcgggatcgagtccgagacgcccaacctggacatcatcggcaagcgcatcgagaagatcaagcaggagcacgagaccagctggcactacgaccaggaccacccctacaagacctgggcctaccacggctcctacgagaccaagcagacggggagcgcctccagcatggtgaacggcgtggtccgcctgctcaccaagccctgggacgtgatcccgatggtgacccagatggccatgaccgacacgacccccttcgggcagcagcgggtcttcaaggagaaggtggacacccgcacccaggagcccaaggagggcacgaagaagctgatgaagatcaccgcggagtggctgtggaaggagctcggcaagaagaagacgccccggatgtgcacccgcgaggagttcacgcggaaggtccgctccaacgccgccctgggggccatcttcaccgacgagaacaagtggaagtccgcccgggaggcggtggaggactccggcttctgggagctggtggacaaggagcgcaacctccacctggaggggaagtgcgagacctgcgtctacaacatgatgggcaagcgggagaagaagctgggggagttcggcaaggccaagggcagccgcgccatctggtacatgtggctcggggcccggttcctggagttcgaggcgctgggcttcctcaacgaggaccactggttctcccgcgagaacagcctgagcggggtggagggcgaggggctgcacaagctcggctacatcctgcgggacgtgtccaagaaggagggcggggccatgtacgccgacgacaccgccggctgggacacgcgcatcaccctggaggacctcaagaacgaggagatggtcaccaaccacatggagggggagcacaagaagctggccgaggcgatcttcaagctgacctaccagaacaaggtggtgcgggtccagcgcccgacgccccggggcaccgtgatggacatcatcagccgccgggaccagcgcgggtccggccaggtggtcacctacggcctcaacaccttcacgaacatggaggcccagctgatccggcagatggagggggagggcgtgttcaagagcatccagcagctgaccgtgaaggaggagatcgccgtcaagaactggctcatccgcgtggggcgcgagcggctgtcccgcatggccatcagcggcgacgactgcgtggtcaagcccctggacgaccggttcgcctccgcgctcaccgccctgaacgacatgggcaaggtgcgcaaggacatccagcagtgggagcccagccgggggtggaacgactggacccaggtgccgttctgctcccaccacttccacgagctgatcatgaaggacggccgcgtcctcgtggtgccctgccggaaccaggacgagctgatcgggcgcgcccggatcagccagggcgccgggtggtccctgcgcgagacggcctgcctcggcaagagctacgcgcagatgtggtccctgatgtacttccaccggcgcgacctgcggctcgccgccaacgccatctgcagcgccgtcccctcccactggatccccaccagccgcaccacctggtccatccacgcgacccacgagtggatgacgaccgaggacatgctgaccgtgtggaaccgggtgtggatccaggagaacccgtggatggaggacaagacccccgtcgagacgtgggaggagatcccctacctgggcaagcgcgaggaccagtggtgcgggagcctcatcggcctgaccagccgggccacctgggccaagaacatccagaccgccatcaaccaggtgcgctccctgatcgggaacgaggagtacacggactacatgcccagcatgaagcggttccgccgcgaggaggaggaggcgggcgtgctctggtga

SEQ ID NO: 9067 - RNA, 9876 nt, synthetic construct
  misc_feature 1..9876: note = derived and/or modified CDS sequence (opt1) from DENV-2__KM279516__SS-prME
  source 1..9876: mol_type = other RNA
accgcgggcatcatcatcatgatgatccccaccgtgatggccttccacctgaccacccggaacggggagccccacatgatcgtcagccggcaggagaagggcaagtccctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggtccctgcgcccccagccgaccgagctgaagtacagctggaaggcgtggggcaaggccaagatgctctccaccgagctgcacaaccacacgttcctgatcgacggccccgagaccgccgagtgccccaacaccaaccgggcctggaacagcctcgaggtggaggactacgggttcggcgtcttcaccacgaacatctggctgaagctgaaggagcgccaggacgtgttctgcgactccaagctcatgagcgccgcgatcaaggacaaccgggccgtgcacgccgacatggggtactggatcgagtccgccctgaacgacacctggaagatcgagaaggccagcttcatcgaggtcaagtcctgccactggcccaagagccacaccctgtggtccaacggcgtgctcgagagcgagatgatcatccccaagaacttcgcgggccccgtgtcccagcacaactaccgccccgggtaccacacccagaccgccggcccgtggcacctggggcggctggagatggacttcgacttctgcgagggcacgaccgtcgtggtgaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtcaacagcctcgtgacggccggccacgggcagatcgacaacttctccctgggcgtgctgggcatggccctcttcctggaggagatgctgcgcacccgggtcgggaccaagcacgccatcctcctggtggccgtgagcttcgtcaccctgatcacgggcaacatgtccttccgcgacctcgggcgcgtgatggtgatggtcggcgccaccatgaccgacgacatcgggatgggcgtgacctacctggccctgctcgcggccttcaaggtgcggcccacgttcgccgccggcctgctgctccgcaagctgaccagcaaggagctgatgatgaccaccatcgggatcgtcctcctgtcccagagcacgatccccgagaacatcctggagctcaccgacgccctggcgctgggcatgatggtgctcaagatcgtccggaacatggagaagtaccagctggccgtgaccatcatggccatcctgtgcgtgcccaacgccgtcatcctccagaacgcctggaaggtgtcctgcaccacgctggcggtggtcagcgtgtccccgctgctcctgaccagctcccagcagaaggccgactggatccccctggccctcaccatcaaggggctgaaccccaccgccatcttcctgacgaccctcagccgcacctccaagaagcggagctggcccctgaacgaggcgatcatggccgtgggcatggtctccatcctggccagctccctcctgaagaacgacatcccgatgaccggccccctggtggccgggggcctcctgacggtgtgctacgtcctgaccgggcgcagcgccgacctcgagctggagcgggcggccgacgtgcgctgggaggagcaggccgagatcagcggctccagccccatcctgtccatcaccatcagcgaggacgggtccatgagcatcaagaacgaggaggaggagcagaccctcacgatcctgatccggaccggcctgctcgtgatctccggcctgttccccgtcagcatcccgatcaccgccgccgcgtggtacctgtgggaggtgaagaagcagcgcgccggggtgctctgggacgtccccagcccgccgcccgtgggcaaggccgagctggaggacggggcctaccggatcaagcagaagggcatcctggggtacagccagatcggcgccggcgtgtacaaggaggggaccttccacaccatgtggcacgtcacgcgcggcgcggtgctcatgcacaaggggaagcggatcgagccctcctgggccgacgtgaagaaggacctgatcagctacggcgggggctggaagctggagggcgagtggaaggagggggaggaggtccaggtgctcgccctggagcccggcaagaacccgcgcgccgtgcagaccaagcccgggctgttcaagaccaacaccggcacgatcggggccgtctccctcgacttcagccccggcacctccggcagccccatcgtggacaagaaggggaaggtggtcggcctgtacgggaacggcgtggtgacccggtccggcacctacgtcagcgcgatcgcccagacggagaagtccatcgaggacaacccggagatcgaggacgacatcttccgcaagaagcggctgaccatcatggacctgcaccccggggccggcaagaccaagcgctacctccccgccatcgtgcgggaggcgatcaagcgcgggctgcggaccctgatcctcgcccccacgcgcgtggtcgccgccgagatggaggaggccctgcgcggcctgccgatccggtaccagacccccgcgatccgcgccgagcacaccgggcgggagatcgtggacctcatgtgccacgccaccttcacgatgcgcctgctgagccccatccgggtgcccaactacaacctcatcatcatggacgaggcccacttcaccgacccggccagcatcgcggcccgcggctacatctccacccgggtcgagatgggcgaggccgccgggatcttcatgaccgccacgccgcccggcagccgcgaccccttcccgcagtccaacgcgcccatcatggacgaggagcgggagatccccgagcgcagctggaactccgggcacgagtgggtgaccgacttcaagggcaagaccgtgtggttcgtccccagcatcaaggccgggaacgacatcgccgcctgcctgcggaagaacggcaagaaggtgatccagctgtcccgcaagaccttcgacagcgagtacatcaagacgcggaccaacgactgggacttcgtggtcaccaccgacatctccgagatgggcgcgaacttcaaggccgagcgcgtgatcgacccgcggcgctgcatgaagcccgtgatcctcacggacggggaggagcgggtcatcctggccggccccatgcccgtgacccacagctccgccgcccagcgccgggggcgcgtgggccgcaacccgaagaacgagaacgaccagtacatctacatgggggagcccctggagaacgacgaggactgcgcgcactggaaggaggccaagatgctcctggacaacatcaacacccccgagggcatcatccccagcatgttcgagccggagcgggagaaggtcgacgccatcgacggcgagtaccgcctgcgcggggaggcccgcaagaccttcgtggacctcatgcggcgcggcgacctgcccgtctggctggcctaccgggtggcggccgaggggatcaactacgccgaccgccggtggtgcttcgacggcgtgaagaacaaccagatcctcgaggagaacgtcgaggtggagatctggacgaaggagggggagcgcaagaagctgaagccccggtggctggacgcccgcatctactccgacccgctcgccctgaaggagttcaaggagttcgcggccggccgcaagagcctgaccctcaacctgatcaccgagatgggccggctgcccaccttcatgacgcagaaggccaagaacgccctcgacaacctggcggtgctgcacaccgccgaggccgggggccgggcctacaaccacgccctctccgagctgcccgagaccctggagaccctcctgctgctcacgctgctggcgaccgtcaccgggggcatcttcctcttcctgatgagcggcaaggggatcggcaagatgaccctggggatgtgctgcatcatcaccgcctccatcctcctgtggtacgcccagatccagccccactggatcgccgccagcatcatcctggagttcttcctcatcgtgctgctgatcccggagcccgagaagcagcgcacgccccaggacaaccagctcacctacgtggtcatcgcgatcctgaccgtggtggccgccaccatggccaacgagatgggcttcctggagaagacgaagaaggacttcgggctcggctccatcaccacccagcagcccgagagcaacatcctggacatcgacctgcggccggccagcgcgtggaccctctacgccgtcgccacgaccttcatcacccccatgctgcgccactccatcgagaacagctccgtgaacgtgagcctgaccgccatcgccaaccaggcgacggtcctcatgggcctggggaagggctggcccctgtccaagatggacatcggggtgcccctcctggccatcggctgctacagccaggtgaacccgatcaccctgaccgccgccctcctgctgctcgtcgcgcactacgccatcatcgggcccggcctgcaggccaaggccacccgggaggcccagaagcgcgcggccgccggcatcatgaagaaccccacggtggacgggatgaccgtgatcgacctggaccccatcccgtacgaccccaagttcgagaagcagctcggccaggtcatgctgctggtgctctgcgtgacccaggtcctgatgatgcggaccacgtgggccctgtgcgaggccctcaccctggcgaccgggcccatctccaccctgtgggagggcaaccccgggcgcttctggaacacgaccatcgccgtgagcatggccaacatcttccgcggctcctacctcgccggcgccgggctgctgttcagcatcatgaagaacaccgcgaacacccggcgcggcacggggaacaccggcgagaccctcggcgagaagtggaagaaccggctgaacgccctggggaagtccgagttccagatctacaagaagtccggcatccaggaggtggaccgcaccctcgccaaggaggggatcaagcggggcgagacggaccaccacgccgtctcccgcgggagcgcgaagctgcggtggttcgtggagcgcaacctggtgaccccggagggcaaggtcgtggacctcggctgcgggcggggcgggtggtcctactactgcggcgggctgaagaacgtgaaggaggtcaagggcctgaccaagggcgggcccggccacgaggagcccatccccatgagcacctacgggtggaacctcgtgcgcctgcagtccggcgtggacgtcttcttcacgccgcccgagaagtgcgacaccctgctctgcgacatcggggagagctcccccaaccccaccgtggaggccggccggaccctgcgcgtgctgaacctcgtcgagaactggctgaacaacaacacccagttctgcatcaaggtgctgaacccgtacatgcccagcgtgatcgagaagatggaggccctgcagcggaagtacggcggggccctcgtccgcaaccccctgagccggaactccacgcacgagatgtactgggtgagcaacgcctccggcaacatcgtgagctccgtcaacatgatcagccgcatgctgatcaaccggttcaccatgcgccacaagaaggcgacctacgagccggacgtggacctcgggtccggcacccggaacatcgggatcgagagcgagacgcccaacctggacatcatcggcaagcgcatcgagaagatcaagcaggagcacgagacctcctggcactacgaccaggaccacccctacaagacctgggcctaccacggcagctacgagaccaagcagacggggtccgccagctccatggtgaacggcgtcgtgcgcctgctcaccaagccctgggacgtgatcccgatggtcacccagatggccatgaccgacacgacccccttcgggcagcagcgggtgttcaaggagaaggtcgacacccgcacccaggagcccaaggagggcacgaagaagctgatgaagatcaccgccgagtggctgtggaaggagctcggcaagaagaagacgccccggatgtgcacccgcgaggagttcacgcggaaggtgcgcagcaacgcggccctgggggccatcttcaccgacgagaacaagtggaagtccgcccgggaggccgtggaggacagcggcttctgggagctggtcgacaaggagcgcaacctccacctggaggggaagtgcgagacctgcgtgtacaacatgatgggcaagcgggagaagaagctgggggagttcggcaaggcgaagggctcccgcgccatctggtacatgtggctcggggcccggttcctggagttcgaggccctgggcttcctcaacgaggaccactggttcagccgcgagaactccctgagcggggtggagggcgaggggctgcacaagctcggctacatcctgcgggacgtcagcaagaaggagggcggggcgatgtacgccgacgacaccgccggctgggacacgcgcatcaccctggaggacctcaagaacgaggagatggtgaccaaccacatggagggggagcacaagaagctggccgaggccatcttcaagctgacctaccagaacaaggtggtccgggtgcagcgcccgacgccccggggcaccgtgatggacatcatctcccgccgggaccagcgcgggagcggccaggtcgtgacctacggcctcaacaccttcacgaacatggaggcgcagctgatccggcagatggagggggagggcgtgttcaagtccatccagcagctgaccgtcaaggaggagatcgccgtgaagaactggctcatccgcgtggggcgcgagcggctgagccgcatggccatctccggcgacgactgcgtcgtgaagcccctggacgaccggttcgccagcgccctcaccgcgctgaacgacatgggcaaggtgcgcaaggacatccagcagtgggagccctcccgggggtggaacgactggacccaggtcccgttctgcagccaccacttccacgagctgatcatgaaggacggccgcgtgctcgtggtcccctgccggaaccaggacgagctgatcgggcgcgcccggatctcccagggcgccgggtggagcctgcgcgagacggcctgcctcggcaagtcctacgcccagatgtggagcctgatgtacttccaccggcgcgacctgcggctcgcggccaacgccatctgctccgccgtgcccagccactggatccccacctcccgcaccacctggagcatccacgccacccacgagtggatgacgaccgaggacatgctgaccgtgtggaaccgggtctggatccaggagaacccgtggatggaggacaagacccccgtggagtcctgggaggagatcccctacctgggcaagcgcgaggaccagtggtgcgggagcctcatcggcctgacgagccgggcgacctgggccaagaacatccagaccgccatcaaccaggtgcgctccctgatcgggaacgaggagtacaccgactacatgcccagcatgaagcggttccgccgcgaggaggaggaggccggcgtcctctggtga

SEQ ID NO: 9068 - RNA, 9876 nt, synthetic construct
  misc_feature 1..9876: note = derived and/or modified CDS sequence (opt1) from DENV-2__KM279517__SS-prME
  source 1..9876: mol_type = other RNA
accgcgggcatcatcatcatgatgatccccaccgtgatggccttccacctgaccacccggaacggggagccccacatgatcgtctcccggcaggagaagggcaagtccctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagagcccgcccaagctggccagcgccatccagaaggcccacgaggaggggatctgcggcatccggtccgtcacccgcctggagaacctcatgtggaagcagatcacccccgagctgaaccacatcctgaccgagaacgaggtgaagctcacgatcatgaccggggacatcaagggcatcatgcaggccgggaagcggagcctgcgcccgcagcccaccgagctgaagtactcctggaaggcgtggggcaaggccaagatgctcagcaccgagctgcacaaccacacgttcctgatcgacggccccgagaccgccgagtgcccgaacaccaaccgggcctggaactccctcgaggtggaggactacgggttcggcgtcttcaccacgaacatctggctgaagctgaaggagcgccaggacgtgttctgcgacagcaagctcatgtccgccgcgatcaaggacaaccgggccgtgcacgccgacatggggtactggatcgagagcgccctgaacgacacctggaagatcgagaaggcctccttcatcgaggtcaagagctgccactggcccaagtcccacaccctgtggagcaacggcgtgctcgagtccgagatgatcatccccaagaacttcgcgggccccgtgagccagcacaactaccgcccggggtaccacacccagaccgccggcccctggcacctggggcggctggagatggacttcgacttctgcgagggcacgaccgtcgtggtgaccgaggactgcgggaaccgcggcccctccctccggaccacgaccgccagcggcaagctgatcaccgagtggtgctgccgcagctgcaccctgcccccgctccggtaccgcggggaggacggctgctggtacgggatggagatccggcccctgaaggagaaggaggagaacctggtcaactccctcgtgacggccggccacgggcagatcgacaacttcagcctgggcgtgctgggcatggccctcttcctggaggagatgctgcgcacccgggtcgggaccaagcacgccatcctcctggtggccgtgtccttcgtcaccctgatcacgggcaacatgagcttccgcgacctcgggcgcgtgatggtgatggtcggcgccaccatgaccgacgacatcgggatgggcgtgacctacctggccctgctcgcggccttcaaggtgcggcccacgttcgccgccggcctgctgctccgcaagctgacctccaaggagctgatgatgaccaccatcgggatcgtcctcctgagccagtccacgatccccgagagcatcctggagctcaccgacgccctggcgctgggcatgatggtgctcaagatcgtccggaacatggagaagtaccagctggccgtgaccatcatggccatcctgtgcgtgccgaacgccgtcatcctccagaacgcctggaaggtgtcctgcaccacgctggcggtggtcagcgtgagccccctgctcctgaccagctcccagcagaaggccgactggatccccctggccctcaccatcaaggggctgaaccccaccgccatcttcctgacgaccctcagccgcacctccaagaagcggagctggccgctgaacgaggcgatcatggccgtgggcatggtctccatcctggccagctccctcctgaagaacgacatccccatgaccggccccctggtggccgggggcctcctgacggtgtgctacgtcctgaccgggcgcagcgccgacctcgagctggagcgggcggccgacgtgcgctgggaggagcaggccgagatcagcggctccagccccatcctgtccatcaccatcagcgaggacgggtccatgagcatcaagaacgaggaggaggagcagaccctcacgatcctgatccggaccggcctgctcgtgatctccggcctgttcccggtcagcatccccatcaccgccgccgcgtggtacctgtgggaggtgaagaagcagcgcgccggggtgctctgggacgtccccagcccgccgcccgtgggcaaggccgagctggaggacggggcctaccggatcaagcagaagggcatcctggggtacagccagatcggcgccggcgtgtacaaggaggggaccttccacaccatgtggcacgtcacgcgcggcgcggtgctcatgcacaaggggaagcggatcgagccctcctgggccgacgtgaagaaggacctgatcagctacggcgggggctggaagctggagggcgagtggaaggagggggaggaggtccaggtgctcgccctggagcccggcaagaacccccgcgccgtgcagaccaagcccgggctgttcaagaccaacaccggcacgatcggggccgtctccctcgacttcagccccggcacctccggcagccccatcgtggacaagaaggggaaggtggtcggcctgtacgggaacggcgtggtgacccggtccggcacctacgtcagcgcgatcgcccagacggagaagtccatcgaggacaaccccgagatcgaggacgacatcttccgcaagaagcggctgaccatcatggacctgcaccccggggccggcaagaccaagcgctacctccccgccatcgtgcgggaggcgatcaagcgcgggctgcggaccctgatcctcgccccgacgcgcgtggtcgccgccgagatggaggaggccctgcgcggcctgcccatccggtaccagacccccgcgatccgcgccgagcacaccgggcgggagatcgtggacctcatgtgccacgccaccttcacgatgcgcctgctgagccccatccgggtgccgaactacaacctcatcatcatggacgaggcccacttcaccgaccccgccagcatcgcggcccgcggctacatctccacccgggtcgagatgggcgaggccgccgggatcttcatgaccgccacgccgcccggcagccgcgacccgttcccccagtccaacgcgcccatcatggacgaggagcgggagatccccgagcgcagctggaactccgggcacgagtgggtgaccgacttcaagggcaagaccgtgtggttcgtcccgagcatcaaggccgggaacgacatcgccgcctgcctgcggaagaacggcaagaaggtgatccagctgtcccgcaagaccttcgacagcgagtacatcaagacgcggaccaacgactgggacttcgtggtcaccaccgacatctccgagatgggcgcgaacttcaaggccgagcgcgtgatcgacccccggcgctgcatgaagcccgtgatcctcacggacggggaggagcgggtcatcctggccggccccatgccggtgacccacagctccgccgcccagcgccgggggcgcgtgggccgcaaccccaagaacgagaacgaccagtacatctacatgggggagcccctggagaacgacgaggactgcgcgcactggaaggaggccaagatgctcctggacaacatcaacacccccgagggcatcatcccgagcatgttcgagcccgagcgggagaaggtcgacgccatcgacggcgagtaccgcctgcgcggggaggcccgcaagaccttcgtggacctcatgcggcgcggcgacctgcccgtctggctggcctaccgggtggcggccgaggggatcaactacgccgaccgccggtggtgcttcgacggcgtgaagaacaaccagatcctcgaggagaacgtcgaggtggagatctggacgaaggagggggagcgcaagaagctgaagccgcggtggctggacgcccgcatctactccgaccccctcgccctgaaggagttcaaggagttcgcggccggccggaagtccctgaccctcaacctgatcaccgagatgggccgcctgcccaccttcatgacgcagaaggccaagaacgccctcgacaacctggcggtgctgcacaccgccgaggccgggggccgggcctacaaccacgccctctccgagctgcccgagaccctggagaccctcctgctgctcacgctgctggcgaccgtcaccgggggcatcttcctcttcctgatgagcggcaaggggatcggcaagatgaccctggggatgtgctgcatcatcaccgcctccatcctcctgtggtacgcccagatccagccgcactggatcgccgccagcatcatcctggagttcttcctcatcgtgctgctgatccccgagcccgagaagcagcgcacgccccaggacaaccagctcacctacgtggtcatcgcgatcctgaccgtggtggccgccaccatggccaacgagatgggcttcctggagaagacgaagaaggacttcgggctcggctccatcaccacccagcagccggagagcaacatcctggacatcgacctgcggcccgccagcgcgtggaccctctacgccgtcgccacgaccttcatcacccccatgctgcgccactccatcgagaacagctccgtgaacgtgagcctgaccgccatcgccaaccaggcgacggtcctcatgggcctggggaagggctggcccctgtccaagatggacatcggggtgccgctcctggccatcggctgctacagccaggtgaaccccatcaccctgaccgccgccctcctgctgctcgtcgcgcactacgccatcatcgggcccggcctgcaggccaaggccacccgggaggcccagaagcgcgcggccgccggcatcatgaagaaccccacggtggacgggatgaccgtgatcgacctggacccgatcccctacgaccccaagttcgagaagcagctcggccaggtcatgctgctggtgctctgcgtgacccaggtcctgatgatgcggaccacgtgggccctgtgcgaggccctcaccctggcgaccgggcccatctccaccctgtgggagggcaacccggggcgcttctggaacacgaccatcgccgtgagcatggccaacatcttccgcggctcctacctcgccggcgccgggctgctgttcagcatcatgaagaacaccgcgaacacccggcgcggcacggggaacaccggcgagaccctcggcgagaagtggaagaaccggctgaacgccctggggaagtccgagttccagatctacaagaagtccggcatccaggaggtggaccgcaccctcgccaaggaggggatcaagcggggcgagacggaccaccacgccgtctcccgcgggagcgcgaagctgcggtggttcgtggagcgcaacctggtgacccccgagggcaaggtcgtggacctcggctgcgggcggggcgggtggtcctactactgcggcgggctgaagaacgtgaaggaggtcaagggcctgaccaagggcgggcccggccacgaggagcccatcccgatgagcacctacgggtggaacctcgtgcgcctgcagtccggcgtggacgtcttcttcacgccgcccgagaagtgcgacaccctgctctgcgacatcggggagagctcccccaacccgaccgtggaggccggccggaccctgcgcgtgctgaacctcgtcgagaactggctgaacaacaacacccagttctgcatcaaggtgctgaacccctacatgcccagcgtgatcgagaagatggagacgctgcagcggaagtacggcggggccctcgtccgcaacccgctgagccggaactccacccacgagatgtactgggtgagcaacgcctccggcaacatcgtgagctccgtcaacatgatcagccgcatgctgatcaaccggttcaccatgcgccacaagaaggccacctacgagcccgacgtggacctcgggtccggcacgcggaacatcgggatcgagagcgagacccccaacctggacatcatcggcaagcgcatcgagaagatcaagcaggagcacgagacctcctggcactacgaccaggaccacccctacaagacctgggcgtaccacggcagctacgagacgaagcagaccgggtccgccagctccatggtgaacggcgtcgtgcgcctgctcaccaagccgtgggacgtgatccccatggtcacccagatggccatgacggacaccacccccttcgggcagcagcgggtgttcaaggagaaggtcgacacccgcacgcaggagcccaaggagggcaccaagaagctgatgaagatcaccgccgagtggctgtggaaggagctcggcaagaagaagaccccgcggatgtgcacgcgcgaggagttcacccggaaggtgcgcagcaacgccgcgctgggggccatcttcaccgacgagaacaagtggaagtccgcccgggaggccgtggaggacagcggcttctgggagctggtcgacaaggagcgcaacctccacctggaggggaagtgcgagacctgcgtgtacaacatgatgggcaagcgggagaagaagctgggggagttcggcaaggccaagggctcccgcgcgatctggtacatgtggctcggggcccggttcctggagttcgaggccctgggcttcctcaacgaggaccactggttcagccgcgagaactccctgagcggggtggagggcgaggggctgcacaagctcggctacatcctgcgggacgtcagcaagaaggagggcggggccatgtacgcggacgacacggccggctgggacacccgcatcaccctggaggacctcaagaacgaggagatggtgaccaaccacatggagggggagcacaagaagctggccgaggccatcttcaagctgacgtaccagaacaaggtggtccgggtgcagcgccccacgccccggggcaccgtgatggacatcatctcccgccgggaccagcgcgggagcggccaggtcgtgacctacggcctcaacacgttcaccaacatggaggcccagctgatccggcagatggagggggagggcgtgttcaagtccatccagcagctgaccgtcaaggaggagatcgcggtgaagaactggctcatccgcgtggggcgcgagcggctgagccgcatggccatctccggcgacgactgcgtcgtgaagcccctggacgaccggttcgccagcgccctcaccgccctgaacgacatgggcaaggtgcgcaaggacatccagcagtgggagccgtcccgggggtggaacgactggacgcaggtccccttctgcagccaccacttccacgagctgatcatgaaggacggccgcgtgctcgtggtcccctgccggaaccaggacgagctgatcgggcgcgcgcggatctcccagggcgccgggtggagcctgcgcgagaccgcctgcctcggcaagtcctacgcccagatgtggagcctgatgtacttccaccggcgcgacctgcggctcgccgcgaacgccatctgctccgccgtgcccagccactggatcccgacctcccgcaccacctggagcatccacgccacgcacgagtggatgaccaccgaggacatgctgaccgtgtggaaccgggtctggatccaggagaacccctggatggaggacaagacgcccgtggagtcctgggaggagatcccctacctgggcaagcgcgaggaccagtggtgcgggagcctcatcggcctgaccagccgggccacctgggcgaagaacatccagaccgccatcaaccaggtgcgctccctgatcgggaacgaggagtacacggactacatgccgagcatgaagcggttccgccgcgaggaggaggaggccggcgtcctctggtga

SEQ ID NO: 9069 - RNA, 9876 nt, synthetic construct
  misc_feature 1..9876: note = derived and/or modified CDS sequence (opt1) from DENV-2__KM279518__SS-prME
  source 1..9876: mol_type = other RNA
accgcggggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgagcagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggtccctgcgcccccagccgaccgagctgaagtacagctggaaggcgtggggcaaggccaagatgctctccaccgagctgcacaaccacacgttcctgatcgacggccccgagaccgccgagtgccccaacaccaaccgggcctggaacagcctcgaggtggaggactacgggttcggcgtcttcaccacgaacatctggctgaagctgaaggagcgccaggacgtgttctgcgactccaagctcatgagcgccgcgatcaaggacaaccgggccgtgcacgccgacatggggtactggatcgagtccgccctgaacgacacctggaagatcgagaaggccagcttcatcgaggtcaagtcctgccactggcccaagagccacaccctgtggtccaacggcgtgctcgagagcgagatgatcatccccaagaacttcgcgggccccgtgtcccagcacaactaccgccccgggtaccacacccagaccgccggcccgtggcacctggggcggctggagatggacttcgacttctgcgagggcacgaccgtcgtggtgaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtcaacagcctcgtgacggccggccacgggcagatcgacaacttctccctgggcgtgctgggcatggccctcttcctggaggagatgctgcgcacccgggtcgggaccaagcacgccatcctcctggtggccgtgagcttcgtcaccctgatcacgggcaacatgtccttccgcgacctcgggcgcgtgatggtgatggtcggcgccaccatgaccgacgacatcgggatgggcgtgacctacctggccctgctcgcggccttcaaggtgcggcccacgttcgccgccggcctgctgctccgcaagctgaccagcaaggagctgatgatgaccaccatcgggatcgtcctcctgtcccagagcacgatccccgagtccatcctggagctcaccgacgccctggcgctgggcatgatggtgctcaagatcgtccggaacatggagaagtaccagctggccgtgaccatcatggccatcctgtgcgtgcccaacgccgtcatcctccagaacgcctggaaggtgagctgcaccacgctggcggtggtctccgtgagcccgctgctcctgacctccagccagcagaaggccgactggatccccctggccctcaccatcaaggggctgaaccccaccgccatcttcctgacgaccctctcccgcaccagcaagaagcggtcctggcccctgaacgaggcgatcatggccgtgggcatggtcagcatcctggcctccagcctcctgaagaacgacatcccgatgaccggccccctggtggccgggggcctcctgacggtgtgctacgtcctgaccgggcgcagcgccgacctcgagctggagcgggcggccgacgtgcgctgggaggagcaggccgagatctccggcagctcccccatcctgagcatcaccatctccgaggacgggagcatgtccatcaagaacgaggaggaggagcagaccctcacgatcctgatccggaccggcctgctcgtgatcagcggcctgttccccgtctccatcccgatcaccgccgccgcgtggtacctgtgggaggtgaagaagcagcgcgccggggtgctctgggacgtcccctccccgccgcccgtgggcaaggccgagctggaggacggggcctaccggatcaagcagaagggcatcctggggtactcccagatcggcgccggcgtgtacaaggaggggaccttccacaccatgtggcacgtcacgcgcggcgcggtgctcatgcacaaggggaagcggatcgagcccagctgggccgacgtgaagaaggacctgatctcctacggcgggggctggaagctggagggcgagtggaaggagggggaggaggtccaggtgctcgccctggagcccggcaagaacccgcgcgccgtgcagaccaagcccgggctgttcaagaccaacaccggcacgatcggggccgtcagcctcgacttctcccccggcaccagcggctcccccatcgtggacaagaaggggaaggtggtcggcctgtacgggaacggcgtggtgacccggagcggcacctacgtctccgcgatcgcccagacggagaagtccatcgaggacaacccggagatcgaggacgacatcttccgcaagaagcggctgaccatcatggacctgcaccccggggccggcaagaccaagcgctacctccccgccatcgtgcgggaggcgatcaagcgcgggctgcggaccctgatcctcgcccccacgcgcgtggtcgccgccgagatggaggaggccctgcgcggcctgccgatccggtaccagacccccgcgatccgcgccgagcacaccgggcgggagatcgtggacctcatgtgccacgccaccttcacgatgcgcctgctgagccccatccgggtgcccaactacaacctcatcatcatggacgaggcccacttcaccgacccggcctccatcgcggcccgcggctacatcagcacccgggtcgagatgggcgaggccgccgggatcttcatgaccgccacgccgcccggctcccgcgaccccttcccgcagagcaacgcgcccatcatggacgaggagcgggagatccccgagcgctcctggaacagcgggcacgagtgggtgaccgacttcaagggcaagaccgtgtggttcgtcccctccatcaaggccgggaacgacatcgccgcctgcctgcggaagaacggcaagaaggtgatccagctgagccgcaagaccttcgactccgagtacatcaagacgcggaccaacgactgggacttcgtggtcaccaccgacatcagcgagatgggcgcgaacttcaaggccgagcgcgtgatcgacccgcggcgctgcatgaagcccgtgatcctcacggacggggaggagcgggtcatcctggccggccccatgcccgtgacccactccagcgccgcccagcgccgggggcgcgtgggccgcaacccgaagaacgagaacgaccagtacatctacatgggggagcccctggagaacgacgaggactgcgcgcactggaaggaggccaagatgctcctggacaacatcaacacccccgagggcatcatcccctccatgttcgagccggagcgggagaaggtcgacgccatcgacggcgagtaccgcctgcgcggggaggcccgcaagaccttcgtggacctcatgcggcgcggcgacctgcccgtctggctggcctaccgggtggcggccgaggggatcaactacgccgaccgccggtggtgcttcgacggcgtgaagaacaaccagatcctcgaggagaacgtcgaggtggagatctggacgaaggagggggagcgcaagaagctgaagccccggtggctggacgcccgcatctacagcgacccgctcgccctgaaggagttcaaggagttcgcggccggccggaagtccctgaccctcaacctgatcaccgagatgggccgcctgcccaccttcatgacgcagaaggccaagaacgccctcgacaacctggcggtgctgcacaccgccgaggccgggggccgggcctacaaccacgccctcagcgagctgcccgagaccctggagaccctcctgctgctcacgctgctggcgaccgtcaccgggggcatcttcctcttcctgatgtccggcaaggggatcggcaagatgaccctggggatgtgctgcatcatcaccgccagcatcctcctgtggtacgcccagatccagccccactggatcgccgcctccatcatcctggagttcttcctcatcgtgctgctgatcccggagcccgagaagcagcgcacgccccaggacaaccagctcacctacgtggtcatcgcgatcctgaccgtggtggccgccaccatggccaacgagatgggcttcctggagaagacgaagaaggacttcgggctcggcagcatcaccacccagcagcccgagagcaacatcctggacatcgacctgcggccggcctccgcgtggaccctctacgccgtcgccacgaccttcatcacccccatgctgcgccacagcatcgagaactccagcgtgaacgtgtccctgaccgccatcgccaaccaggcgacggtcctcatgggcctggggaagggctggcccctgagcaagatggacatcggggtgcccctcctggccatcggctgctactcccaggtgaacccgatcaccctgaccgccgccctcctgctgctcgtcgcgcactacgccatcatcgggcccggcctgcaggccaaggccacccgggaggcccagaagcgcgcggccgccggcatcatgaagaaccccacggtggacgggatgaccgtgatcgacctggaccccatcccgtacgaccccaagttcgagaagcagctcggccaggtcatgctgctggtgctctgcgtgacccaggtcctgatgatgcggaccacgtgggccctgtgcgaggccctcaccctggcgaccgggcccatcagcaccctgtgggagggcaaccccgggcgcttctggaacacgaccatcgccgtgtccatggccaacatcttccgcggcagctacctcgccggcgccgggctgctgttctccatcatgaagaacaccgcgaacacccggcgcggcacggggaacaccggcgagaccctcggcgagaagtggaagaaccggctgaacgccctgggcaagagcgagttccagatctacaagaagtccggcatccaggaggtggaccgcaccctcgccaaggaggggatcaagcggggcgagacggaccaccacgccgtcagccgcgggtccgcgaagctgcggtggttcgtggagcgcaacctggtgaccccggagggcaaggtcgtggacctcggctgcgggcggggcgggtggagctactactgcggcgggctgaagaacgtgaaggaggtcaagggcctgaccaagggcgggcccggccacgaggagcccatccccatgtccacctacgggtggaacctcgtgcgcctgcagagcggcgtggacgtcttcttcacgccgcccgagaagtgcgacaccctgctctgcgacatcggggagtccagccccaaccccaccgtggaggccggccggaccctgcgcgtgctgaacctcgtcgagaactggctgaacaacaacacccagttctgcatcaaggtgctgaacccgtacatgcccagcgtgatcgagaagatggaggccctgcagcggaagtacggcggggccctcgtccgcaaccccctgtcccggaacagcacgcacgagatgtactgggtgtccaacgccagcggcaacatcgtgtccagcgtcaacatgatctcccgcatgctgatcaaccggttcaccatgcgccacaagaaggcgacctacgagccggacgtggacctcgggagcggcacccggaacatcgggatcgagtccgagacgcccaacctggacatcatcggcaagcgcatcgagaagatcaagcaggagcacgagaccagctggcactacgaccaggaccacccctacaagacctgggcctaccacggctcctacgagaccaagcagacggggagcgcctccagcatggtgaacggcgtcgtgcgcctgctcaccaagccctgggacgtgatcccgatggtcacccagatggccatgaccgacacgacccccttcgggcagcagcgggtgttcaaggagaaggtcgacacccgcacccaggagcccaaggagggcacgaagaagctgatgaagatcaccgccgagtggctgtggaaggagctcggcaagaagaagacgccccggatgtgcacccgcgaggagttcacgcggaaggtgcgctccaacgcggccctgggggccatcttcaccgacgagaacaagtggaagtccgcccgggaggccgtggaggactccggcttctgggagctggtcgacaaggagcgcaacctccacctggaggggaagtgcgagacctgcgtgtacaacatgatgggcaagcgggagaagaagctgggggagttcggcaaggcgaagggcagccgcgccatctggtacatgtggctcggggcccggttcctggagttcgaggccctgggcttcctcaacgaggaccactggttctcccgcgagaacagcctgagcggggtggagggcgaggggctgcacaagctcggctacatcctgcgggacgtctccaagaaggagggcggggcgatgtacgccgacgacaccgccggctgggacacgcgcatcaccctggaggacctcaagaacgaggagatggtgaccaaccacatggagggggagcacaagaagctggccgaggccatcttcaagctgacctaccagaacaaggtggtccgggtgcagcgccagacgccgcggggcaccgtgatggacatcatcagccgccgggaccagcgcgggtccggccaggtcgtgacctacggcctcaacaccttcacgaacatggaggcgcagctgatccggcagatggagggggagggcgtgttcaagagcatccagcagctgaccgtcaaggaggagatcgccgtgaagaactggctcatccgcgtggggcgcgagcggctgtcccgcatggccatcagcggcgacgactgcgtcgtgaagcccctggacgaccggttcgcctccgccctcaccgcgctgaacgacatgggcaaggtgcgcaaggacatccagcagtgggagcccagccgggggtggaacgactggacccaggtccccttctgctcccaccacttccacgagctgatcatgaaggacggccgcgtgctcgtggtcccgtgccggaaccaggacgagctgatcgggcgcgcccggatcagccagggcgccgggtggtccctgcgcgagacggcctgcctcggcaagagctacgcccagatgtggtccctgatgtacttccaccggcgcgacctgcggctcgcggccaacgccatctgcagcgccgtgccctcccactggatccccaccagccgcaccacctggtccatccacgccacccacgagtggatgacgaccgaggacatgctgaccgtgtggaaccgggtctggatccaggagaacccctggatggaggacaagaccccggtggagagctgggaggagatcccctacctgggcaagcgcgaggaccagtggtgcgggagcctcatcggcctgacgtcccgggcgacctgggccaagaacatccagaccgccatcaaccaggtgcgcagcctgatcgggaacgaggagtacaccgactacatgccctccatgaagcggttccgccgcgaggaggaggaggccggcgtcctctggtga

SEQ ID NO: 9070 - RNA, 9876 nt, synthetic construct
  misc_feature 1..9876: note = derived and/or modified CDS sequence (opt1) from DENV-2__KM279519__SS-prME
  source 1..9876: mol_type = other RNA
accgcggggatcatcatcatgatgatccccaccgtgatggccttccacctgaccacccgcaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgagcagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggtccctgcgcccccagccgaccgagctgaagtacagctggaaggcgtggggcaaggccaagatgctctccaccgagctgcacaaccacacgttcctgatcgacggccccgagaccgccgagtgccccaacaccaaccgggcctggaacagcctcgaggtggaggactacgggttcggcgtcttcaccacgaacatctggctgaagctgaaggagcgccaggacgtgttctgcgactccaagctcatgagcgccgcgatcaaggacaaccgggccgtgcacgccgacatggggtactggatcgagtccgccctgaacgacacctggaagatcgagaaggccagcttcatcgaggtcaagtcctgccactggcccaagagccacaccctgtggtccaacggcgtgctcgagagcgagatgatcatccccaagaacttcgcgggccccgtgtcccagcacaactaccgccccgggtaccacacccagaccgccggcccgtggcacctggggcggctggagatggacttcgacttctgcgagggcacgaccgtcgtggtgaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtcaacagcctcgtgacggccggccacgggcagatcgacaacttctccctgggcgtgctgggcatggccctcttcctggaggagatgctgcgcacccgggtcgggaccaagcacgccatcctcctggtggccgtgagcttcgtcaccctgatcacgggcaacatgtccttccgcgacctcgggcgcgtgatggtgatggtcggcgccaccatgaccgacgacatcgggatgggcgtgacctacctggccctgctcgcggccttcaaggtgcggcccacgttcgccgccggcctgctgctccgcaagctgaccagcaaggagctgatgatgaccaccatcgggatcgtcctcctgtcccagagcacgatccccgagtccatcctggagctcaccgacgccctggcgctgggcatgatggtgctcaagatcgtccggaacatggagaagtaccagctggccgtgaccatcatggccatcctgtgcgtgcccaacgccgtcatcctccagaacgcctggaaggtgagctgcaccacgctggcggtggtctccgtgagcccgctgctcctgacctccagccagcagaaggccgactggatccccctggccctcaccatcaaggggctgaaccccaccgccatcttcctgacgaccctctcccgcaccagcaagaagcggtcctggcccctgaacgaggcgatcatggccgtgggcatggtcagcatcctggcctccagcctcctgaagaacgacatcccgatgaccggccccctggtggccgggggcctcctgacggtgtgctacgtcctgaccgggcgcagcgccgacctcgagctggagcgggcggccgacgtgcgctgggaggagcaggccgagatctccggcagctcccccatcctgagcatcaccatctccgaggacgggagcatgtccatcaagaacgaggaggaggagcagaccctcacgatcctgatccggaccggcctgctcgtgatcagcggcctgttccccgtctccatcccgatcaccgccgccgcgtggtacctgtgggaggtgaagaagcagcgcgccggggtgctctgggacgtcccctccccgccgcccgtgggcaaggccgagctggaggacggggcctaccggatcaagcagaagggcatcctggggtactcccagatcggcgccggcgtgtacaaggaggggaccttccacaccatgtggcacgtcacgcgcggcgcggtgctcatgcacaaggggaagcggatcgagcccagctgggccgacgtgaagaaggacctgatctcctacggcgggggctggaagctggagggcgagtggaaggagggggaggaggtccaggtgctcgccctggagcccggcaagaacccgcgcgccgtgcagaccaagcccgggctgttcaagaccaacaccggcacgatcggggccgtcagcctcgacttctcccccggcaccagcggctcccccatcgtggacaagaaggggaaggtggtcggcctgtacgggaacggcgtggtgacccggagcggcacctacgtctccgcgatcgcccagacggagaagtccatcgaggacaacccggagatcgaggacgacatcttccgcaagaagcggctgaccatcatggacctgcaccccggggccggcaagaccaagcgctacctccccgccatcgtgcgggaggcgatcaagcgcgggctgcggaccctgatcctcgcccccacgcgcgtggtcgccgccgagatggaggaggccctgcgcggcctgccgatccggtaccagacccccgcgatccgcgccgagcacaccgggcgggagatcgtggacctcatgtgccacgccaccttcacgatgcgcctgctgagccccatccgggtgcccaactacaacctcatcatcatggacgaggcccacttcaccgacccggcctccatcgcggcccgcggctacatcagcacccgggtcgagatgggcgaggccgccgggatcttcatgaccgccacgccgcccggctcccgcgaccccttcccgcagagcaacgcgcccatcatggacgaggagaaggagatccccgagcggtcctggaacagcgggcacgagtgggtgaccgacttcaagggcaagaccgtgtggttcgtcccctccatcaaggccgggaacgacatcgccgcctgcctgcgcaagaacggcaagaaggtgatccagctgagccggaagaccttcgactccgagtacatcaagacgcgcaccaacgactgggacttcgtggtcaccaccgacatcagcgagatgggcgcgaacttcaaggccgagcgggtgatcgacccgcgccggtgcatgaagcccgtgatcctcacggacggggaggagcgcgtcatcctggccggccccatgcccgtgacccactccagcgccgcccagcggcgcgggcgggtgggccgcaacccgaagaacgagaacgaccagtacatctacatgggggagcccctggagaacgacgaggactgcgcgcactggaaggaggccaagatgctcctggacaacatcaacacccccgagggcatcatcccctccatgttcgagccggagcgcgagaaggtcgacgccatcgacggcgagtaccggctgcgcggggaggcccggaagaccttcgtggacctcatgcgccggggcgacctgcccgtctggctggcctaccgcgtggcggccgaggggatcaactacgccgaccggcgctggtgcttcgacggcgtgaagaacaaccagatcctcgaggagaacgtcgaggtggagatctggacgaaggagggggagcggaagaagctgaagccccgctggctggacgcccggatctacagcgacccgctcgccctgaaggagttcaaggagttcgcggccggccgcaagtccctgaccctcaacctgatcaccgagatgggccggctgcccaccttcatgacgcagaaggccaagaacgccctcgacaacctggcggtgctgcacaccgccgaggccgggggccgcgcctacaaccacgccctcagcgagctgcccgagaccctggagaccctcctgctgctcacgctgctggcgaccgtcaccgggggcatcttcctcttcctgatgtccggcaaggggatcggcaagatgaccctggggatgtgctgcatcatcaccgccagcatcctcctgtggtacgcccagatccagccccactggatcgccgcctccatcatcctggagttcttcctcatcgtgctgctgatcccggagcccgagaagcagcggacgccccaggacaaccagctcacctacgtggtcatcgcgatcctgaccgtggtggccgccaccatggccaacgagatgggcttcctggagaagacgaagaaggacttcgggctcggcagcatcaccacccagcagcccgagagcaacatcctggacatcgacctgcgcccggcctccgcgtggaccctctacgccgtcgccacgaccttcatcacccccatgctgcggcacagcatcgagaactccagcgtgaacgtgtccctgaccgccatcgccaaccaggcgacggtcctcatgggcctggggaagggctggcccctgagcaagatggacatcggggtgcccctcctggccatcggctgctactcccaggtgaacccgatcaccctgaccgccgccctcctgctgctcgtcgcgcactacgccatcatcgggcccggcctgcaggccaaggccacccgcgaggcccagaagcgggcggccgccggcatcatgaagaaccccacggtggacgggatgaccgtgatcgacctggaccccatcccgtacgaccccaagttcgagaagcagctcggccaggtcatgctgctggtgctctgcgtgacccaggtcctgatgatgcgcaccacgtgggccctgtgcgaggccctcaccctggcgaccgggcccatcagcaccctgtgggagggcaaccccgggcggttctggaacacgaccatcgccgtgtccatggccaacatcttccgcggcagctacctcgccggcgccgggctgctgttctccatcatgaagaacaccgcgaacacccgccggggcacggggaacaccggcgagaccctcggcgagaagtggaagaaccgcctgaacgccctgggcaagagcgagttccagatctacaagaagtccggcatccaggaggtggaccggaccctcgccaaggaggggatcaagcgcggcgagacggaccaccacgccgtcagccgggggtccgcgaagctgcgctggttcgtggagcggaacctggtgaccccggagggcaaggtcgtggacctcggctgcgggcgcggcgggtggagctactactgcggcgggctgaagaacgtgaaggaggtcaagggcctgaccaagggcgggcccggccacgaggagcccatccccatgtccacctacgggtggaacctcgtgcggctgcagagcggcgtggacgtcttcttcacgccgcccgagaagtgcgacaccctgctctgcgacatcggggagtccagccccaaccccaccgtggaggccggccgcaccctgcgggtgctgaacctcgtcgagaactggctgaacaacaacacccagttctgcatcaaggtgctgaacccgtacatgcccagcgtgatcgagaagatggaggccctgcagcgcaagtacggcggggccctcgtccggaaccccctgtcccgcaacagcacgcacgagatgtactgggtgtccaacgccagcggcaacatcgtgtccagcgtcaacatgatctcccggatgctgatcaaccgcttcaccatgcggcacaagaaggcgacctacgagccggacgtggacctcgggagcggcacccgcaacatcgggatcgagtccgagacgcccaacctggacatcatcggcaagcggatcgagaagatcaagcaggagcacgagaccagctggcactacgaccaggaccacccctacaagacctgggcctaccacggctcctacgagaccaagcagacggggagcgcctccagcatggtgaacggcgtcgtgcgcctgctcaccaagccctgggacgtgatcccgatggtcacccagatggccatgaccgacacgacccccttcgggcagcagcgcgtgttcaaggagaaggtcgacacccggacccaggagcccaaggagggcacgaagaagctgatgaagatcaccgccgagtggctgtggaaggagctcggcaagaagaagacgccccgcatgtgcacccgggaggagttcacgcgcaaggtgcggtccaacgcggccctgggggccatcttcaccgacgagaacaagtggaagtccgcccgcgaggccgtggaggactccggcttctgggagctggtcgacaaggagcggaacctccacctggaggggaagtgcgagacctgcgtgtacaacatgatgggcaagcgcgagaagaagctgggggagttcggcaaggcgaagggcagccgggccatctggtacatgtggctcggggcccgcttcctggagttcgaggccctgggcttcctcaacgaggaccactggttctcccgggagaacagcctgagcggggtggagggcgaggggctgcacaagctcggctacatcctgcgcgacgtctccaagaaggagggcggggcgatgtacgccgacgacaccgccggctgggacacgcggatcaccctggaggacctcaagaacgaggagatggtgaccaaccacatggagggggagcacaagaagctggccgaggccatcttcaagctgacctaccagaacaaggtggtccgcgtgcagcggccgacgccccgcggcaccgtgatggacatcatcagccggcgcgaccagcgggggtccggccaggtcgtgacctacggcctcaacaccttcacgaacatggaggcgcagctgatccgccagatggagggggagggcgtgttcaagagcatccagcagctgaccgtcaaggaggagatcgccgtgaagaactggctcatccgggtggggcgcgagcgcctgtcccggatggccatcagcggcgacgactgcgtcgtgaagcccctggacgaccgcttcgcctccgccctcaccgcgctgaacgacatgggcaaggtgcggaaggacatccagcagtgggagcccagccgcgggtggaacgactggacccaggtcccgttctgctcccaccacttccacgagctgatcatgaaggacggccgggtgctcgccgtgccctgccgcaaccaggacgagctgatcgggcgggcccgcatcagccagggcgccgggtggtccctgcgggagacggcctgcctcggcaagagctacgcgcagatgtggtccctgatgtacttccaccgccgggacctgcgcctcgccgccaacgccatctgcagcgccgtcccctcccactggatccccaccagccggaccacctggtccatccacgcgacccacgagtggatgacgaccgaggacatgctgaccgtgtggaaccgcgtgtggatccaggagaacccgtggatggaggacaagacccccgtcgagagctgggaggagatcccctacctgggcaagcgggaggaccagtggtgcgggagcctcatcggcctgacgtcccgcgccacctgggccaagaacatccagaccgccatcaaccaggtgcggagcctgatcgggaacgaggagtacaccgactacatgccctccatgaagcgcttccggcgcgaggaggaggaggcgggcgtgctctggtga

SEQ ID NO: 9071 - RNA, 9876 nt, synthetic construct
  misc_feature 1..9876: note = derived and/or modified CDS sequence (opt1) from DENV-2__KM279520__SS-prME
  source 1..9876: mol_type = other RNA
accgccgggatcatcatcatgatgatccccaccgtgatggccttccacctgaccacccgcaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgagcagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggcccgcaacaagcccacgctcgacttcgagctgatcaagaccgaggccaagcacctggccaccctccggaagtactgcgtggaggccaagctgaccaacacgaccaccgcgagccgctgccccacccagggggagccctccctgaacgaggagcaggacaagcggttcgtgtgcaagcacagcatggtcgaccgcggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcggaccggcctcgacttcaacgagatggtgctgctgcagatggagaacaaggcctggctcgtccaccgccagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccggctgcgcatggacaagctccagctgaagggcatgagctactccatgtgcaccgggaagttcaaggtcgtgaaggagatcgcggagacccagcacggcaccatcgtgatccgggtccagtacgagggggacggcagcccctgcaagatccccttcgagatcatggacctggagaagcgccacgccctcggccgcctgatcacggtgaaccccatcgtgaccgagaaggactccccggtcaacatcgaggccgagccgcccttcggggacagctacatcatcatcggcgtggagcccgggcagctgaagctctcctggttcaagaagggcagctccatcgggcagatgttcgagaccaccatgcggggcgccaagcgcatggccatcctgggcgacacggcgtgggacttcgggagcctgggcggggtgttcacctccatcggcaaggccctccaccaggtcttcggggccatctacggcgccgcgttcagcggcgtgtcctggaccatgaagatcctgatcggggtggtcatcacctggatcggcatgaacagccggtccacgagcctgtccgtgagcctggtgctcgtcggggtggtgaccctgtacctgggcgtcatggtgcaggccgactccgggtgcgtggtcagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccgcagcgtgacccggctggagaacctcatgtggaagcagatcacccccgagctgaaccacatcctgaccgagaacgaggtcaagctcacgatcatgaccggggacatcaagggcatcatgcaggcggggaagcgctccctgcggccccagccgaccgagctgaagtacagctggaaggcctggggcaaggccaagatgctctccaccgagctgcacaaccacacgttcctgatcgacggccccgagaccgccgagtgccccaacaccaaccgcgcctggaacagcctcgaggtggaggactacgggttcggcgtgttcaccacgaacatctggctgaagctgaaggagcggcaggacgtcttctgcgactccaagctcatgagcgcggccatcaaggacaaccgcgccgtgcacgccgacatggggtactggatcgagtccgccctgaacgacacctggaagatcgagaaggcgagcttcatcgaggtgaagtcctgccactggcccaagagccacaccctgtggtccaacggcgtcctcgagagcgagatgatcatccccaagaacttcgccggccccgtgtcccagcacaactaccggcccgggtaccacacccagaccgccggcccgtggcacctggggcgcctggagatggacttcgacttctgcgagggcacgaccgtggtcgtgaccgaggactgcgggaaccggggccccagcctccgcaccacgaccgccagcggcaagctgatcaccgagtggtgctgccggtcctgcaccctgccgcccctccgctaccgcggggaggacggctgctggtacgggatggagatccgcccgctgaaggagaaggaggagaacctggtgaacagcctcgtcacggcgggccacgggcagatcgacaacttctccctgggcgtgctgggcatggccctcttcctggaggagatgctgcggacccgcgtggggaccaagcacgccatcctcctggtcgccgtgagcttcgtgaccctgatcacgggcaacatgtccttccgcgacctcgggcgggtcatggtgatggtgggcgccaccatgaccgacgacatcgggatgggcgtcacctacctggcgctgctcgccgccttcaaggtgcgccccacgttcgccgccggcctgctgctccggaagctgaccagcaaggagctgatgatgaccaccatcgggatcgtgctcctgtcccagagcacgatccccgagtccatcctggagctcaccgacgcgctggccctgggcatgatggtcctcaagatcgtgcgcaacatggagaagtaccagctggccgtcaccatcatggccatcctgtgcgtgcccaacgccgtgatcctccagaacgcgtggaaggtcagctgcaccacgctggccgtggtgtccgtcagcccgctgctcctgacctccagccagcagaaggccgactggatccccctggccctcaccatcaaggggctgaaccccaccgcgatcttcctgacgaccctctcccggaccagcaagaagcgctcctggcccctgaacgaggccatcatggccgtgggcatggtgagcatcctggcctccagcctcctgaagaacgacatcccgatgaccggccccctggtcgccgggggcctcctgacggtgtgctacgtgctgaccgggcggagcgcggacctcgagctggagcgcgccgccgacgtccggtgggaggagcaggccgagatctccggcagctcccccatcctgagcatcaccatctccgaggacgggagcatgtccatcaagaacgaggaggaggagcagaccctcacgatcctgatccgcaccggcctgctcgtgatcagcggcctgttccccgtgtccatcccgatcaccgccgcggcctggtacctgtgggaggtcaagaagcagcgggccggggtgctctgggacgtgccctccccgccgcccgtcggcaaggccgagctggaggacggggcctaccgcatcaagcagaagggcatcctggggtactcccagatcggcgcgggcgtgtacaaggaggggaccttccacaccatgtggcacgtgacgcggggcgccgtcctcatgcacaaggggaagcgcatcgagcccagctgggccgacgtgaagaaggacctgatctcctacggcgggggctggaagctggagggcgagtggaaggagggggaggaggtgcaggtcctcgccctggagcccggcaagaacccgcgggccgtgcagaccaagcccgggctgttcaagaccaacaccggcacgatcggggcggtgagcctcgacttctcccccggcaccagcggctcccccatcgtcgacaagaaggggaaggtggtgggcctgtacgggaacggcgtcgtgacccgcagcggcacctacgtgtccgccatcgcccagacggagaagtccatcgaggacaacccggagatcgaggacgacatcttccggaagaagcgcctgaccatcatggacctgcaccccggggccggcaagaccaagcggtacctccccgcgatcgtccgcgaggccatcaagcgggggctgcgcaccctgatcctcgcccccacgcgcgtggtggccgccgagatggaggaggcgctgcggggcctgccgatccgctaccagacccccgccatccgggccgagcacaccgggcgcgagatcgtcgacctcatgtgccacgccaccttcacgatgcggctgctgagccccatccgcgtgcccaactacaacctcatcatcatggacgaggcccacttcaccgacccggcgtccatcgccgcccggggctacatcagcacccgcgtggagatgggcgaggccgccgggatcttcatgaccgcgacgccgcccggctcccgggaccccttcccgcagagcaacgcccccatcatggacgaggagcgcgagatccccgagcggtcctggaacagcgggcacgagtgggtcaccgacttcaagggcaagaccgtgtggttcgtgccctccatcaaggccgggaacgacatcgccgcgtgcctgcgcaagaacggcaagaaggtcatccagctgagccggaagaccttcgactccgagtacatcaagacgcgcaccaacgactgggacttcgtggtgaccaccgacatcagcgagatgggcgccaacttcaaggccgagcgggtcatcgacccgcgccggtgcatgaagcccgtgatcctcacggacggggaggagcgcgtgatcctggccggccccatgcccgtcacccactccagcgccgcgcagcggcgcgggcgcgtgggccggaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgcgagaaggtggacgccatcgacggcgagtaccggctgcgcggggaggcccggaagaccttcgtcgacctcatgcgccggggcgacctgcccgtgtggctggcgtaccgcgtcgccgccgaggggatcaactacgccgaccggcgctggtgcttcgacggcgtgaagaacaaccagatcctcgaggagaacgtggaggtcgagatctggacgaaggagggggagcggaagaagctgaagccccgctggctggacgcccggatctacagcgacccgctcgcgctgaaggagttcaaggagttcgccgccggccgcaagtccctgaccctcaacctgatcaccgagatgggccggctgcccaccttcatgacgcagaaggccaagaacgcgctcgacaacctggccgtgctgcacaccgccgaggccgggggccgcgcctacaaccacgcgctcagcgagctgcccgagaccctggagaccctcctgctgctcacgctgctggccaccgtgaccgggggcatcttcctcttcctgatgtccggcaaggggatcggcaagatgaccctggggatgtgctgcatcatcaccgccagcatcctcctgtggtacgcccagatccagccccactggatcgccgcgtccatcatcctggagttcttcctcatcgtcctgctgatcccggagcccgagaagcagcggacgccccaggacaaccagctcacctacgtggtgatcgccatcctgaccgtcgtggccgccaccatggccaacgagatgggcttcctggagaagacgaagaaggacttcgggctcggcagcatcaccacccagcagcccgagagcaacatcctggacatcgacctgcgcccggcgtccgcctggaccctctacgccgtggccacgaccttcatcacccccatgctgcggcacagcatcgagaactccagcgtcaacgtgtccctgaccgccatcgcgaaccaggccacggtgctcatgggcctggggaagggctggcccctgagcaagatggacatcggggtccccctcctggccatcggctgctactcccaggtgaacccgatcaccctgaccgccgcgctcctgctgctcgtggcccactacgccatcatcgggcccggcctgcaggccaaggccacccgcgaggcgcagaagcgggccgccgccggcatcatgaagaaccccacggtcgacgggatgaccgtgatcgacctggaccccatcccgtacgaccccaagttcgagaagcagctcggccaggtgatgctgctggtcctctgcgtgacccaggtgctgatgatgcgcaccacgtgggccctgtgcgaggcgctcaccctggccaccgggcccatcagcaccctgtgggagggcaaccccgggcgcttctggaacacgaccatcgccgtctccatggccaacatcttccggggcagctacctcgccggcgcggggctgctgttctccatcatgaagaacaccgccaacacccgccggggcacggggaacaccggcgagaccctcggcgagaagtggaagaaccgcctgaacgccctgggcaagagcgagttccagatctacaagaagtccggcatccaggaggtggaccggaccctcgccaaggaggggatcaagcgcggcgagacggaccaccacgcggtgagccgggggtccgccaagctgcgctggttcgtcgagcggaacctggtgaccccggagggcaaggtggtcgacctcggctgcgggcgcggcgggtggagctactactgcggcgggctgaagaacgtgaaggaggtgaagggcctgaccaagggcgggcccggccacgaggagcccatccccatgtccacctacgggtggaacctcgtccggctgcagagcggcgtggacgtgttcttcacgccgcccgagaagtgcgacaccctgctctgcgacatcggggagtccagccccaaccccaccgtcgaggccggccgcaccctgcgggtgctgaacctcgtggagaactggctgaacaacaacacccagttctgcatcaaggtcctgaacccgtacatgcccagcgtgatcgagaagatggaggccctgcagcgcaagtacggcggggccctcgtgcggaaccccctgtcccgcaacagcacgcacgagatgtactgggtctccaacgcgagcggcaacatcgtgtccagcgtgaacatgatctcccggatgctgatcaaccgcttcaccatgcggcacaagaaggccacctacgagccggacgtcgacctcgggagcggcacccgcaacatcgggatcgagtccgagacgcccaacctggacatcatcggcaagcgcatcgagaagatcaagcaggagcacgagaccagctggcactacgaccaggaccacccctacaagacctgggcctaccacggctcctacgagaccaagcagacggggagcgcctccagcatggtgaacggcgtggtccggctgctcaccaagccctgggacgtgatcccgatggtgacccagatggccatgaccgacacgacccccttcgggcagcagcgcgtcttcaaggagaaggtggacacccggacccaggagcccaaggagggcacgaagaagctgatgaagatcaccgcggagtggctgtggaaggagctcggcaagaagaagacgccccggatgtgcacccgggaggagttcacgcgcaaggtccggtccaacgccgccctgggggccatcttcaccgacgagaacaagtggaagtccgcccgcgaggcggtggaggactccggcttctgggagctggtggacaaggagcggaacctccacctggaggggaagtgcgagacctgcgtctacaacatgatgggcaagcgcgagaagaagctgggggagttcggcaaggccaagggcagccgggccatctggtacatgtggctcggggcccgcttcctggagttcgaggcgctgggcttcctcaacgaggaccactggttctcccgggagaacagcctgagcggggtggagggcgaggggctgcacaagctcggctacatcctgcgcgacgtgtccaagaaggagggcggggccatgtacgccgacgacaccgccggctgggacacgcggatcaccctggaggacctcaagaacgaggagatggtcaccaaccacatggagggggagcacaagaagctggccgaggcgatcttcaagctgacctaccagaacaaggtggtgcgcgtccagcggccgacgccccgcggcaccgtgatggacatcatcagccggcgcgaccagcgggggtccggccaggtggtcacctacggcctcaacaccttcacgaacatggaggcccagctgatccgccagatggagggggagggcgtgttcaagagcatccagcagctgaccgtgaaggaggagatcgccgtcaagaactggctcatccgcgtggggcgggagcgcctgtcccggatggccatcagcggcgacgactgcgtggtcaagcccctggacgaccgcttcgcctccgcgctcaccgccctgaacgacatgggcaaggtgcggaaggacatccagcagtgggagcccagccgcgggtggaacgactggacccaggtgccgttctgctcccaccacttccacgagctgatcatgaaggacggccgggtcctcgtggtgccctgccgcaaccaggacgagctgatcgggcgggcccgcatcagccagggcgccgggtggtccctgcgggagacggcctgcctcggcaagagctacgcgcagatgtggtccctgatgtacttccaccgccgggacctgcgcctcgccgccaacgccatctgcagcgccgtcccctcccactggatccccaccagccggaccacctggtccatccacgcgacccacgagtggatgacgaccgaggacatgctgaccgtgtggaaccgcgtgtggatccaggagaacccgtggatggaggacaagacccccgtcgagacgtgggaggagatcccctacctgggcaagcgggaggaccagtggtgcgggagcctcatcggcctgaccagccgcgccacctgggccaagaacatccagaccgccatcaaccaggtgcggtccctgatcgggaacgaggagtacacggactacatgcccagcatgaagcgcttccgccgggaggaggaggaggcgggcgtgctctggtga

SEQ ID NO: 9072 - RNA, 9876 nt, synthetic construct
  misc_feature 1..9876: note = derived and/or modified CDS sequence (opt1) from DENV-2__KM279521__SS-prME
  source 1..9876: mol_type = other RNA
accgcggggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgagcagcgagggcgcctggaagcacgcccagcggatcgagacctggatcctccgccaccccgggttcaccatcatggcggccatcctggcctacaccatcggcaccacctacttccagcgggtcctgatcttcatcctcctgaccgccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccgtccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccaccgtgaacatcgaggccgagccgcccttcggggacagctacatcatcatcggcgtggagcccgggcagctgaagctctcctggttcaagaagggcagctccatcgggcagatgttcgagaccacgatgcgcggcgccaagcggatggccatcctgggcgacaccgcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacgtggatcggcatgaacagccgctccaccagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacgtggaccgagcagtacaagttccagcccgagtccccgagcaagctggcctccgccatccagaaggcccacgaggaggggatctgcggcatccggagcgtcacccgcctggagaacctcatgtggaagcagatcacccccgagctgaaccacatcctgacggagaacgaggtgaagctcaccatcatgaccggggacatcaagggcatcatgcaggccgggaagcggtccctgcgcccccagcccaccgagctgaagtacagctggaaggcgtggggcaaggccaagatgctctccacggagctgcacaaccacaccttcctgatcgacggcccggagaccgccgagtgccccaacaccaaccgggcctggaacagcctcgaggtggaggactacgggttcggcgtcttcacgaccaacatctggctgaagctgaaggagcgccaggacgtgttctgcgactccaagctcatgagcgccgcgatcaaggacaaccgggccgtgcacgccgacatggggtactggatcgagtccgccctgaacgacacctggaagatcgagaaggccagcttcatcgaggtcaagtcctgccactggcccaagagccacaccctgtggtccaacggcgtgctcgagagcgagatgatcatcccgaagaacttcgcgggccccgtgtcccagcacaactaccgccccgggtaccacacccagacggccggcccctggcacctggggcggctggagatggacttcgacttctgcgagggcaccaccgtcgtggtgaccgaggactgcgggaaccgcggcccgagcctccggacgaccaccgccagcggcaagctgatcaccgagtggtgctgccgctcctgcacgctgccgcccctccggtaccgcggggaggacggctgctggtacgggatggagatccggcccctgaaggagaaggaggagaacctggtcaacagcctcgtgaccgccggccacgggcagatcgacaacttctccctgggcgtgctgggcatggccctcttcctggaggagatgctgcgcacccgggtcgggaccaagcacgccatcctcctggtggccgtgagcttcgtcacgctgatcaccggcaacatgtccttccgcgacctcgggcgcgtgatggtgatggtcggcgccaccatgaccgacgacatcgggatgggcgtgacgtacctggccctgctcgcggccttcaaggtgcggccgaccttcgccgccggcctgctgctccgcaagctgaccagcaaggagctgatgatgaccacgatcgggatcgtcctcctgtcccagagcaccatccccgagtccatcctggagctcaccgacgccctggcgctgggcatgatggtgctcaagatcgtccggaacatggagaagtaccagctggccgtgaccatcatggccatcctgtgcgtgcccaacgccgtcatcctccagaacgcctggaaggtgagctgcacgaccctggcggtggtctccgtgagccccctgctcctgacctccagccagcagaaggccgactggatcccgctggccctcaccatcaaggggctgaaccccacggccatcttcctgaccaccctctcccgcaccagcaagaagcggtcctggcccctgaacgaggcgatcatggccgtgggcatggtcagcatcctggcctccagcctcctgaagaacgacatccccatgacgggcccgctggtggccgggggcctcctgaccgtgtgctacgtcctgaccgggcgcagcgccgacctcgagctggagcgggcggccgacgtgcgctgggaggagcaggccgagatctccggcagctcccccatcctgagcatcaccatctccgaggacgggagcatgtccatcaagaacgaggaggaggagcagacgctcaccatcctgatccggaccggcctgctcgtgatcagcggcctgttccccgtctccatccccatcaccgccgccgcgtggtacctgtgggaggtgaagaagcagcgcgccggggtgctctgggacgtcccgtccccgccgcccgtgggcaaggccgagctggaggacggggcctaccggatcaagcagaagggcatcctggggtactcccagatcggcgccggcgtgtacaaggaggggaccttccacacgatgtggcacgtcacccgcggcgcggtgctcatgcacaaggggaagcggatcgagccgagctgggccgacgtgaagaaggacctgatctcctacggcgggggctggaagctggagggcgagtggaaggagggggaggaggtccaggtgctcgccctggagcccggcaagaacccccgcgccgtgcagaccaagccggggctgttcaagaccaacacgggcaccatcggggccgtcagcctcgacttctcccccggcaccagcggctcccccatcgtggacaagaaggggaaggtggtcggcctgtacgggaacggcgtggtgacccggagcggcacgtacgtctccgcgatcgcccagaccgagaagtccatcgaggacaaccccgagatcgaggacgacatcttccgcaagaagcggctgaccatcatggacctgcacccgggggccggcaagaccaagcgctacctccccgccatcgtgcgggaggcgatcaagcgcgggctgcggacgctgatcctcgcccccacccgcgtggtcgccgccgagatggaggaggccctgcgcggcctgcccatccggtaccagaccccggcgatccgcgccgagcacaccgggcgggagatcgtggacctcatgtgccacgccacgttcaccatgcgcctgctgagccccatccgggtgcccaactacaacctcatcatcatggacgaggcccacttcaccgaccccgcctccatcgcggcccgcggctacatcagcacccgggtcgagatgggcgaggccgccgggatcttcatgacggccaccccgcccggctcccgcgaccccttcccccagagcaacgcgccgatcatggacgaggagcgggagatccccgagcgctcctggaacagcgggcacgagtgggtgaccgacttcaagggcaagaccgtgtggttcgtcccctccatcaaggccgggaacgacatcgccgcctgcctgcggaagaacggcaagaaggtgatccagctgagccgcaagacgttcgactccgagtacatcaagacccggaccaacgactgggacttcgtggtcaccacggacatcagcgagatgggcgcgaacttcaaggccgagcgcgtgatcgacccccggcgctgcatgaagccggtgatcctcaccgacggggaggagcgggtcatcctggccggccccatgcccgtgacccactccagcgccgcccagcgccgggggcgcgtgggccgcaaccccaagaacgagaacgaccagtacatctacatgggggagccgctggagaacgacgaggactgcgcgcactggaaggaggccaagatgctcctggacaacatcaacacccccgagggcatcatcccctccatgttcgagcccgagcgggagaaggtcgacgccatcgacggcgagtaccgcctgcgcggggaggcccgcaagacgttcgtggacctcatgcggcgcggcgacctgccggtctggctggcctaccgggtggcggccgaggggatcaactacgccgaccgccggtggtgcttcgacggcgtgaagaacaaccagatcctcgaggagaacgtcgaggtggagatctggaccaaggagggggagcgcaagaagctgaagccccggtggctggacgcccgcatctacagcgaccccctcgccctgaaggagttcaaggagttcgcggccggccggaagtccctgaccctcaacctgatcaccgagatgggccgcctgccgacgttcatgacccagaaggccaagaacgccctcgacaacctggcggtgctgcacaccgccgaggccgggggccgggcctacaaccacgccctcagcgagctgcccgagaccctggagacgctcctgctgctcaccctgctggcgaccgtcaccgggggcatcttcctcttcctgatgtccggcaaggggatcggcaagatgaccctggggatgtgctgcatcatcacggccagcatcctcctgtggtacgcccagatccagccccactggatcgccgcctccatcatcctggagttcttcctcatcgtgctgctgatccccgagccggagaagcagcgcacgccccaggacaaccagctcacctacgtggtcatcgcgatcctgaccgtggtggccgccacgatggccaacgagatgggcttcctggagaagaccaagaaggacttcgggctcggcagcatcaccacccagcagcccgagagcaacatcctggacatcgacctgcggcccgcctccgcgtggacgctctacgccgtcgccaccaccttcatcaccccgatgctgcgccacagcatcgagaactccagcgtgaacgtgtccctgacggccatcgccaaccaggcgaccgtcctcatgggcctggggaagggctggcccctgagcaagatggacatcggggtgcccctcctggccatcggctgctactcccaggtgaaccccatcaccctgaccgccgccctcctgctgctcgtcgcgcactacgccatcatcgggccgggcctgcaggccaaggccacgcgggaggcccagaagcgcgcggccgccggcatcatgaagaaccccaccgtggacgggatgaccgtgatcgacctggaccccatcccctacgacccgaagttcgagaagcagctcggccaggtcatgctgctggtgctctgcgtgacccaggtcctgatgatgcggacgacctgggccctgtgcgaggccctcaccctggcgaccgggcccatcagcacgctgtgggagggcaaccccgggcgcttctggaacaccaccatcgccgtgtccatggccaacatcttccgcggcagctacctcgccggcgccgggctgctgttctccatcatgaagaacaccgcgaacacgcggcgcggcaccgggaacaccggcgagaccctcggcgagaagtggaagaaccggctgaacgccctgggcaagagcgagttccagatctacaagaagtccggcatccaggaggtggaccgcacgctcgccaaggaggggatcaagcggggcgagaccgaccaccacgccgtcagccgcgggtccgcgaagctgcggtggttcgtggagcgcaacctggtgacccccgagggcaaggtcgtggacctcggctgcgggcggggcgggtggagctactactgcggcgggctgaagaacgtgaaggaggtcaagggcctgaccaagggcgggccgggccacgaggagcccatccccatgtccacgtacgggtggaacctcgtgcgcctgcagagcggcgtggacgtcttcttcacgccgcccgagaagtgcgacaccctgctctgcgacatcggggagtccagccccaaccccaccgtggaggccggccggaccctgcgcgtgctgaacctcgtcgagaactggctgaacaacaacacgcagttctgcatcaaggtgctgaacccctacatgcccagcgtgatcgagaagatggaggccctgcagcggaagtacggcggggccctcgtccgcaaccccctgtcccggaacagcacccacgagatgtactgggtgtccaacgccagcggcaacatcgtgtccagcgtcaacatgatctcccgcatgctgatcaaccggttcaccatgcgccacaagaaggcgacctacgagcccgacgtggacctcgggagcggcacgcggaacatcgggatcgagtccgagaccccgaacctggacatcatcggcaagcgcatcgagaagatcaagcaggagcacgagaccagctggcactacgaccaggaccacccctacaagacctgggcctaccacggctcctacgagacgaagcagaccgggagcgcctccagcatggtgaacggcgtcgtgcgcctgctcaccaagccctgggacgtgatccccatggtcacccagatggccatgacggacaccaccccgttcgggcagcagcgggtgttcaaggagaaggtcgacacccgcacgcaggagcccaaggagggcaccaagaagctgatgaagatcaccgccgagtggctgtggaaggagctcggcaagaagaagacgccccggatgtgcacgcgcgaggagttcacccggaaggtgcgctccaacgcggccctgggggccatcttcaccgacgagaacaagtggaagtccgcccgggaggccgtggaggactccggcttctgggagctggtcgacaaggagcgcaacctccacctggaggggaagtgcgagacctgcgtgtacaacatgatgggcaagcgggagaagaagctgggggagttcggcaaggcgaagggcagccgcgccatctggtacatgtggctcggggcccggttcctggagttcgaggccctgggcttcctcaacgaggaccactggttctcccgcgagaacagcctgagcggggtggagggcgaggggctgcacaagctcggctacatcctgcgggacgtctccaagaaggagggcggggcgatgtacgccgacgacacggccggctgggacacccgcatcaccctggaggacctcaagaacgaggagatggtgaccaaccacatggagggggagcacaagaagctggccgaggccatcttcaagctgacgtaccagaacaaggtggtccgggtgcagcgccccaccccgcggggcaccgtgatggacatcatcagccgccgggaccagcgcgggtccggccaggtcgtgacctacggcctcaacacgttcaccaacatggaggcgcagctgatccggcagatggagggggagggcgtgttcaagagcatccagcagctgaccgtcaaggaggagatcgccgtgaagaactggctcatccgcgtggggcgcgagcggctgtcccgcatggccatcagcggcgacgactgcgtcgtgaagcccctggacgaccggttcgcctccgccctcaccgcgctgaacgacatgggcaaggtgcgcaaggacatccagcagtgggagcccagccgggggtggaacgactggacgcaggtccccttctgctcccaccacttccacgagctgatcatgaaggacggccgcgtgctcgtggtcccgtgccggaaccaggacgagctgatcgggcgcgcccggatcagccagggcgccgggtggtccctgcgcgagaccgcctgcctcggcaagagctacgcccagatgtggtccctgatgtacttccaccggcgcgacctgcggctcgcggccaacgccatctgcagcgccgtgccctcccactggatccccaccagccgcaccacctggtccatccacgccacgcacgagtggatgaccaccgaggacatgctgaccgtgtggaaccgggtctggatccaggagaacccctggatggaggacaagacgccggtggagagctgggaggagatcccctacctgggcaagcgcgaggaccagtggtgcgggagcctcatcggcctgacctcccgggcgacctgggccaagaacatccagaccgccatcaaccaggtgcgcagcctgatcgggaacgaggagtacacggactacatgccctccatgaagcggttccgccgcgaggaggaggaggccggcgtcctctggtga

SEQ ID NO: 9073 - RNA, 9876 nt, synthetic construct
  misc_feature 1..9876: note = derived and/or modified CDS sequence (opt1) from DENV-2__KM279583__SS-prME
  source 1..9876: mol_type = other RNA
accgccgggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgagcagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggccctgctgcagatggagaacaaggcgtggctcgtgcaccggcagtggttcctggacctgcccctcccctggctgcccggcgccgacacccaggggtccaactggatccagaaggagaccctggtcacgttcaagaacccgcacgccaagaagcaggacgtggtcgtgctcggcagccaggagggggccatgcacaccgccctgaccggcgcgaccgagatccagatgagctccgggaacctcctgttcacgggccacctgaagtgccgcctgcggatggacaagctccagctgaagggcatgagctactccatgtgcaccgggaagttcaaggtggtcaaggagatcgccgagacccagcacggcaccatcgtgatccgcgtgcagtacgagggggacggcagcccctgcaagatccccttcgagatcatggacctggagaagcggcacgtcctcggccgcctgatcacggtgaaccccatcgtgaccgagaaggactccccggtcaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcgtgggacttcgggagcctgggcggggtgttcacctccatcggcaaggccctccaccaggtcttcggggccatctacggcgccgcgttcagcggcgtgtcctggaccatgaagatcctgatcggggtggtcatcacctggatcggcatgaacagccgctccacgagcctgtccgtgagcctggtgctcgtcggggtggtgaccctgtacctgggcgtcatggtgcaggccgactccgggtgcgtggtcagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtgacccgcctggagaacctcatgtggaagcagatcacccccgagctgaaccacatcctgaccgagaacgaggtcaagctcacgatcatgaccggggacatcaagggcatcatgcaggcggggaagcggtccctgcgcccccagccgaccgagctgaagtacagctggaaggcctggggcaaggccaagatgctctccaccgagctgcacaaccacacgttcctgatcgacggccccgagaccgccgagtgccccaacaccaaccgggcctggaacagcctcgaggtggaggactacgggttcggcgtgttcaccacgaacatctggctgaagctgaaggagcgccaggacgtcttctgcgactccaagctcatgagcgcggccatcaaggacaaccgggccgtgcacgccgacatggggtactggatcgagtccgccctgaacgacacctggaagatcgagaaggcgagcttcatcgaggtgaagtcctgccactggcccaagagccacaccctgtggtccaacggcgtcctcgagagcgagatgatcatccccaagaacttcgccggccccgtgtcccagcacaactaccgccccgggtaccacacccagaccgccggcccgtggcacctggggcggctggagatggacttcgacttctgcgagggcacgaccgtggtcgtgaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtgaacagcctcgtcacggcgggccacgggcagatcgacaacttctccctgggcgtgctgggcatggccctcttcctggaggagatgctgcgcacccgggtggggaccaagcacgccatcctcctggtcgccgtgagcttcgtgaccctgatcacgggcaacatgtccttccgcgacctcgggcgcgtcatggtgatggtgggcgccaccatgaccgacgacatcgggatgggcgtcacctacctggcgctgctcgccgccttcaaggtgcggcccacgttcgccgccggcctgctgctccgcaagctgaccagcaaggagctgatgatgaccaccatcgggatcgtgctcctgtcccagagcacgatccccgagtccatcctggagctcaccgacgcgctggccctgggcatgatggtcctcaagatcgtgcggaacatggagaagtaccagctggccgtcaccatcatggccatcctgtgcgtgcccaacgccgtgatcctccagaacgcgtggaaggtcagctgcaccacgctggccgtggtgtccgtcagcccgctgctcctgacctccagccagcagaaggccgactggatccccctggccctcaccatcaaggggctgaaccccaccgcgatcttcctgacgaccctctcccgcaccagcaagaagcggtcctggcccctgaacgaggccatcatggccgtgggcatggtgagcatcctggcctccagcctcctgaagaacgacatcccgatgaccggccccctggtcgccgggggcctcctgacggtgtgctacgtgctgaccgggcgcagcgcggacctcgagctggagcgggccgccgacgtccgctgggaggagcaggccgagatctccggcagctcccccatcctgagcatcaccatctccgaggacgggagcatgtccatcaagaacgaggaggaggagcagaccctcacgatcctgatccggaccggcctgctcgtgatcagcggcctgttccccgtgtccatcccgatcaccgccgcggcctggtacctgtgggaggtcaagaagcagcgcgccggggtgctctgggacgtgccctccccgccgcccgtcggcaaggccgagctggaggacggggcctaccggatcaagcagaagggcatcctggggtactcccagatcggcgcgggcgtgtacaaggaggggaccttccacaccatgtggcacgtgacgcgcggcgccgtcctcatgcacaaggggaagcggatcgagcccagctgggccgacgtgaagaaggacctgatctcctacggcgggggctggaagctggagggcgagtggaaggagggggaggaggtgcaggtcctcgccctggagcccggcaagaacccgcgcgccgtgcagaccaagcccgggctgttcaagaccaacaccggcacgatcggggcggtgagcctcgacttctcccccggcaccagcggctcccccatcgtcgacaagaaggggaaggtggtgggcctgtacgggaacggcgtcgtgacccggagcggcacctacgtgtccgccatcgcccagacggagaagtccatcgaggacaacccggagatcgaggacgacatcttccgcaagaagcggctgaccatcatggacctgcaccccggggccggcaagaccaagcgctacctccccgcgatcgtccgggaggccatcaagcgcgggctgcggaccctgatcctcgcccccacgcgcgtggtggccgccgagatggaggaggcgctgcgcggcctgccgatccggtaccagacccccgccatccgcgccgagcacaccgggcgggagatcgtcgacctcatgtgccacgccaccttcacgatgcgcctgctgagccccatccgggtgcccaactacaacctcatcatcatggacgaggcccacttcaccgacccggcgtccatcgccgcccgcggctacatcagcacccgggtggagatgggcgaggccgccgggatcttcatgaccgcgacgccgcccggctcccgcgaccccttcccgcagagcaacgcccccatcatggacgaggagcgggagatccccgagcgctcctggaacagcgggcacgagtgggtcaccgacttcaagggcaagaccgtgtggttcgtgccctccatcaaggccgggaacgacatcgccgcgtgcctgcggaagaacggcaagaaggtcatccagctgagccgcaagaccttcgactccgagtacatcaagacgcggaccaacgactgggacttcgtggtgaccaccgacatcagcgagatgggcgccaacttcaaggccgagcgcgtcatcgacccgcggcgctgcatgaagcccgtgatcctcacggacggggaggagcgggtgatcctggccggccccatgcccgtcacccactccagcgccgcgcagcgccgggggcgcgtgggccgcaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgggagaaggtggacgccatcgacggcgagtaccgcctgcgcggggaggcccgcaagaccttcgtcgacctcatgcggcgcggcgacctgcccgtgtggctggcgtaccgggtcgccgccgaggggatcaactacgccgaccgccggtggtgcttcgacggcgtgaagaacaaccagatcctcgaggagaacgtggaggtcgagatctggacgaaggagggggagcgcaagaagctgaagccccggtggctggacgcccgcatctacagcgacccgctcgcgctgaaggagttcaaggagttcgccgccggccggaagtccctgaccctcaacctgatcaccgagatgggccgcctgcccaccttcatgacgcagaaggccaagaacgcgctcgacaacctggccgtgctgcacaccgccgaggccgggggccgggcctacaaccacgcgctcagcgagctgcccgagaccctggagaccctcctgctgctcacgctgctggccaccgtgaccgggggcatcttcctcttcctgatgtccggcaaggggatcggcaagatgaccctggggatgtgctgcatcatcaccgccagcatcctcctgtggtacgcccagatccagccccactggatcgccgcgtccatcatcctggagttcttcctcatcgtcctgctgatcccggagcccgagaagcagcgcacgccccaggacaaccagctcacctacgtggtgatcgccatcctgaccgtcgtggccgccaccatggccaacgagatgggcttcctggagaagacgaagaaggacttcgggctcggcagcatcaccacccagcagcccgagagcaacatcctggacatcgacctgcggccggcgtccgcctggaccctctacgccgtggccacgaccttcatcacccccatgctgcgccacagcatcgagaactccagcgtcaacgtgtccctgaccgccatcgcgaaccaggccacggtgctcatgggcctggggaagggctggcccctgagcaagatggacatcggggtccccctcctggccatcggctgctactcccaggtgaacccgatcaccctgaccgccgcgctcctgctgctcgtggcccactacgccatcatcgggcccggcctgcaggccaaggccacccgggaggcgcagaagcgcgccgccgccggcatcatgaagaaccccacggtcgacgggatgaccgtgatcgacctggaccccatcccgtacgaccccaagttcgagaagcagctcggccaggtgatgctgctggtcctctgcgtgacccaggtgctgatgatgcggaccacgtgggccctgtgcgaggcgctcaccctggccaccgggcccatcagcaccctgtgggagggcaaccccgggcgcttctggaacacgaccatcgccgtctccatggccaacatcttccgcggcagctacctcgccggcgcggggctgctgttctccatcatgaagaacaccgccaacacccggcgcggcacggggaacaccggcgagaccctcggcgagaagtggaagaaccggctgaacgccctgggcaagagcgagttccagatctacaagaagtccggcatccaggaggtggaccgcaccctcgccaaggaggggatcaagcggggcgagacggaccaccacgcggtgagccgcgggtccgccaagctgcggtggttcgtcgagcgcaacctggtgaccccggagggcaaggtggtcgacctcggctgcgggcggggcgggtggagctactactgcggcgggctgaagaacgtgaaggaggtgaagggcctgaccaagggcgggcccggccacgaggagcccatccccatgtccacctacgggtggaacctcgtccgcctgcagagcggcgtggacgtgttcttcacgccgcccgagaagtgcgacaccctgctctgcgacatcggggagtccagccccaaccccaccgtcgaggccggccggaccctgcgcgtgctgaacctcgtggagaactggctgaacaacaacacccagttctgcatcaaggtcctgaacccgtacatgcccagcgtgatcgagaagatggaggccctgcagcggaagtacggcggggccctcgtgcgcaaccccctgtcccggaacagcacgcacgagatgtactgggtctccaacgcgagcggcaacatcgtgtccagcgtgaacatgatctcccgcatgctgatcaaccggttcaccatgcgccacaagaaggccacctacgagccggacgtcgacctcgggagcggcacccggaacatcgggatcgagtccgagacgcccaacctggacatcatcggcaagcgcatcgagaagatcaagcaggagcacgagaccagctggcactacgaccaggaccacccctacaagacctgggcctaccacggctcctacgagaccaagcagacggggagcgcctccagcatggtgaacggcgtggtccgcctgctcaccaagccctgggacgtgatcccgatggtgacccagatggccatgaccgacacgacccccttcgggcagcagcgggtcttcaaggagaaggtggacacccgcacccaggagcccaaggagggcacgaagaagctgatgaagatcaccgcggagtggctgtggaaggagctcggcaagaagaagacgccccggatgtgcacccgcgaggagttcacgcggaaggtccgctccaacgccgccctgggggccatcttcaccgacgagaacaagtggaagtccgcccgggaggcggtggaggactccggcttctgggagctggtggacaaggagcgcaacctccacctggaggggaagtgcgagacctgcgtctacaacatgatgggcaagcgggagaagaagctgggggagttcggcaaggccaagggcagccgcgccatctggtacatgtggctcggggcccggttcctggagttcgaggcgctgggcttcctcaacgaggaccactggttctcccgcgagaacagcctgagcggggtggagggcgaggggctgcacaagctcggctacatcctgcgggacgtgtccaagaaggagggcggggccatgtacgccgacgacaccgccggctgggacacgcgcatcaccctggaggacctcaagaacgaggagatggtcaccaaccacatggagggggagcacaagaagctggccgaggcgatcttcaagctgacctaccagaacaaggtggtgcgggtccagcgcccgacgccccggggcaccgtgatggacatcatcagccgccgggaccagcgcgggtccggccaggtggtcacctacggcctcaacaccttcacgaacatggaggcccagctgatccggcagatggagggggagggcgtgttcaagagcatccagcagctgaccgtgaaggaggagatcgccgtcaagaactggctcatccgcgtggggcgcgagcggctgtcccgcatggccatcagcggcgacgactgcgtggtcaagcccctggacgaccggttcgcctccgcgctcaccgccctgaacgacatgggcaaggtgcgcaaggacatccagcagtgggagcccagccgggggtggaacgactggacccaggtgccgttctgctcccaccacttccacgagctgatcatgaaggacggccgcgtcctcgtggtgccctgccggaaccaggacgagctgatcgggcgcgcccggatcagccagggcgccgggtggtccctgcgcgagacggcctgcctcggcaagagctacgcgcagatgtggtccctgatgtacttccaccggcgcgacctgcggctcgccgccaacgccatctgcagcgccgtcccctcccactggatccccaccagccgcaccacctggtccatccacgcgacccacgagtggatgacgaccgaggacatgctgaccgtgtggaaccgggtgtggatccaggagaacccgtggatggaggacaagacccccgtcgagagctgggaggagatcccctacctgggcaagcgcgaggaccagtggtgcgggagcctcatcggcctgacgtcccgggccacctgggccaagaacatccagaccgccatcaaccaggtgcgcagcctgatcgggaacgaggagtacaccgactacatgccctccatgaagcggttccgccgcgaggaggaggaggcgggcgtgctctggtga

SEQ ID NO: 9074 - RNA, 9876 nt, synthetic construct
  misc_feature 1..9876: note = derived and/or modified CDS sequence (opt1) from DENV-2__KM279585__SS-prME
  source 1..9876: mol_type = other RNA
accgcggggatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgagcagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtggtccgcgtgcagtacgagggggacggcagcccctgcaagatccccttcgagatcatggacctggagaagcggcacgtgctcggccgcctgatcacggtcaaccccatcgtgaccgagaaggactccccggtgaacatcgaggccgagccgcccttcggggacagctacatcatcatcggcgtcgagcccgggcagctgaagctctcctggttcaagaagggcagctccatcgggcagatgttcgagaccaccatgcgcggcgccaagcggatggccatcctgggcgacacggcctgggacttcgggagcctgggcggggtgttcacctccatcggcaaggcgctccaccaggtgttcggggccatctacggcgccgccttcagcggcgtctcctggaccatgaagatcctgatcggggtggtgatcacctggatcggcatgaacagccgctccacgagcctgtccgtcagcctggtgctcgtgggggtcgtgaccctgtacctgggcgtgatggtccaggcggactccgggtgcgtggtgagctggaagaacaaggagctcaagtgcggcagcggcatcttcatcaccgacaacgtccacacctggacggagcagtacaagttccagccggagtcccccagcaagctggcctccgccatccagaaggcccacgaggaggggatctgcggcatccggagcgtgacccgcctggagaacctcatgtggaagcagatcacccccgagctgaaccacatcctgaccgagaacgaggtgaagctcacgatcatgaccggggacatcaagggcatcatgcaggccgggaagcggtccctgcgcccccagccgaccgagctgaagtacagctggaaggcgtggggcaaggccaagatgctctccaccgagctgcacaaccacacgttcctgatcgacggccccgagaccgccgagtgccccaacaccaaccgggcctggaacagcctcgaggtcgaggactacgggttcggcgtgttcaccacgaacatctggctgaagctgaaggagcgccaggacgtgttctgcgactccaagctcatgagcgccgcgatcaaggacaaccgggccgtccacgccgacatggggtactggatcgagtccgccctgaacgacacctggaagatcgagaaggccagcttcatcgaggtgaagtcctgccactggcccaagagccacaccctgtggtccaacggcgtgctcgagagcgagatgatcatccccaagaacttcgcgggccccgtctcccagcacaactaccgccccgggtaccacacccagaccgccggcccgtggcacctggggcggctggagatggacttcgacttctgcgagggcacgaccgtggtggtcaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtgaacagcctcgtgacggccggccacgggcagatcgacaacttctccctgggcgtcctgggcatggccctcttcctggaggagatgctgcgcacccgggtggggaccaagcacgccatcctcctggtggccgtcagcttcgtgaccctgatcacgggcaacatgtccttccgcgacctcgggcgcgtgatggtcatggtgggcgccaccatgaccgacgacatcgggatgggcgtgacctacctggccctgctcgcggccttcaaggtccggcccacgttcgccgccggcctgctgctccgcaagctgaccagcaaggagctgatgatgaccaccatcgggatcgtgctcctgtcccagagcacgatccccgagtccatcctggagctcaccgacgccctggcgctgggcatgatggtcctcaagatcgtgcggaacatggagaagtaccagctggccgtgaccatcatggccatcctgtgcgtccccaacgccgtgatcctccagaacgcctggaaggtgagctgcaccacgctggcggtcgtgtccgtgagcccgctgctcctgacctccagccagcagaaggccgactggatccccctggccctcaccatcaaggggctgaaccccaccgccatcttcctgacgaccctctcccgcaccagcaagaagcggtcctggcccctgaacgaggcgatcatggccgtcggcatggtgagcatcctggcctccagcctcctgaagaacgacatcccgatgaccggccccctggtggccgggggcctcctgacggtctgctacgtgctgaccgggcgcagcgccgacctcgagctggagcgggcggccgacgtgcgctgggaggagcaggccgagatctccggcagctcccccatcctgagcatcaccatctccgaggacgggagcatgtccatcaagaacgaggaggaggagcagaccctcacgatcctgatccggaccggcctgctcgtcatcagcggcctgttccccgtgtccatcccgatcaccgccgccgcgtggtacctgtgggaggtgaagaagcagcgcgccggggtcctctgggacgtgccctccccgccgcccgtgggcaaggccgagctggaggacggggcctaccggatcaagcagaagggcatcctggggtactcccagatcggcgccggcgtctacaaggaggggaccttccacaccatgtggcacgtgacgcgcggcgcggtgctcatgcacaaggggaagcggatcgagcccagctgggccgacgtcaagaaggacctgatctcctacggcgggggctggaagctggagggcgagtggaaggagggggaggaggtccaggtgctcgccctggagcccggcaagaacccgcgcgccgtccagaccaagcccgggctgttcaagaccaacaccggcacgatcggggccgtgagcctcgacttctcccccggcaccagcggctcccccatcgtggacaagaaggggaaggtcgtgggcctgtacgggaacggcgtggtcacccggagcggcacctacgtgtccgcgatcgcccagacggagaagtccatcgaggacaacccggagatcgaggacgacatcttccgcaagaagcggctgaccatcatggacctgcaccccggggccggcaagaccaagcgctacctccccgccatcgtgcgggaggcgatcaagcgcgggctgcggaccctgatcctcgcccccacgcgcgtcgtggccgccgagatggaggaggccctgcgcggcctgccgatccggtaccagacccccgcgatccgcgccgagcacaccgggcgggagatcgtggacctcatgtgccacgccaccttcacgatgcgcctgctgagccccatccgggtccccaactacaacctcatcatcatggacgaggcccacttcaccgacccggcctccatcgcggcccgcggctacatcagcacccgggtggagatgggcgaggccgccgggatcttcatgaccgccacgccgcccggctcccgcgaccccttcccgcagagcaacgcgcccatcatggacgaggagcgggagatccccgagcgctcctggaacagcgggcacgagtgggtgaccgacttcaagggcaagaccgtctggttcgtgccctccatcaaggccgggaacgacatcgccgcctgcctgcggaagaacggcaagaaggtgatccagctgagccgcaagaccttcgactccgagtacatcaagacgcggaccaacgactgggacttcgtcgtgaccaccgacatcagcgagatgggcgcgaacttcaaggccgagcgcgtgatcgacccgcggcgctgcatgaagcccgtcatcctcacggacggggaggagcgggtgatcctggccggccccatgcccgtgacccactccagcgccgcccagcgccgggggcgcgtcggccgcaacccgaagaacgagaacgaccagtacatctacatgggggagcccctggagaacgacgaggactgcgcgcactggaaggaggccaagatgctcctggacaacatcaacacccccgagggcatcatcccctccatgttcgagccggagcgggagaaggtggacgccatcgacggcgagtaccgcctgcgcggggaggcccgcaagaccttcgtcgacctcatgcggcgcggcgacctgcccgtgtggctggcctaccgggtggcggccgaggggatcaactacgccgaccgccggtggtgcttcgacggcgtcaagaacaaccagatcctcgaggagaacgtggaggtggagatctggacgaaggagggggagcgcaagaagctgaagccccggtggctggacgcccgcatctacagcgacccgctcgccctgaaggagttcaaggagttcgcggccggccggaagtccctgaccctcaacctgatcaccgagatgggccgcctgcccaccttcatgacgcagaaggccaagaacgccctcgacaacctggcggtcctgcacaccgccgaggccgggggccgggcctacaaccacgccctcagcgagctgcccgagaccctggagaccctcctgctgctcacgctgctggcgaccgtgaccgggggcatcttcctcttcctgatgtccggcaaggggatcggcaagatgaccctggggatgtgctgcatcatcaccgccagcatcctcctgtggtacgcccagatccagccccactggatcgccgcctccatcatcctggagttcttcctcatcgtgctgctgatcccggagcccgagaagcagcgcacgccccaggacaaccagctcacctacgtcgtgatcgcgatcctgaccgtggtcgccgccaccatggccaacgagatgggcttcctggagaagacgaagaaggacttcgggctcggcagcatcaccacccagcagcccgagagcaacatcctggacatcgacctgcggccggcctccgcgtggaccctctacgccgtggccacgaccttcatcacccccatgctgcgccacagcatcgagaactccagcgtgaacgtctccctgaccgccatcgccaaccaggcgacggtgctcatgggcctggggaagggctggcccctgagcaagatggacatcggggtgcccctcctggccatcggctgctactcccaggtcaacccgatcaccctgaccgccgccctcctgctgctcgtggcgcactacgccatcatcgggcccggcctgcaggccaaggccacccgggaggcccagaagcgcgcggccgccggcatcatgaagaaccccacggtggacgggatgaccgtcatcgacctggaccccatcccgtacgaccccaagttcgagaagcagctcggccaggtgatgctgctggtgctctgcgtcacccaggtgctgatgatgcggaccacgtgggccctgtgcgaggccctcaccctggcgaccgggcccatcagcaccctgtgggagggcaaccccgggcgcttctggaacacgaccatcgccgtgtccatggccaacatcttccgcggcagctacctcgccggcgccgggctgctgttctccatcatgaagaacaccgcgaacacccggcgcggcacggggaacaccggcgagaccctcggcgagaagtggaagaaccggctgaacgccctgggcaagagcgagttccagatctacaagaagtccggcatccaggaggtcgaccgcaccctcgccaaggaggggatcaagcggggcgagacggaccaccacgccgtgagccgcgggtccgcgaagctgcggtggttcgtggagcgcaacctggtcaccccggagggcaaggtggtggacctcggctgcgggcggggcgggtggagctactactgcggcgggctgaagaacgtcaaggaggtgaagggcctgaccaagggcgggcccggccacgaggagcccatccccatgtccacctacgggtggaacctcgtgcgcctgcagagcggcgtcgacgtgttcttcacgccgcccgagaagtgcgacaccctgctctgcgacatcggggagtccagccccaaccccaccgtggaggccggccggaccctgcgcgtcctgaacctcgtggacaactggctgaacaacaacacccagttctgcatcaaggtgctgaacccgtacatgcccagcgtcatcgagaagatggaggccctgcagcggaagtacggcggggccctcgtgcgcaaccccctgtcccggaacagcacgcacgagatgtactgggtgtccaacgccagcggcaacatcgtctccagcgtgaacatgatctcccgcatgctgatcaaccggttcaccatgcgccacaagaaggcgacctacgagccggacgtggacctcgggagcggcacccggaacatcgggatcgagtccgagacgcccaacctggacatcatcggcaagcgcatcgagaagatcaagcaggagcacgagaccagctggcactacgaccaggaccacccctacaagacctgggcctaccacggctcctacgagaccaagcagacggggagcgcctccagcatggtcaacggcgtggtgcgcctgctcaccaagccctgggacgtcatcccgatggtgacccagatggccatgaccgacacgacccccttcgggcagcagcgggtcttcaaggagaaggtggacacccgcacccaggagcccaaggagggcacgaagaagctgatgaagatcaccgccgagtggctgtggaaggagctcggcaagaagaagacgccccggatgtgcacccgcgaggagttcacgcggaaggtgcgctccaacgcggccctgggggccatcttcaccgacgagaacaagtggaagtccgcccgggaggccgtcgaggactccggcttctgggagctggtggacaaggagcgcaacctccacctggaggggaagtgcgagacctgcgtgtacaacatgatgggcaagcgggagaagaagctgggggagttcggcaaggcgaagggcagccgcgccatctggtacatgtggctcggggcccggttcctggagttcgaggccctgggcttcctcaacgaggaccactggttctcccgcgagaacagcctgagcggggtcgagggcgaggggctgcacaagctcggctacatcctgcgggacgtgtccaagaaggagggcggggcgatgtacgccgacgacaccgccggctgggacacgcgcatcaccctggaggacctcaagaacgaggagatggtgaccaaccacatggagggggagcacaagaagctggccgaggccatcttcaagctgacctaccagaacaaggtcgtgcgggtgcagcgcccgacgccccggggcaccgtcatggacatcatcagccgccgggaccagcgcgggtccggccaggtggtgacctacggcctcaacaccttcacgaacatggaggcgcagctgatccggcagatggagggggagggcgtcttcaagagcatccagcagctgaccgtgaaggaggagatcgccgtgaagaactggctcatccgcgtcgggcgcgagcggctgtcccgcatggccatcagcggcgacgactgcgtggtgaagcccctggacgaccggttcgcctccgccctcaccgcgctgaacgacatgggcaaggtccgcaaggacatccagcagtgggagcccagccgggggtggaacgactggacccaggtgccgttctgctcccaccacttccacgagctgatcatgaaggacggccgcgtgctcgtcgtgccctgccggaaccaggacgagctgatcgggcgcgcccggatcagccagggcgccgggtggtccctgcgcgagacggcctgcctcggcaagagctacgcccagatgtggaacctgatgtacttccaccggcgcgacctgcggctcgcggccaacgccatctgctccgccgtgcccagccactggatccccacctcccgcaccacctggagcatccacgccacccacgagtggatgacgaccgaggacatgctgaccgtctggaaccgggtgtggatccaggagaacccgtggatggaggacaagacccccgtggagtcctgggaggagatcccctacctgggcaagcgcgaggaccagtggtgcgggagcctcatcggcctgacgagccgggcgacctgggccaagaacatccagaccgccatcaaccaggtccgctccctgatcgggaacgaggagtacaccgactacatgcccagcatgaagcggttccgccgcgaggaggaggaggccggcgtgctctggtga

SEQ ID NO: 9075 - RNA, 9876 nt, synthetic construct
  misc_feature 1..9876: note = derived and/or modified CDS sequence (opt1) from DENV-2__KM279525__SS-prME
  source 1..9876: mol_type = other RNA
accgcgggcatcatcatcatgatgatccccaccgtgatggccttccacctgaccacccggaacggggagccccacatgatcgtcagccggcaggagaagggcaagtccctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcaccatcatggcggccatcctggcctacaccatcggcaccacctacttccagcgggtcctgatcttcatcctcctgaccgccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggtccctgcgcccccagccgaccgagctgaagtacagctggaaggcgtggggcaaggccaagatgctctccaccgagctgcacaaccacacgttcctgatcgacggccccgagaccgccgagtgccccaacaccaaccgggcctggaacagcctcgaggtggaggactacgggttcggcgtcttcaccacgaacatctggctgaagctgaaggagcgccaggacgtgttctgcgactccaagctcatgagcgccgcgatcaaggacaaccgggccgtgcacgccgacatggggtactggatcgagtccgccctgaacgacacctggaagatcgagaaggccagcttcatcgaggtcaagtcctgccactggcccaagagccacaccctgtggtccaacggcgtgctcgagagcgagatgatcatccccaagaacttcgcgggccccgtgtcccagcacaactaccgccccgggtaccacacccagaccgccggcccgtggcacctggggcggctggagatggacttcgacttctgcgagggcacgaccgtcgtggtgaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtcaacagcctcgtgacggccggccacgggcagatcgacaacttctccctgggcgtgctgggcatggccctcttcctggaggagatgctgcgcacccgggtcgggaccaagcacgccatcctcctggtggccgtgagcttcgtcatcctgatcaccggcaacatgtccttccgcgacctcgggcgcgtgatggtgatggtcggcgccacgatgaccgacgacatcgggatgggcgtgacctacctggccctgctcgcggccttcaaggtgcggcccaccttcgccgccggcctgctgctccgcaagctgacgagcaaggagctgatgatgaccaccatcgggatcgtcctcctgtcccagagcaccatccccgagaacatcctggagctcacggacgccctggcgctgggcatgatggtgctcaagatcgtccggaacatggagaagtaccagctggccgtgaccatcatggccatcctgtgcgtgcccaacgccgtcatcctccagaacgcctggaaggtgtcctgcaccaccctggcggtggtcagcgtgtccccgctgctcctgacgagctcccagcagaaggccgactggatccccctggccctcaccatcaaggggctgaaccccaccgccatcttcctgaccacgctcagccgcacctccaagaagcggagctggcccctgaacgaggcgatcatggccgtgggcatggtctccatcctggccagctccctcctgaagaacgacatcccgatgaccggccccctggtggccgggggcctcctgaccgtgtgctacgtcctgacggggcgcagcgccgacctcgagctggagcgggcggccgacgtgcgctgggaggagcaggccgagatcagcggctccagccccatcctgtccatcaccatcagcgaggacgggtccatgagcatcaagaacgaggaggaggagcagaccctcaccatcctgatccggacgggcctgctcgtgatctccggcctgttccccgtcagcatcccgatcaccgccgccgcgtggtacctgtgggaggtgaagaagcagcgcgccggggtgctctgggacgtccccagcccgccgcccgtgggcaaggccgagctggaggacggggcctaccggatcaagcagaagggcatcctggggtacagccagatcggcgccggcgtgtacaaggaggggaccttccacaccatgtggcacgtcacccgcggcgcggtgctcatgcacaaggggaagcggatcgagccctcctgggccgacgtgaagaaggacctgatcagctacggcgggggctggaagctggagggcgagtggaaggagggggaggaggtccaggtgctcgccctggagcccggcaagaacccgcgcgccgtgcagacgaagcccgggctgttcaagaccaacaccggcaccatcggggccgtctccctcgacttcagccccggcacgtccggcagccccatcgtggacaagaaggggaaggtggtcggcctgtacgggaacggcgtggtgacccggtccggcacctacgtcagcgcgatcgcccagaccgagaagtccatcgaggacaacccggagatcgaggacgacatcttccgcaagaagcggctgacgatcatggacctgcaccccggggccggcaagaccaagcgctacctccccgccatcgtgcgggaggcgatcaagcgcgggctgcggaccctgatcctcgcccccacccgcgtggtcgccgccgagatggaggaggccctgcgcggcctgccgatccggtaccagacgcccgcgatccgcgccgagcacaccgggcgggagatcgtggacctcatgtgccacgccaccttcaccatgcgcctgctgagccccatccgggtgcccaactacaacctcatcatcatggacgaggcccacttcacggacccggccagcatcgcggcccgcggctacatctccacccgggtcgagatgggcgaggccgccgggatcttcatgaccgccacgccgcccggcagccgcgaccccttcccgcagtccaacgcgcccatcatggacgaggagcgggagatccccgagcgcagctggaactccgggcacgagtgggtgacggacttcaagggcaagaccgtgtggttcgtccccagcatcaaggccgggaacgacatcgccgcctgcctgcggaagaacggcaagaaggtgatccagctgtcccgcaagaccttcgacagcgagtacatcaagacccggacgaacgactgggacttcgtggtcaccaccgacatctccgagatgggcgcgaacttcaaggccgagcgcgtgatcgacccgcggcgctgcatgaagcccgtgatcctcaccgacggggaggagcgggtcatcctggccggccccatgcccgtgacgcacagctccgccgcccagcgccgggggcgcgtgggccgcaacccgaagaacgagaacgaccagtacatctacatgggggagcccctggagaacgacgaggactgcgcgcactggaaggaggccaagatgctcctggacaacatcaacacccccgagggcatcatccccagcatgttcgagccggagcgggagaaggtcgacgccatcgacggcgagtaccgcctgcgcggggaggcccgcaagaccttcgtggacctcatgcggcgcggcgacctgcccgtctggctggcctaccgggtggcggccgaggggatcaactacgccgaccgccggtggtgcttcgacggcgtgaagaacaaccagatcctcgaggagaacgtcgaggtggagatctggaccaaggagggggagcgcaagaagctgaagccccggtggctggacgcccgcatctactccgacccgctcgccctgaaggagttcaaggagttcgcggccggccgcaagagcctgacgctcaacctgatcaccgagatgggccggctgcccaccttcatgacccagaaggccaagaacgccctcgacaacctggcggtgctgcacacggccgaggccgggggccgggcctacaaccacgccctctccgagctgcccgagaccctggagaccctcctgctgctcaccctgctggcgacggtcaccgggggcatcttcctcttcctgatgagcggcaaggggatcggcaagatgaccctggggatgtgctgcatcatcaccgcctccatcctcctgtggtacgcccagatccagccccactggatcgccgccagcatcatcctggagttcttcctcatcgtgctgctgatcccggagcccgagaagcagcgcacgccccaggacaaccagctcacgtacgtggtcatcgcgatcctgaccgtggtggccgccaccatggccaacgagatgggcttcctggagaagaccaagaaggacttcgggctcggctccatcacgacccagcagcccgagagcaacatcctggacatcgacctgcggccggccagcgcgtggaccctctacgccgtcgccaccacgttcatcacccccatgctgcgccactccatcgagaacagctccgtgaacgtgagcctgaccgccatcgccaaccaggcgaccgtcctcatgggcctggggaagggctggcccctgtccaagatggacatcggggtgcccctcctggccatcggctgctacagccaggtgaacccgatcacgctgaccgccgccctcctgctgctcgtcgcgcactacgccatcatcgggcccggcctgcaggccaaggccacccgggaggcccagaagcgcgcggccgccggcatcatgaagaaccccaccgtggacgggatgacggtgatcgacctggaccccatcccgtacgaccccaagttcgagaagcagctcggccaggtcatgctgctggtgctctgcgtgacccaggtcctgatgatgcggaccacctgggccctgtgcgaggccctcacgctggcgaccgggcccatctccaccctgtgggagggcaaccccgggcgcttctggaacaccacgatcgccgtgagcatggccaacatcttccgcggctcctacctcgccggcgccgggctgctgttcagcatcatgaagaacaccgcgaacacccggcgcggcaccgggaacacgggcgagaccctcggcgagaagtggaagaaccggctgaacgccctggggaagtccgagttccagatctacaagaagtccggcatccaggaggtggaccgcaccctcgccaaggaggggatcaagcggggcgagaccgaccaccacgccgtctcccgcgggagcgcgaagctgcggtggttcgtggagcgcaacctggtgacgccggagggcaaggtcgtggacctcggctgcgggcggggcgggtggtcctactactgcggcgggctgaagaacgtgaaggaggtcaagggcctgaccaagggcgggcccggccacgaggagcccatccccatgagcacctacgggtggaacctcgtgcgcctgcagtccggcgtggacgtcttcttcaccccgcccgagaagtgcgacacgctgctctgcgacatcggggagagctcccccaaccccaccgtggaggccggccggaccctgcgcgtgctgaacctcgtcgagaactggctgaacaacaacacccagttctgcatcaaggtgctgaacccgtacatgcccagcgtgatcgagaagatggaggccctgcagcggaagtacggcggggccctcgtccgcaaccccctgagccggaactccacccacgagatgtactgggtgagcaacgcctccggcaacatcgtgagctccgtcaacatgatcagccgcatgctgatcaaccggttcacgatgcgccacaagaaggcgacctacgagccggacgtggacctcgggtccggcacccggaacatcgggatcgagagcgagacccccaacctggacatcatcggcaagcgcatcgagaagatcaagcaggagcacgagacgtcctggcactacgaccaggaccacccctacaagacctgggcctaccacggcagctacgagaccaagcagaccgggtccgccagctccatggtgaacggcgtcgtgcgcctgctcacgaagccctgggacgtgatcccgatggtcacccagatggccatgaccgacaccacgcccttcgggcagcagcgggtgttcaaggagaaggtcgacacccgcacccaggagcccaaggagggcaccaagaagctgatgaagatcacggccgagtggctgtggaaggagctcggcaagaagaagacgccccggatgtgcacccgcgaggagttcacccggaaggtgcgcagcaacgcggccctgggggccatcttcacggacgagaacaagtggaagtccgcccgggaggccgtggaggacagcggcttctgggagctggtcgacaaggagcgcaacctccacctggaggggaagtgcgagacctgcgtgtacaacatgatgggcaagcgggagaagaagctgggggagttcggcaaggcgaagggctcccgcgccatctggtacatgtggctcggggcccggttcctggagttcgaggccctgggcttcctcaacgaggaccactggttcagccgcgagaactccctgagcggggtggagggcgaggggctgcacaagctcggctacatcctgcgggacgtcagcaagaaggagggcggggcgatgtacgccgacgacaccgccggctgggacacccgcatcacgctggaggacctcaagaacgaggagatggtgaccaaccacatggagggggagcacaagaagctggccgaggccatcttcaagctgacctaccagaacaaggtggtccgggtgcagcgcccgacgccccggggcaccgtgatggacatcatctcccgccgggaccagcgcgggagcggccaggtcgtgacctacggcctcaacaccttcaccaacatggaggcgcagctgatccggcagatggagggggagggcgtgttcaagtccatccagcagctgacggtcaaggaggagatcgccgtgaagaactggctcatccgcgtggggcgcgagcggctgagccgcatggccatctccggcgacgactgcgtcgtgaagcccctggacgaccggttcgccagcgccctcaccgcgctgaacgacatgggcaaggtgcgcaaggacatccagcagtgggagccctcccgggggtggaacgactggacccaggtcccgttctgcagccaccacttccacgagctgatcatgaaggacggccgcgtgctcgtggtcccctgccggaaccaggacgagctgatcgggcgcgcccggatctcccagggcgccgggtggagcctgcgcgagaccgcctgcctcggcaagtcctacgcccagatgtggagcctgatgtacttccaccggcgcgacctgcggctcgcggccaacgccatctgctccgccgtgcccagccactggatccccacgtcccgcaccacctggagcatccacgccacccacgagtggatgaccacggaggacatgctgaccgtgtggaaccgggtctggatccaggagaacccgtggatggaggacaagacccccgtggagtcctgggaggagatcccctacctgggcaagcgcgaggaccagtggtgcgggagcctcatcggcctgaccagccgggcgacgtgggccaagaacatccagaccgccatcaaccaggtgcgctccctgatcgggaacgaggagtacaccgactacatgcccagcatgaagcggttccgccgcgaggaggaggaggccggcgtcctctggtga

SEQ ID NO: 9076 - RNA, 9876 nt, synthetic construct
  misc_feature 1..9876: note = derived and/or modified CDS sequence (opt1) from DENV-2__KM279528__SS-prME
  source 1..9876: mol_type = other RNA
accgcggggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgagcagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggtccctgcgcccccagccgaccgagctgaagtacagctggaaggcgtggggcaaggccaagatgctctccaccgagctgcacaaccacacgttcctgatcgacggccccgagaccgccgagtgccccaacaccaaccgggcctggaacagcctcgaggtggaggactacgggttcggcgtcttcaccacgaacatctggctgaagctgaaggagcgccaggacgtgttctgcgactccaagctcatgagcgccgcgatcaaggacaaccgggccgtgcacgccgacatggggtactggatcgagtccgccctgaacgacacctggaagatcgagaaggccagcttcatcgaggtcaagtcctgccactggcccaagagccacaccctgtggtccaacggcgtgctcgagagcgagatgatcatccccaagaacttcgcgggccccgtgtcccagcacaactaccgccccgggtaccacacccagaccgccggcccgtggcacctggggcggctggagatggacttcgacttctgcgagggcacgaccgtcgtggtgaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtcaacagcctcgtgacggccggccacgggcagatcgacaacttctccctgggcgtgctgggcatggccctcttcctggaggagatgctgcgcacccgggtcgggaccaagcacgccatcctcctggtggccgtgagcttcgtcaccctgatcacgggcaacatgtccttccgcgacctcgggcgcgtgatggtgatggtcggcgccaccatgaccgacgacatcgggatgggcgtgacctacctggccctgctcgcggccttcaaggtgcggcccacgttcgccgccggcctgctgctccgcaagctgaccagcaaggagctgatgatgaccaccatcgggatcgtcctcctgtcccagagcacgatccccaagtccatcctggagctcaccgacgccctggcgctgggcatgatggtgctcaagatcgtccggaacatggagaagtaccagctggccgtgaccatcatggccatcctgtgcgtgcccaacgccgtcatcctccagaacgcctggaaggtgagctgcaccacgctggcggtggtctccgtgagcccgctgctcctgacctccagccagcagaaggccgactggatccccctggccctcaccatcaaggggctgaaccccaccgccatcttcctgacgaccctctcccgcaccagcaagaagcggtcctggcccctgaacgaggcgatcatggccgtgggcatggtcagcatcctggcctccagcctcctgaagaacgacatcccgatgaccggccccctggtggccgggggcctcctgacggtgtgctacgtcctgaccgggcgcagcgccgacctcgagctggagcgggcggccgacgtgcgctgggaggagcaggccgagatctccggcagctcccccatcctgagcatcaccatctccgaggacgggagcatgtccatcaagaacgaggaggaggagcagaccctcacgatcctgatccggaccggcctgctcgtgatcagcggcctgttccccgtctccatcccgatcaccgccgccgcgtggtacctgtgggaggtgaagaagcagcgcgccggggtgctctgggacgtcccctccccgccgcccgtgggcaaggccgagctggaggacggggcctaccggatcaagcagaagggcatcctggggtactcccagatcggcgccggcgtgtacaaggaggggaccttccacaccatgtggcacgtcacgcgcggcgcggtgctcatgcacaaggggaagcggatcgagcccagctgggccgacgtgaagaaggacctgatctcctacggcgggggctggaagctggagggcgagtggaaggagggggaggaggtccaggtgctcgccctggagcccggcaagaacccgcgcgccgtgcagaccaagcccgggctgttcaagaccaacaccggcacgatcggggccgtcagcctcgacttctcccccggcaccagcggctcccccatcgtggacaagaaggggaaggtggtcggcctgtacgggaacggcgtggtgacccggagcggcacctacgtctccgcgatcgcccagacggagaagtccatcgaggacaacccggagatcgaggacgacatcttccgcaagaagcggctgaccatcatggacctgcaccccggggccggcaagaccaagcgctacctccccgccatcgtgcgggaggcgatcaagcgcgggctgcggaccctgatcctcgcccccacgcgcgtggtcgccgccgagatggaggaggccctgcgcggcctgccgatccggtaccagacccccgcgatccgcgccgagcacaccgggcgggagatcgtggacctcatgtgccacgccaccttcacgatgcgcctgctgagccccatccgggtgcccaactacaacctcatcatcatggacgaggcccacttcaccgacccggcctccatcgcggcccgcggctacatcagcacccgggtcgagatgggcgaggccgccgggatcttcatgaccgccacgccgcccggctcccgcgaccccttcccgcagagcaacgcgcccatcatggacgaggagcgggagatccccgagcgctcctggaacagcgggcacgagtgggtgaccgacttcaagggcaagaccgtgtggttcgtcccctccatcaaggccgggaacgacatcgccgcctgcctgcggaagaacggcaagaaggtgatccagctgagccgcaagaccttcgactccgagtacatcaagacgcggaccaacgactgggacttcgtggtcaccaccgacatcagcgagatgggcgcgaacttcaaggccgagcgcgtgatcgacccgcggcgctgcatgaagcccgtgatcctcacggacggggaggagcgggtcatcctggccggccccatgcccgtgacccactccagcgccgcccagcgccgggggcgcgtgggccgcaacccgaagaacgagaacgaccagtacatctacatgggggagcccctggagaacgacgaggactgcgcgcactggaaggaggccaagatgctcctggacaacatcaacacccccgagggcatcatcccctccatgttcgagccggagcgggagaaggtcgacgccatcgacggcgagtaccgcctgcgcggggaggcccgcaagaccttcgtggacctcatgcggcgcggcgacctgcccgtctggctggcctaccgggtggcggccgaggggatcaactacgccgaccgccggtggtgcttcgacggcgtgaagaacaaccagatcctcgaggagaacgtcgaggtggagatctggacgaaggagggggagcgcaagaagctgaagccccggtggctggacgcccgcatctacagcgacccgctcgccctgaaggagttcaaggagttcgcggccggccggaagtccctgaccctcaacctgatcaccgagatgggccgcctgcccaccttcatgacgcagaaggccaagaacgccctcgacaacctggcggtgctgcacaccgccgaggccgggggccgggcctacaaccacgccctcagcgagctgcccgagaccctggagaccctcctgctgctcacgctgctggcgaccgtcaccgggggcatcttcctcttcctgatgtccggcaaggggatcggcaagatgaccctggggatgtgctgcatcatcaccgccagcatcctcctgtggtacgcccagatccagccccactggatcgccgcctccatcatcctggagttcttcctcatcgtgctgctgatcccggagcccgagaagcagcgcacgccccaggacaaccagctcacctacgtggtcatcgcgatcctgaccgtggtggccgccaccatggccaacgagatgggcttcctggagaagacgaagaaggacttcgggctcggcagcatcaccacccagcagcccgagagcaacatcctggacatcgacctgcggccggcctccgcgtggaccctctacgccgtcgccacgaccttcatcacccccatgctgcgccacagcatcgagaactccagcgtgaacgtgtccctgaccgccatcgccaaccaggcgacggtcctcatgggcctggggaagggctggcccctgagcaagatggacatcggggtgcccctcctggccatcggctgctactcccaggtgaacccgatcaccctgaccgccgccctcctgctgctcgtcgcgcactacgccatcatcgggcccggcctgcaggccaaggccacccgggaggcccagaagcgcgcggccgccggcatcatgaagaaccccacggtggacgggatgaccgtgatcgacctggaccccatcccgtacgaccccaagttcgagaagcagctcggccaggtcatgctgctggtgctctgcgtgacccaggtcctgatgatgcggaccacgtgggccctgtgcgaggccctcaccctggcgaccgggcccatcagcaccctgtgggagggcaaccccgggcgcttctggaacacgaccatcgccgtgtccatggccaacatcttccgcggcagctacctcgccggcgccgggctgctgttctccatcatgaagaacaccgcgaacacccggcgcggcacggggaacaccggcgagaccctcggcgagaagtggaagaaccggctgaacgccctgggcaagagcgagttccagatctacaagaagtccggcatccaggaggtggaccgcaccctcgccaaggaggggatcaagcggggcgagacggaccaccacgccgtcagccgcgggtccgcgaagctgcggtggttcgtggagcgcaacctggtgaccccggagggcaaggtcgtggacctcggctgcgggcggggcgggtggagctactactgcggcgggctgaagaacgtgaaggaggtcaagggcctgaccaagggcgggcccggccacgaggagcccatccccatgtccacctacgggtggaacctcgtgcgcctgcagagcggcgtggacgtcttcttcacgccgcccgagaagtgcgacaccctgctctgcgacatcggggagtccagccccaaccccaccgtggaggccggccggaccctgcgcgtgctgaacctcgtcgagaactggctgaacaacaacacccagttctgcatcaaggtgctgaacccgtacatgcccagcgtgatcgagaagatggaggccctgcagcggaagtacggcggggccctcgtccgcaaccccctgtcccggaacagcacgcacgagatgtactgggtgtccaacgccagcggcaacatcgtgtccagcgtcaacatgatctcccgcatgctgatcaaccggttcaccatgcgccacaagaaggcgacctacgagccggacgtggacctcgggagcggcacccggaacatcgggatcgagtccgagacgcccaacctggacatcatcggcaagcgcatcgagaagatcaagcaggagcacgagaccagctggcactacgaccaggaccacccctacaagacctgggcctaccacggctcctacgagaccaagcagacggggagcgcctccagcatggtgaacggcgtcgtgcgcctgctcaccaagccctgggacgtgatcccgatggtcacccagatggccatgaccgacacgacccccttcgggcagcagcgggtgttcaaggagaaggtcgacacccgcacccaggagcccaaggagggcacgaagaagctgatgaagatcaccgccgagtggctgtggaaggagctcggcaagaagaagacgccccggatgtgcacccgcgaggagttcacgcggaaggtgcgctccaacgcggccctgggggccatcttcaccgacgagaacaagtggaagtccgcccgggaggccgtggaggactccggcttctgggagctggtcgacaaggagcgcaacctccacctggaggggaagtgcgagacctgcgtgtacaacatgatgggcaagcgggagaagaagctgggggagttcggcaaggcgaagggcagccgcgccatctggtacatgtggctcggggcccggttcctggagttcgaggccctgggcttcctcaacgaggaccactggttctcccgcgagaacagcctgagcggggtggagggcgaggggctgcacaagctcggctacatcctgcgggacgtctccaagaaggagggcggggcgatgtacgccgacgacaccgccggctgggacacgcgcatcaccctggaggacctcaagaacgaggagatggtgaccaaccacatggagggggagcacaagaagctggccgaggccatcttcaagctgacctaccagaacaaggtggtccgggtgcagcgcccgacgccccggggcaccgtgatggacatcatcagccgccgggaccagcgcgggtccggccaggtcgtgacctacggcctcaacaccttcacgaacatggaggcgcagctgatccggcagatggagggggagggcgtgttcaagagcatccagcagctgaccgtcaaggaggagatcgccgtgaagaactggctcatccgcgtggggcgcgagcggctgtcccgcatggccatcagcggcgacgactgcgtcgtgaagcccctggacgaccggttcgcctccgccctcaccgcgctgaacgacatgggcaaggtgcgcaaggacatccagcagtgggagcccagccgggggtggaacgactggacccaggtcccgttctgctcccaccacttccacgagctgatcatgaaggacggccgcgtgctcgtggtcccctgccggaaccaggacgagctgatcgggcgcgcccggatcagccagggcgccgggtggtccctgcgcgagacggcctgcctcggcaagagctacgcccagatgtggtccctgatgtacttccaccggcgcgacctgcggctcgcggccaacgccatctgcagcgccgtgccctcccactggatccccaccagccgcaccacctggtccatccacgccacccacgagtggatgacgaccgaggacatgctgaccgtgtggaaccgggtctggatccaggagaacccgtggatggaggacaagacccccgtggagagctgggaggagatcccctacctgggcaagcgcgaggaccagtggtgcgggagcctcatcggcctgacgtcccgggcgacctgggccaagaacatccagaccgccatcaaccaggtgcgcagcctgatcgggaacgaggagtacaccgactacatgccctccatgaagcggttccgccgcgaggaggaggaggccggcgtcctctggtga

SEQ ID NO: 9077 - RNA, 9876 nt, synthetic construct
  misc_feature 1..9876: note = derived and/or modified CDS sequence (opt1) from DENV-2__KM279533__SS-prME
  source 1..9876: mol_type = other RNA
accgcggggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgagcagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggtccctgcgcccccagccgaccgagctgaagtacagctggaaggcgtggggcaaggccaagatgctctccaccgagctgcacaaccacacgttcctgatcgacggccccgagaccgccgagtgccccaacaccaaccgggcctggaacagcctcgaggtggaggactacgggttcggcgtcttcaccacgaacatctggctgaagctgaaggagcgccaggacgtgttctgcgactccaagctcatgagcgccgcgatcaaggacaaccgggccgtgcacgccgacatggggtactggatcgagtccgccctgaacgacacctggaagatcgagaaggccagcttcatcgaggtcaagtcctgccactggcccaagagccacaccctgtggtccaacggcgtgctcgagagcgagatgatcatccccaagaacttcgcgggccccgtgtcccagcacaactaccgccccgggtaccacacccagaccgccggcccgtggcacctggggcggctggagatggacttcgacttctgcgagggcacgaccgtcgtggtgaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtcaacagcctcgtgacggccggccacgggcagatcgacaacttctccctgggcgtgctgggcatggccctcttcctggaggagatgctgcgcacccgggtcgggaccaagcacgccatcctcctggtggccgtgagcttcgtcaccctgatcacgggcaacatgtccttccgcgacctcgggcgcgtgatggtgatggtcggcgccaccatgaccgacgacatcgggatgggcgtgacctacctggccctgctcgcggccttcaaggtgcggcccacgttcgccgccggcctgctgctccgcaagctgaccagcaaggagctgatgatgaccaccatcgggatcgtcctcctgtcccagagcacgatccccgagtccatcctggagctcaccgacgccctggcgctgggcatgatggtgctcaagatcgtccggaacatggagaagtaccagctggccgtgaccatcatggccatcctgtgcgtgcccaacgccgtcatcctccagaacgcctggaaggtgagctgcaccacgctggcggtggtctccgtgagcccgctgctcctgacctccagccagcagaaggccgactggatccccctggccctcaccatcaaggggctgaaccccaccgccatcttcctgacgaccctctcccgcaccagcaagaagcggtcctggcccctgaacgaggcgatcatggccgtgggcatggtcagcatcctggcctccagcctcctgaagaacgacatcccgatgaccggccccctggtggccgggggcctcctgacggtgtgctacgtcctgaccgggcgcagcgccgacctcgagctggagcgggcggccgacgtgcgctgggaggagcaggccgagatctccggcagctcccccatcctgagcatcaccatctccgaggacgggagcatgtccatcaagaacgaggaggaggagcagaccctcacgatcctgatccggaccggcctgctcgtgatcagcggcctgttccccgtctccatcccgatcaccgccgccgcgtggtacctgtgggaggtgaagaagcagcgcgccggggtgctctgggacgtcccctccccgccgcccgtgggcaaggccgagctggaggacggggcctaccggatcaagcagaagggcatcctggggtactcccagatcggcgccggcgtgtacaaggaggggaccttccacaccatgtggcacgtcacgcgcggcgcggtgctcatgcacaaggggaagcggatcgagcccagctgggccgacgtgaagaaggacctgatctcctacggcgggggctggaagctggagggcgagtggaaggagggggaggaggtccaggtgctcgccctggagcccggcaagaacccgcgcgccgtgcagaccaagcccgggctgttcaagaccaacaccggcacgatcggggccgtcagcctcgacttctcccccggcaccagcggctcccccatcgtggacaagaaggggaaggtggtcggcctgtacgggaacggcgtggtgacccggagcggcacctacgtctccgcgatcgcccagacggagaagtccatcgaggacaacccggagatcgaggacgacatcttccgcaagaagcggctgaccatcatggacctgcaccccggggccggcaagaccaagcgctacctccccgccatcgtgcgggaggcgatcaagcgcgggctgcggaccctgatcctcgcccccacgcgcgtggtcgccgccgagatggaggaggccctgcgcggcctgccgatccggtaccagacccccgcgatccgcgccgagcacaccgggcgggagatcgtggacctcatgtgccacgccaccttcacgatgcgcctgctgagccccatccgggtgcccaactacaacctcatcatcatggacgaggcccacttcaccgacccggcctccatcgcggcccgcggctacatcagcacccgggtcgagatgggcgaggccgccgggatcttcatgaccgccacgccgcccggctcccgcgaccccttcccgcagagcaacgcgcccatcatggacgaggagcgggagatccccgagcgctcctggaacagcgggcacgagtgggtgaccgacttcaagggcaagaccgtgtggttcgtcccctccatcaaggccgggaacgacatcgccgcctgcctgcggaagaacggcaagaaggtgatccagctgagccgcaagaccttcgactccgagtacatcaagacgcggaccaacgactgggacttcgtggtcaccaccgacatcagcgagatgggcgcgaacttcaaggccgagcgcgtgatcgacccgcggcgctgcatgaagcccgtgatcctcacggacggggaggagcgggtcatcctggccggccccatgcccgtgacccactccagcgccgcccagcgccgggggcgcgtgggccgcaacccgaagaacgagaacgaccagtacatctacatgggggagcccctggagaacgacgaggactgcgcgcactggaaggaggccaagatgctcctggacaacatcaacacccccgagggcatcatcccctccatgttcgagccggagcgggagaaggtcgacgccatcgacggcgagtaccgcctgcgcggggaggcccgcaagaccttcgtggacctcatgcggcgcggcgacctgcccgtctggctggcctaccgggtggcggccgaggggatcaactacgccgaccgccggtggtgcttcgacggcgtgaagaacaaccagatcctcgaggagaacgtcgaggtggagatctggacgaaggagggggagcgcaagaagctgaagccccggtggctggacgcccgcatctacagcgacccgctcgccctgaaggagttcaaggagttcgcggccggccggaagtccctgaccctcaacctgatcaccgagatgggccgcctgcccaccttcatgacgcagaaggccaagaacgccctcgacaacctggcggtgctgcacaccgccgaggccgggggccgggcctacaaccacgccctcagcgagctgcccgagaccctggagaccctcctgctgctcacgctgctggcgaccgtcaccgggggcatcttcctcttcctgatgtccggcaaggggatcggcaagatgaccctggggatgtgctgcatcatcaccgccagcatcctcctgtggtacgcccagatccagccccactggatcgccgcctccatcatcctggagttcttcctcatcgtgctgctgatcccggagcccgagaagcagcgcacgccccaggacaaccagctcacctacgtggtcatcgcgatcctgaccgtggtggccgccaccatggccaacgagatgggcttcctggagaagacgaagaaggacttcgggctcggcagcatcaccacccagcagcccgagagcaacatcctggacatcgacctgcggccggcctccgcgtggaccctctacgccgtcgccacgaccttcatcacccccatgctgcgccacagcatcgagaactccagcgtgaacgtgtccctgaccgccatcgccaaccaggcgacggtcctcatgggcctggggaagggctggcccctgagcaagatggacatcggggtgcccctcctggccatcggctgctactcccaggtgaacccgatcaccctgaccgccgccctcctgctgctcgtcgcgcactacgccatcatcgggcccggcctgcaggccaaggccacccgggaggcccagaagcgcgcggccgccggcatcatgaagaaccccacggtggacgggatgaccgtgatcgacctggaccccatcccgtacgaccccaagttcgagaagcagctcggccaggtcatgctgctggtgctctgcgtgacccaggtcctgatgatgcggaccacgtgggccctgtgcgaggccctcaccctggcgaccgggcccatcagcaccctgtgggagggcaaccccgggcgcttctggaacacgaccatcgccgtgtccatggccaacatcttccgcggcagctacctcgccggcgccgggctgctgttctccatcatgaagaacaccgcgaacacccggcgcggcacggggaacaccggcgagaccctcggcgagaagtggaagaaccggctgaacgccctgggcaagagcgagttccagatctacaagaagtccggcatccaggaggtggaccgcaccctcgccaaggaggggatcaagcggggcgagacggaccaccacgccgtcagccgcgggtccgcgaagctgcggtggttcgtggagcgcaacctggtgaccccggagggcaaggtcgtggacctcggctgcgggcggggcgggtggagctactactgcggcgggctgaagaacgtgaaggaggtcaagggcctgaccaagggcgggcccggccacgaggagcccatccccatgtccacctacgggtggaacctcgtgcgcctgcagagcggcgtggacgtcttcttcacgccgcccgagaagtgcgacaccctgctctgcgacatcggggagtccagccccaaccccaccgtggaggccggccggaccctgcgcgtgctgaacctcgtcgagaactggctgaacaacaacacccagttctgcatcaaggtgctgaacccgtacatgcccagcgtgatcgagaagatggaggccctgcagcggaagtacggcggggccctcgtccgcaaccccctgtcccggaacagcacgcacgagatgtactgggtgtccaacgccagcggcaacatcgtgtccagcgtcaacatgatctcccgcatgctgatcaaccggttcaccatgcgccacaagaaggcgacctacgagccggacgtggacctcgggagcggcacccggaacatcgggatcgagtccgagacgcccaacctggacatcatcggcaagcgcatcgagaagatcaagcaggagcacgagaccagctggcactacgaccaggaccacccctacaagacctgggcctaccacggctcctacgagaccaagcagacggggagcgcctccagcatggtgaacggcgtcgtgcgcctgctcaccaagccctgggacgtgatcccgatggtcacccagatggccatgaccgacacgacccccttcgggcagcagcgggtgttcaaggagaaggtcgacacccgcacccaggagcccaaggagggcacgaagaagctgatgaagatcaccgccgagtggctgtggaaggagctcggcaagaagaagacgccccggatgtgcacccgcgaggagttcacgcggaaggtgcgctccaacgcggccctgggggccatcttcaccgacgagaacaagtggaagtccgcccgggaggccgtggaggactccggcttctgggagctggtcgacaaggagcgcaacctccacctggaggggaagtgcgagacctgcgtgtacaacatgatgggcaagcgggagaagaagctgggggagttcggcaaggcgaagggcagccgcgccatctggtacatgtggctcggggcccggttcctggagttcgaggccctgggcttcctcaacgaggaccactggttctcccgcgagaacagcctgagcggggtggagggcgaggggctgcacaagctcggctacatcctgcgggacgtctccaagaaggagggcggggcgatgtacgccgacgacaccgccggctgggacacgcgcatcaccctggaggacctcaagaacgaggagatggtgaccaaccacatggagggggagcacaagaagctggccgaggccatcttcaagctgacctaccagaacaaggtggtccgggtgcagcgcccgacgccccggggcaccgtgatggacatcatcagccgccgggaccagcgcgggtccggccaggtcgtgacctacggcctcaacaccttcacgaacatggaggcgcagctgatccggcagatggagggggagggcgtgttcaagagcatccagcagctgaccgtcaaggaggagatcgccgtgaagaactggctcatccgcgtggggcgcgagcggctgtcccgcatggccatcagcggcgacgactgcgtcgtgaagcccctggacgaccggttcgcctccgccctcaccgcgctgaacgacatgggcaaggtgcgcaaggacatccagcagtgggagcccagccgggggtggaacgactggacccaggtcccgttctgctcccaccacttccacgagctgatcatgaaggacggccgcgtgctcgtggtcccctgccggaaccaggacgagctgatcgggcgcgcccggatcagccagggcgccgggtggtccctgcgcgagacggcctgcctcggcaagagctacgcccagatgtggtccctgatgtacttccaccggcgcgacctgcggctcgcggccaacgccatctgcagcgccgtgccctcccactggatccccaccagccgcaccacctggtccatccacgccacccacgagtggatgacgaccgagaacatgctgaccgtgtggaaccgggtctggatccaggagaacccgtggatggaggacaagacccccgtggagagctgggaggagatcccctacctgggcaagcgcgaggaccagtggtgcgggagcctcatcggcctgacgtcccgggcgacctgggccaagaacatccagaccgccatcaaccaggtgcgcagcctgatcgggaacgaggagtacaccgactacatgccctccatgaagcggttccgccgcgaggaggaggaggccggcgtcctctggtga

SEQ ID NO: 9078 - RNA, 9876 nt, synthetic construct
  misc_feature 1..9876: note = derived and/or modified CDS sequence (opt1) from DENV-2__KM279535__SS-prME
  source 1..9876: mol_type = other RNA
accgcgggcatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggtccctgcgcccccagccgaccgagctgaagtacagctggaaggcgtggggcaaggccaagatgctctccaccgagctgcacaaccacacgttcctgatcgacggccccgagaccgccgagtgccccaacaccaaccgggcctggaacagcctcgaggtggaggactacgggttcggcgtcttcaccacgaacatctggctgaagctgaaggagcgccaggacgtgttctgcgactccaagctcatgagcgccgcgatcaaggacaaccgggccgtgcacgccgacatggggtactggatcgagtccgccctgaacgacacctggaagatcgagaaggccagcttcatcgaggtcaagtcctgccactggcccaagagccacaccctgtggtccaacggcgtgctcgagagcgagatgatcatccccaagaacttcgcgggccccgtgtcccagcacaactaccgccccgggtaccacacccagaccgccggcccgtggcacctggggcggctggagatggacttcgacttctgcgagggcacgaccgtcgtggtgaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtcaacagcctcgtgacggccggccacgggcagatcgacaacttctccctgggcgtgctgggcatggccctcttcctggaggagatgctgcgcacccgggtcgggaccaagcacgccatcctcctggtggccgtgagcttcgtcaccctgatcacgggcaacatgtccttccgcgacctcgggcgcgtgatggtgatggtcggcgccaccatgaccgacgacatcgggatgggcgtgacctacctggccctgctcgcggccttcaaggtgcggcccacgttcgccgccggcctgctgctccgcaagctgaccagcaaggagctgatgatgaccaccatcgggatcgtcctcctgtcccagagcacgatccccgagtccatcctggagctcaccgacgccctggcgctgggcatgatggtgctcaagatcgtccggaacatggagaagtaccagctggccgtgaccatcatggccatcagctgcgtgcccaacgccgtcatcctgcagaacgcctggaaggtgtcctgcaccacgctcgcggtggtcagcgtgtccccgctgctgctcaccagctcccagcagaaggccgactggatccccctggccctgaccatcaaggggctcaaccccaccgccatcttcctgacgaccctgagccgcacctccaagaagcggagctggcccctcaacgaggcgatcatggccgtgggcatggtctccatcctggccagcagcctgctcaagaacgacatcccgatgaccggccccctggtggccgggggcctgctcacggtgtgctacgtcctgaccgggcgctccgccgacctggagctcgagcgggcggccgacgtgcgctgggaggagcaggccgagatcagcggctccagccccatcctgtccatcaccatcagcgaggacgggtccatgagcatcaagaacgaggaggaggagcagaccctgacgatcctcatccggaccggcctgctggtgatctccggcctcttccccgtcagcatcccgatcaccgccgccgcgtggtacctgtgggaggtgaagaagcagcgcgccggggtgctgtgggacgtccccagcccgccgcccgtgggcaaggccgagctcgaggacggggcctaccggatcaagcagaagggcatcctggggtacagccagatcggcgccggcgtgtacaaggaggggaccttccacaccatgtggcacgtcacgcgcggcgcggtgctgatgcacaaggggaagcggatcgagccctcctgggccgacgtgaagaaggacctcatcagctacggcgggggctggaagctggagggcgagtggaaggagggggaggaggtccaggtgctggccctcgagcccggcaagaacccgcgcgccgtgcagaccaagcccgggctgttcaagaccaacaccggcacgatcggggccgtctccctggacttcagccccggcacctccggcagccccatcgtggacaagaaggggaaggtggtcggcctctacgggaacggcgtggtgacccggtccggcacctacgtcagcgcgatcgcccagacggagaagtccatcgaggacaacccggagatcgaggacgacatcttccgcaagaagcggctgaccatcatggacctgcaccccggggccggcaagaccaagcgctacctgcccgccatcgtgcgggaggcgatcaagcgcgggctccggaccctgatcctggcccccacgcgcgtggtcgccgccgagatggaggaggccctccgcggcctgccgatccggtaccagacccccgcgatccgcgccgagcacaccgggcgggagatcgtggacctgatgtgccacgccaccttcacgatgcgcctcctgagccccatccgggtgcccaactacaacctgatcatcatggacgaggcccacttcaccgacccggccagcatcgcggcccgcggctacatctccacccgggtcgagatgggcgaggccgccgggatcttcatgaccgccacgccgcccggcagccgcgaccccttcccgcagtccaacgcgcccatcatggacgaggagcgggagatccccgagcgcagctggaactccgggcacgagtgggtgaccgacttcaagggcaagaccgtgtggttcgtccccagcatcaaggccgggaacgacatcgccgcctgcctccggaagaacggcaagaaggtgatccagctgtcccgcaagaccttcgacagcgagtacatcaagacgcggaccaacgactgggacttcgtggtcaccaccgacatctccgagatgggcgcgaacttcaaggccgagcgcgtgatcgacccgcggcgctgcatgaagcccgtgatcctgacggacggggaggagcgggtcatcctcgccggccccatgcccgtgacccacagctccgccgcccagcgccgggggcgcgtgggccgcaacccgaagaacgagaacgaccagtacatctacatgggggagcccctggagaacgacgaggactgcgcgcactggaaggaggccaagatgctgctcgacaacatcaacacccccgagggcatcatccccagcatgttcgagccggagcgggagaaggtcgacgccatcgacggcgagtaccgcctgcgcggggaggcccgcaagaccttcgtggacctgatgcggcgcggcgacctccccgtctggctggcctaccgggtggcggccgaggggatcaactacgccgaccgccggtggtgcttcgacggcgtgaagaacaaccagatcctggaggagaacgtcgaggtggagatctggacgaaggagggggagcgcaagaagctcaagccccggtggctggacgcccgcatctactccgacccgctggccctcaaggagttcaaggagttcgcggccggccggaagtccctgaccctgaacctcatcaccgagatgggccgcctgcccaccttcatgacgcagaaggccaagaacgccctggacaacctcgcggtgctgcacaccgccgaggccgggggccgggcctacaaccacgccctgtccgagctccccgagaccctggagaccctgctcctgctgacgctcctggcgaccgtcaccgggggcatcttcctgttcctcatgagcggcaaggggatcggcaagatgaccctggggatgtgctgcatcatcaccgcctccatcctgctctggtacgcccagatccagccccactggatcgccgccagcatcatcctggagttcttcctgatcgtgctcctgatcccggagcccgagaagcagcgcacgccccaggacaaccagctgacctacgtggtcatcgcgatcctcaccgtggtggccgccaccatggccaacgagatgggcttcctggagaagacgaagaaggacttcgggctgggcagcatcaccacccagcagcccgagtccaacatcctcgacatcgacctgcggccggccagcgcgtggaccctgtacgccgtcgccacgaccttcatcacccccatgctccgccactccatcgagaacagctccgtgaacgtgagcctgaccgccatcgccaaccaggcgacggtcctgatgggcctcgggaagggctggcccctgtccaagatggacatcggggtgcccctgctcgccatcggctgctacagccaggtgaacccgatcaccctgaccgccgccctgctcctgctggtcgcgcactacgccatcatcgggcccggcctccaggccaaggccacccgggaggcccagaagcgcgcggccgccggcatcatgaagaaccccacggtggacgggatgaccgtgatcgacctggaccccatcccgtacgaccccaagttcgagaagcagctgggccaggtcatgctcctggtgctgtgcgtgacccaggtcctcatgatgcggaccacgtgggccctgtgcgaggccctgaccctcgcgaccgggcccatctccaccctgtgggagggcaaccccgggcgcttctggaacacgaccatcgccgtgagcatggccaacatcttccgcggctcctacctggccggcgccgggctcctgttcagcatcatgaagaacaccgcgaacacccggcgcggcacggggaacaccggcgagaccctgggcgagaagtggaagaaccggctcaacgccctggggaagtccgagttccagatctacaagaagtccggcatccaggaggtggaccgcaccctggccaaggaggggatcaagcggggcgagacggaccaccacgccgtctcccgcgggagcgcgaagctccggtggttcgtggagcgcaacctggtgaccccggagggcaaggtcgtggacctgggctgcgggcggggcgggtggtcctactactgcggcgggctcaagaacgtgaaggaggtcaagggcctgaccaagggcgggcccggccacgaggagcccatccccatgagcacctacgggtggaacctggtgcgcctccagtccggcgtggacgtcttcttcacgccgcccgagaagtgcgacaccctgctgtgcgacatcggggagagcagccccaaccccaccgtggaggccggccggaccctccgcgtgctgaacctggtcgagaactggctcaacaacaacacccagttctgcatcaaggtgctgaacccgtacatgccctccgtgatcgagaagatggaggccctgcagcggaagtacggcggggccctggtccgcaaccccctcagccggaactccacgcacgagatgtactgggtgagcaacgcctccggcaacatcgtgagctccgtcaacatgatcagccgcatgctgatcaaccggttcaccatgcgccacaagaaggcgacctacgagccggacgtggacctggggtccggcacccggaacatcgggatcgagagcgagacgcccaacctcgacatcatcggcaagcgcatcgagaagatcaagcaggagcacgagacctcctggcactacgaccaggaccacccctacaagacctgggcctaccacggcagctacgagaccaagcagacggggtccgccagctccatggtgaacggcgtcgtgcgcctgctgaccaagccctgggacgtgatcccgatggtcacccagatggccatgaccgacacgacccccttcgggcagcagcgggtgttcaaggagaaggtcgacacccgcacccaggagcccaaggagggcacgaagaagctcatgaagatcaccgccgagtggctgtggaaggagctgggcaagaagaagacgccccggatgtgcacccgcgaggagttcacgcggaaggtgcgcagcaacgcggccctcggggccatcttcaccgacgagaacaagtggaagtccgcccgggaggccgtggaggacagcggcttctgggagctggtcgacaaggagcgcaacctgcacctcgaggggaagtgcgagacctgcgtgtacaacatgatgggcaagcgggagaagaagctgggggagttcggcaaggcgaagggctcccgcgccatctggtacatgtggctgggggcccggttcctcgagttcgaggccctgggcttcctgaacgaggaccactggttcagccgcgagaacagcctctccggggtggagggcgaggggctgcacaagctgggctacatcctccgggacgtcagcaagaaggagggcggggcgatgtacgccgacgacaccgccggctgggacacgcgcatcaccctggaggacctgaagaacgaggagatggtgaccaaccacatggagggggagcacaagaagctcgccgaggccatcttcaagctgacctaccagaacaaggtggtccgggtgcagcgcccgacgccccggggcaccgtgatggacatcatctcccgccgggaccagcgcgggagcggccaggtcgtgacctacggcctgaacaccttcacgaacatggaggcgcagctcatccggcagatggagggggagggcgtgttcaagtccatccagcagctgaccgtcaaggaggagatcgccgtgaagaactggctgatccgcgtggggcgcgagcggctcagccgcatggccatctccggcgacgactgcgtcgtgaagcccctggacgaccggttcgccagcgccctgaccgcgctcaacgacatgggcaaggtgcgcaaggacatccagcagtgggagccctcccgggggtggaacgactggacccaggtcccgttctgcagccaccacttccacgagctgatcatgaaggacggccgcgtgctggtggtcccctgccggaaccaggacgagctcatcgggcgcgcccggatctcccagggcgccgggtggagcctgcgcgagacggcctgcctgggcaagtcctacgcccagatgtggagcctcatgtacttccaccggcgcgacctgcggctggcggccaacgccatctgctccgccgtgcccagccactggatccccacctcccgcaccacctggagcatccacgccacccacgagtggatgacgaccgaggacatgctcaccgtgtggaaccgggtctggatccaggagaacccgtggatggaggacaagacccccgtggagagctgggaggagatcccctacctgggcaagcgcgaggaccagtggtgcgggtccctgatcggcctcacgagccgggcgacctgggccaagaacatccagaccgccatcaaccaggtgcgctccctgatcgggaacgaggagtacaccgactacatgcccagcatgaagcggttccgccgcgaggaggaggaggccggcgtcctgtggtga

SEQ ID NO: 9079 - RNA, 9876 nt, synthetic construct
  misc_feature 1..9876: note = derived and/or modified CDS sequence (opt1) from DENV-2__KM279539__SS-prME
  source 1..9876: mol_type = other RNA
accgcggggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggtccctgcgcccccagccgaccgagctgaagtacagctggaaggcgtggggcaaggccaagatgctctccaccgagctgcacaaccacacgttcctgatcgacggccccgagaccgccgagtgccccaacaccaaccgggcctggaacagcctcgaggtggaggactacgggttcggcgtcttcaccacgaacatctggctgaagctgaaggagcgccaggacgtgttctgcgactccaagctcatgagcgccgcgatcaaggacaaccgggccgtgcacgccgacatggggtactggatcgagtccgccctgaacgacacctggaagatcgagaaggccagcttcatcgaggtcaagtcctgccactggcccaagagccacaccctgtggtccaacggcgtgctcgagagcgagatgatcatccccaagaacttcgcgggccccgtgtcccagcacaactaccgccccgggtaccacacccagaccgccggcccgtggcacctggggcggctggagatggacttcgacttctgcgagggcacgaccgtcgtggtgaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtcaacagcctcgtgacggccggccacgggcagatcgacaacttctccctgggcgtgctgggcatggccctcttcctggaggagatgctgcgcacccgggtcgggaccaagcacgccatcctcctggtggccgtgagcttcgtcaccctgatcacgggcaacatgtccttccgcgacctcgggcgcgtgatggtgatggtcggcgccaccatgaccgacgacatcgggatgggcgtgacctacctggccctgctcgcggccttcaaggtgcggcccacgttcgccgccggcctgctgctccgcaagctgaccagcaaggagctgatgatgaccaccatcgggatcgtcctcctgtcccagagcacgatccccgagtccatcctggagctcaccgacgccctggcgctgggcatgatggtgctcaagatcgtccggaacatggagaagtaccagctggccgtgaccatcatggccatcctgtgcgtgcccaacgccgtcatcctccagaacgcctggaaggtgagctgcaccacgctggcggtggtctccgtgagcccgctgctcctgacctccagccagcagaaggccgactggatccccctggccctcaccatcaaggggctgaaccccaccgccatcttcctgacgaccctctcccgcaccagcaagaagcggtcctggcccctgaacgaggcgatcatggccgtgggcatggtcagcatcctggcctccagcctcctgaagaacgacatcccgatgaccggccccctggtggccgggggcctcctgacggtgtgctacgtcctgaccgggcgcagcgccgacctcgagctggagcgggcggccgacgtgcgctgggaggagcaggccgagatctccggcagctcccccatcctgagcatcaccatctccgaggacgggagcatgtccatcaagaacgaggaggaggagcagaccctcacgatcctgatccggaccggcctgctcgtgatcagcggcctgttccccgtctccatcccgatcaccgccgccgcgtggtacctgtgggaggtgaagaagcagcgcgccggggtgctctgggacgtcccctccccgccgcccgtgggcaaggccgagctggaggacggggcctaccggatcaagcagaagggcatcctggggtactcccagatcggcgccggcgtgtacaaggaggggaccttccacaccatgtggcacgtcacgcgcggcgcggtgctcatgcacaaggggaagcggatcgagcccagctgggccgacgtgaagaaggacctgatctcctacggcgggggctggaagctggagggcgagtggaaggagggggaggaggtccaggtgctcgccctggagcccggcaagaacccgcgcgccgtgcagaccaagcccgggctgttcaagaccaacaccggcacgatcggggccgtcagcctcgacttctcccccggcaccagcggctcccccatcgtggacaagaaggggaaggtggtcggcctgtacgggaacggcgtggtgacccggagcggcacctacgtctccgcgatcgcccagacggaggagagcatcgaggacaacccggagatcgaggacgacatcttccgcaagaagcggctgaccatcatggacctgcaccccggggccggcaagaccaagcgctacctccccgccatcgtgcgggaggcgatcaagcgcgggctgcggaccctgatcctcgcccccacgcgcgtggtcgccgccgagatggaggaggccctgcgcggcctgccgatccggtaccagacccccgcgatccgcgccgagcacaccgggcgggagatcgtggacctcatgtgccacgccaccttcacgatgcgcctgctgagccccatccgggtgcccaactacaacctcatcatcatggacgaggcccacttcaccgacccggcctccatcgcggcccgcggctacatcagcacccgggtcgagatgggcgaggccgccgggatcttcatgaccgccacgccgcccggctcccgcgaccccttcccgcagagcaacgcgcccatcatggacgaggagcgggagatccccgagcgctcctggaacagcgggcacgagtgggtgaccgacttcaagggcaagaccgtgtggttcgtcccctccatcaaggccgggaacgacatcgccgcctgcctgcggaagaacggcaagaaggtgatccagctgagccgcaagaccttcgactccgagtacatcaagacgcggaccaacgactgggacttcgtggtcaccaccgacatcagcgagatgggcgcgaacttcaaggccgagcgcgtgatcgacccgcggcgctgcatgaagcccgtgatcctcacggacggggaggagcgggtcatcctggccggccccatgcccgtgacccactccagcgccgcccagcgccgggggcgcgtgggccgcaacccgaagaacgagaacgaccagtacatctacatgggggagcccctggagaacgacgaggactgcgcgcactggaaggaggccaagatgctcctggacaacatcaacacccccgagggcatcatcccctccatgttcgagccggagcgggagaaggtcgacgccatcgacggcgagtaccgcctgcgcggggaggcccgcaagaccttcgtggacctcatgcggcgcggcgacctgcccgtctggctggcctaccgggtggcggccgaggggatcaactacgccgaccgccggtggtgcttcgacggcgtgaagaacaaccagatcctcgaggagaacgtcgaggtggagatctggacgaaggagggggagcgcaagaagctgaagccccggtggctggacgcccgcatctacagcgacccgctcgccctgaaggagttcaaggagttcgcggccggccggaagtccctgaccctcaacctgatcaccgagatgggccgcctgcccaccttcatgacgcagaaggccaagaacgccctcgacaacctggcggtgctgcacaccgccgaggccgggggccgggcctacaaccacgccctcagcgagctgcccgagaccctggagaccctcctgctgctcacgctgctggcgaccgtcaccgggggcatcttcctcttcctgatgtccggcaaggggatcggcaagatgaccctggggatgtgctgcatcatcaccgccagcatcctcctgtggtacgcccagatccagccccactggatcgccgcctccatcatcctggagttcttcctcatcgtgctgctgatcccggagcccgagaagcagcgcacgccccaggacaaccagctcacctacgtggtcatcgcgatcctgaccgtggtggccgccaccatggccaacgagatgggcttcctggagaagacgaagaaggacttcgggctcggcagcatcaccacccagcagcccgagagcaacatcctggacatcgacctgcggccggcctccgcgtggaccctctacgccgtcgccacgaccttcatcacccccatgctgcgccacagcatcgagaactccagcgtgaacgtgtccctgaccgccatcgccaaccaggcgacggtcctcatgggcctggggaagggctggcccctgagcaagatggacatcggggtgcccctcctggccatcggctgctactcccaggtgaacccgatcaccctgaccgccgccctcctgctgctcgtcgcgcactacgccatcatcgggcccggcctgcaggccaaggccacccgggaggcccagaagcgcgcggccgccggcatcatgaagaaccccacggtggacgggatgaccgtgatcgacctggaccccatcccgtacgaccccaagttcgagaagcagctcggccaggtcatgctgctggtgctctgcgtgacccaggtcctgatgatgcggaccacgtgggccctgtgcgaggccctcaccctggcgaccgggcccatcagcaccctgtgggagggcaaccccgggcgcttctggaacacgaccatcgccgtgtccatggccaacatcttccgcggcagctacctcgccggcgccgggctgctgttctccatcatgaagaacaccgcgaacacccggcgcggcacggggaacaccggcgagaccctcggcgagaagtggaagaaccggctgaacgccctgggcaagagcgagttccagatctacaagaagtccggcatccaggaggtggaccgcaccctcgccaaggaggggatcaagcggggcgagacggaccaccacgccgtcagccgcgggtccgcgaagctgcggtggttcgtggagcgcaacctggtgaccccggagggcaaggtcgtggacctcggctgcgggcggggcgggtggagctactactgcggcgggctgaagaacgtgaaggaggtcaagggcctgaccaagggcgggcccggccacgaggagcccatccccatgtccacctacgggtggaacctcgtgcgcctgcagagcggcgtggacgtcttcttcacgccgcccgagaagtgcgacaccctgctctgcgacatcggggagtccagccccaaccccaccgtggaggccggccggaccctgcgcgtgctgaacctcgtcgagaactggctgaacaacaacacccagttctgcatcaaggtgctgaacccgtacatgcccagcgtgatcgagaagatggaggccctgcagcggaagtacggcggggccctcgtccgcaaccccctgtcccggaacagcacgcacgagatgtactgggtgtccaacgccagcggcaacatcgtgtccagcgtcaacatgatctcccgcatgctgatcaaccggttcaccatgcgccacaagaaggcgacctacgagccggacgtggacctcgggagcggcacccggaacatcgggatcgagtccgagacgcccaacctggacatcatcggcaagcgcatcgagaagatcaagcaggagcacgagaccagctggcactacgaccaggaccacccctacaagacctgggcctaccacggctcctacgagaccaagcagacggggagcgcctccagcatggtgaacggcgtcgtgcgcctgctcaccaagccctgggacgtgatcccgatggtcacccagatggccatgaccgacacgacccccttcgggcagcagcgggtgttcaaggagaaggtcgacacccgcacccaggagcccaaggagggcacgaagaagctgatgaagatcaccgccgagtggctgtggaaggagctcggcaagaagaagacgccccggatgtgcacccgcgaggagttcacgcggaaggtgcgctccaacgcggccctgggggccatcttcaccgacgagaacaagtggaagtccgcccgggaggccgtggaggactccggcttctgggagctggtcgacaaggagcgcaacctccacctggaggggaagtgcgagacctgcgtgtacaacatgatgggcaagcgggagaagaagctgggggagttcggcaaggcgaagggcagccgcgccatctggtacatgtggctcggggcccggttcctggagttcgaggccctgggcttcctcaacgaggaccactggttctcccgcgagaacagcctgagcggggtggagggcgaggggctgcacaagctcggctacatcctgcgggacgtctccaagaaggagggcggggcgatgtacgccgacgacaccgccggctgggacacgcgcatcaccctggaggacctcaagaacgaggagatggtgaccaaccacatggagggggagcacaagaagctggccgaggccatcttcaagctgacctaccagaacaaggtggtccgggtgcagcgcccgacgccccggggcaccgtgatggacatcatcagccgccgggaccagcgcgggtccggccaggtcgtgacctacggcctcaacaccttcacgaacatggaggcgcagctgatccggcagatggagggggagggcgtgttcaagagcatccagcagctgaccgtcaaggaggagatcgccgtgaagaactggctcatccgcgtggggcgcgagcggctgtcccgcatggccatcagcggcgacgactgcgtcgtgaagcccctggacgaccggttcgcctccgccctcaccgcgctgaacgacatgggcaaggtgcgcaaggacatccagcagtgggagcccagccgggggtggaacgactggacccaggtcccgttctgctcccaccacttccacgagctgatcatgaaggacggccgcgtgctcgtggtcccctgccggaaccaggacgagctgatcgggcgcgcccggatcagccagggcgccgggtggtccctgcgcgagacggcctgcctcggcaagagctacgcccagatgtggtccctgatgtacttccaccggcgcgacctgcggctcgcggccaacgccatctgcagcgccgtgccctcccactggatccccaccagccgcaccacctggtccatccacgccacccacgagtggatgacgaccgaggacatgctgaccgtgtggaaccgggtctggatccaggagaacccgtggatggaggacaagacccccgtggagagctgggaggagatcccctacctgggcaagcgcgaggaccagtggtgcgggagcctcatcggcctgacgtcccgggcgacctgggccaagaacatccagaccgccatcaaccaggtgcgcagcctgatcgggaacgaggagtacaccgactacatgccctccatgaagcggttccgccgcgaggaggaggaggccggcgtcctctggtga

SEQ ID NO: 9080 - RNA, 9876 nt, synthetic construct
  misc_feature 1..9876: note = derived and/or modified CDS sequence (opt1) from DENV-2__KM279543__SS-prME
  source 1..9876: mol_type = other RNA
accgcggggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgagcagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcgggatgttcacctccatcggcaaggcgctccaccaggtcttcggggccatctacggcgccgccttcagcggcgtgtcctggaccatgaagatcctgatcggggtggtcatcacctggatcggcatgaacagccgctccacgagcctgtccgtgagcctggtgctcgtcggggtggtgaccctgtacctgggcgtcatggtgcaggcggactccgggtgcgtggtcagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtgacccgcctggagaacctcatgtggaagcagatcacccccgagctgaaccacatcctgaccgagaacgaggtcaagctcacgatcatgaccggggacatcaagggcatcatgcaggccgggaagcggtccctgcgcccccagccgaccgagctgaagtacagctggaaggcgtggggcaaggccaagatgctctccaccgagctgcacaaccacacgttcctgatcgacggccccgagaccgccgagtgccccaacaccaaccgggcctggaacagcctcgaggtggaggactacgggttcggcgtgttcaccacgaacatctggctgaagctgaaggagcgccaggacgtcttctgcgactccaagctcatgagcgccgcgatcaaggacaaccgggccgtgcacgccgacatggggtactggatcgagtccgccctgaacgacacctggaagatcgagaaggccagcttcatcgaggtgaagtcctgccactggcccaagagccacaccctgtggtccaacggcgtcctcgagagcgagatgatcatccccaagaacttcgcgggccccgtgtcccagcacaactaccgccccgggtaccacacccagaccgccggcccgtggcacctggggcggctggagatggacttcgacttctgcgagggcacgaccgtggtcgtgaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtgaacagcctcgtcacggccggccacgggcagatcgacaacttctccctgggcgtgctgggcatggccctcttcctggaggagatgctgcgcacccgggtggggaccaagcacgccatcctcctggtcgccgtgagcttcgtgaccctgatcacgggcaacatgtccttccgcgacctcgggcgcgtcatggtgatggtgggcgccaccatgaccgacgacatcgggatgggcgtcacctacctggccctgctcgcggccttcaaggtgcggcccacgttcgccgccggcctgctgctccgcaagctgaccagcaaggagctgatgatgaccaccatcgggatcgtgctcctgtcccagagcacgatccccgagtccatcctggagctcaccgacgccctggcgctgggcatgatggtcctcaagatcgtgcggaacatggagaagtaccagctggccgtcaccatcatggccatcctgtgcgtgcccaacgccgtgatcctccagaacgcctggaaggtcagctgcaccacgctggcggtggtgtccgtcagcccgctgctcctgacctccagccagcagaaggccgactggatccccctggccctcaccatcaaggggctgaaccccaccgccatcttcctgacgaccctctcccgcaccagcaagaagcggtcctggcccctgaacgaggcgatcatggccgtgggcatggtgagcatcctggcctccagcctcctgaagaacgacatcccgatgaccggccccctggtcgccgggggcctcctgacggtgtgctacgtgctgaccgggcgcagcgccgacctcgagctggagcgggcggccgacgtccgctgggaggagcaggccgagatctccggcagctcccccatcctgagcatcaccatctccgaggacgggagcatgtccatcaagaacgaggaggaggagcagaccctcacgatcctgatccggaccggcctgctcgtgatcagcggcctgttccccgtgtccatcccgatcaccgccgccgcgtggtacctgtgggaggtcaagaagcagcgcgccggggtgctctgggacgtgccctccccgccgcccgtcggcaaggccgagctggaggacggggcctaccggatcaagcagaagggcatcctggggtactcccagatcggcgccggcgtgtacaaggaggggaccttccacaccatgtggcacgtgacgcgcggcgcggtcctcatgcacaaggggaagcggatcgagcccagctgggccgacgtgaagaaggacctgatctcctacggcgggggctggaagctggagggcgagtggaaggagggggaggaggtgcaggtcctcgccctggagcccggcaagaacccgcgcgccgtgcagaccaagcccgggctgttcaagaccaacaccggcacgatcggggccgtgagcctcgacttctcccccggcaccagcggctcccccatcgtcgacaagaaggggaaggtggtgggcctgtacgggaacggcgtcgtgacccggagcggcacctacgtgtccgcgatcgcccagacggagaagtccatcgaggacaacccggagatcgaggacgacatcttccgcaagaagcggctgaccatcatggacctgcaccccggggccggcaagaccaagcgctacctccccgccatcgtccgggaggcgatcaagcgcgggctgcggaccctgatcctcgcccccacgcgcgtggtggccgccgagatggaggaggccctgcgcggcctgccgatccggtaccagacccccgcgatccgcgccgagcacaccgggcgggagatcgtcgacctcatgtgccacgccaccttcacgatgcgcctgctgagccccatccgggtgcccaactacaacctcatcatcatggacgaggcccacttcaccgacccggcctccatcgcggcccgcggctacatcagcacccgggtggagatgggcgaggccgccgggatcttcatgaccgccacgccgcccggctcccgcgaccccttcccgcagagcaacgcgcccatcatggacgaggagcgggagatccccgagcgctcctggaacagcgggcacgagtgggtcaccgacttcaagggcaagaccgtgtggttcgtgccctccatcaaggccgggaacgacatcgccgcctgcctgcggaagaacggcaagaaggtcatccagctgagccgcaagaccttcgactccgagtacatcaagacgcggaccaacgactgggacttcgtggtgaccaccgacatcagcgagatgggcgcgaacttcaaggccgagcgcgtcatcgacccgcggcgctgcatgaagcccgtgatcctcacggacggggaggagcgggtgatcctggccggccccatgcccgtcacccactccagcgccgcccagcgccgggggcgcgtgggccgcaacccgaagaacgagaacgaccagtacatctacatgggggagcccctggagaacgacgaggactgcgcgcactggaaggaggccaagatgctcctggacaacatcaacacccccgagggcatcatcccctccatgttcgagccggagcgggagaaggtggacgccatcgacggcgagtaccgcctgcgcggggaggcccgcaagaccttcgtcgacctcatgcggcgcggcgacctgcccgtgtggctggcctaccgggtcgcggccgaggggatcaactacgccgaccgccggtggtgcttcgacggcgtgaagaacaaccagatcctcgaggagaacgtggaggtcgagatctggacgaaggagggggagcgcaagaagctgaagccccggtggctggacgcccgcatctacagcgacccgctcgccctgaaggagttcaaggagttcgcggccggccggaagtccctgaccctcaacctgatcaccgagatgggccgcctgcccaccttcatgacgcagaaggccaagaacgccctcgacaacctggcggtgctgcacaccgccgaggccgggggccgggcctacaaccacgccctcagcgagctgcccgagaccctggagaccctcctgctgctcacgctgctggcgaccgtgaccgggggcatcttcctcttcctgatgtccggcaaggggatcggcaagatgaccctggggatgtgctgcatcatcaccgccagcatcctcctgtggtacgcccagatccagccccactggatcgccgcctccatcatcctggagttcttcctcatcgtcctgctgatcccggagcccgagaagcagcgcacgccccaggacaaccagctcacctacgtggtgatcgcgatcctgaccgtcgtggccgccaccatggccaacgagatgggcttcctggagaagacgaagaaggacttcgggctcggcagcatcaccacccagcagcccgagagcaacatcctggacatcgacctgcggccggcctccgcgtggaccctctacgccgtggccacgaccttcatcacccccatgctgcgccacagcatcgagaactccagcgtcaacgtgtccctgaccgccatcgccaaccaggcgacggtgctcatgggcctggggaagggctggcccctgagcaagatggacatcggggtccccctcctggccatcggctgctactcccaggtgaacccgatcaccctgaccgccgccctcctgctgctcgtggcgcactacgccatcatcgggcccggcctgcaggccaaggccacccgggaggcccagaagcgcgcggccgccggcatcatgaagaaccccacggtcgacgggatgaccgtgatcgacctggaccccatcccgtacgaccccaagttcgagaagcagctcggccaggtgatgctgctggtcctctgcgtgacccaggtgctgatgatgcggaccacgtgggccctgtgcgaggccctcaccctggcgaccgggcccatcagcaccctgtgggagggcaaccccgggcgcttctggaacacgaccatcgccgtctccatggccaacatcttccgcggcagctacctcgccggcgccgggctgctgttctccatcatgaagaacaccgcgaacacccggcgcggcacggggaacaccggcgagaccctcggcgagaagtggaagaaccggctgaacgccctgggcaagagcgagttccagatctacaagaagtccggcatccaggaggtggaccgcaccctcgccaaggaggggatcaagcggggcgagacggaccaccacgccgtgagccgcgggtccgcgaagctgcggtggttcgtcgagcgcaacctggtgaccccggagggcaaggtggtcgacctcggctgcgggcggggcgggtggagctactactgcggcgggctgaagaacgtgaaggaggtgaagggcctgaccaagggcgggcccggccacgaggagcccatccccatgtccacctacgggtggaacctcgtccgcctgcagagcggcgtggacgtgttcttcacgccgcccgagaagtgcgacaccctgctctgcgacatcggggagtccagccccaaccccaccgtcgaggccggccggaccctgcgcgtgctgaacctcgtggagaactggctgaacaacaacacccagttctgcatcaaggtcctgaacccgtacatgcccagcgtgatcgagaagatggaggccctgcagcggaagtacggcggggccctcgtgcgcaaccccctgtcccggaacagcacgcacgagatgtactgggtctccaacgccagcggcaacatcgtgtccagcgtgaacatgatctcccgcatgctgatcaaccggttcaccatgcgccacaagaaggcgacctacgagccggacgtcgacctcgggagcggcacccggaacatcgggatcgagtccgagacgcccaacctggacatcatcggcaagcgcatcgagaagatcaagcaggagcacgagaccagctggcactacgaccaggaccacccctacaagacctgggcctaccacggctcctacgagaccaagcagacggggagcgcctccagcatggtgaacggcgtggtccgcctgctcaccaagccctgggacgtgatcccgatggtgacccagatggccatgaccgacacgacccccttcgggcagcagcgggtcttcaaggagaaggtggacacccgcacccaggagcccaaggagggcacgaagaagctgatgaagatcaccgccgagtggctgtggaaggagctcggcaagaagaagacgccccggatgtgcacccgcgaggagttcacgcggaaggtccgctccaacgcggccctgggggccatcttcaccgacgagaacaagtggaagtccgcccgggaggccgtggaggactccggcttctgggagctggtggacaaggagcgcaacctccacctggaggggaagtgcgagacctgcgtctacaacatgatgggcaagcgggagaagaagctgggggagttcggcaaggcgaagggcagccgcgccatctggtacatgtggctcggggcccggttcctggagttcgaggccctgggcttcctcaacgaggaccactggttctcccgcgagaacagcctgagcggggtggagggcgaggggctgcacaagctcggctacatcctgcgggacgtgtccaagaaggagggcggggcgatgtacgccgacgacaccgccggctgggacacgcgcatcaccctggaggacctcaagaacgaggagatggtcaccaaccacatggagggggagcacaagaagctggccgaggccatcttcaagctgacctaccagaacaaggtggtgcgggtccagcgcccgacgccccggggcaccgtgatggacatcatcagccgccgggaccagcgcgggtccggccaggtggtcacctacggcctcaacaccttcacgaacatggaggcgcagctgatccggcagatggagggggagggcgtgttcaagagcatccagcagctgaccgtgaaggaggagatcgccgtcaagaactggctcatccgcgtggggcgcgagcggctgtcccgcatggccatcagcggcgacgactgcgtggtcaagcccctggacgaccggttcgcctccgccctcaccgcgctgaacgacatgggcaaggtgcgcaaggacatccagcagtgggagcccagccgggggtggaacgactggacccaggtgccgttctgctcccaccacttccacgagctgatcatgaaggacggccgcgtcctcgtggtgccctgccggaaccaggacgagctgatcgggcgcgcccggatcagccagggcgccgggtggtccctgcgcgagacggcctgcctcggcaagagctacgcccagatgtggtccctgatgtacttccaccggcgcgacctgcggctcgcggccaacgccatctgcagcgccgtcccctcccactggatccccaccagccgcaccacctggtccatccacgccacccacgagtggatgacgaccgaggacatgctgaccgtgtggaaccgggtgtggatccaggagaacccgtggatggaggacaagacccccgtcgagagctgggaggagatcccctacctgggcaagcgcgaggaccagtggtgcgggagcctcatcggcctgacgtcccgggcgacctgggccaagaacatccagaccgccatcaaccaggtgcgcagcctgatcgggaacgaggagtacaccgactacatgccctccatgaagcggttccgccgcgaggaggaggaggccggcgtgctctggtga

SEQ ID NO: 9081 - RNA, 9876 nt, synthetic construct
  misc_feature 1..9876: note = derived and/or modified CDS sequence (opt1) from DENV-2__KM279571__SS-prME
  source 1..9876: mol_type = other RNA
accgcgggcatcatcatcatgatgatccccaccgtgatggccttccacctgaccacccgcaacggggagccccacatgatcgtctcccggcaggagaagggcaagtccctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcaccatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggaccctgcgcccccagccgaccgagctgaagtactcctggaaggcgtggggcaaggccaagatgctcagcacggagctgcacaaccacaccttcctgatcgacggccccgagaccgccgagtgccccaacaccaaccgggcctggaactccctcgaggtggaggactacgggttcggcgtcttcacgaccaacatctggctgaagctgaaggagcgccaggacgtgttctgcgacagcaagctcatgtccgccgcgatcaaggacaaccgggccgtgcacgccgacatggggtactggatcgagagcgccctgaacgacacctggaagatcgagaaggcctccttcatcgaggtcaagagctgccactggccgaagtcccacaccctgtggagcaacggcgtgctcgagtccgagatgatcatccccaagaacttcgcgggccccgtgagccagcacaactaccgccccgggtaccacacccagacggccggcccgtggcacctggggcggctggagatggacttcgacttctgcgagggcaccaccgtcgtggtgaccgaggactgcgggaaccgcggcccctccctccggacgaccaccgccagcggcaagctgatcaccgagtggtgctgccgcagctgcacgctgccgcccctccggtaccgcggggaggacggctgctggtacgggatggagatccggccgctgaaggagaaggaggagaacctggtcaactccctcgtgaccgccggccacgggcagatcgacaacttcagcctgggcgtgctgggcatggccctcttcctggaggagatgctgcgcacccgggtcgggaccaagcacgccatcctcctggtggccgtgtccttcgtcacgctgatcaccggcaacatgagcttccgcgacctcgggcgcgtgatggtgatggtcggcgccaccatgaccgacgacatcgggatgggcgtgacgtacctggccctgctcgcggccttcaagatccggcccaccttcgccgccggcctgctgctccgcaagctgacctccaaggagctgatgatgaccacgatcgggatcgtgctcctgagccagtccaccatccccgagagcatcctggagctcaccgacgccctggcgctgggcatgatggtcctcaagatcgtgcggaacatggagaagtaccagctggccgtcaccatcatggccatcctgtgcgtgcccaacgccgtgatcctccagaacgcctggaaggtctcctgcacgaccctggcggtggtgagcgtctccccgctgctcctgaccagctcccagcagaaggccgactggatccccctggccctcaccatcaaggggctgaaccccacggccatcttcctgaccaccctcagccgcacctccaagaagcggagctggcccctgaacgaggcgatcatggccgtgggcatggtgtccatcctggccagctccctcctgaagaacgacatcccgatgacgggccccctggtcgccgggggcctcctgaccgtgtgctacgtgctgaccgggcgcagcgccgacctcgagctggagcgggcggccgacgtccgctgggaggagcaggccgagatcagcggctccagccccatcctgtccatcaccatcagcgaggacgggtccatgagcatcaagaacgaggaggaggagcagacgctcaccatcctgatccggaccggcctgctcgtgatctccggcctgttccccgtgagcatcccgatcaccgccgccgcgtggtacctgtgggaggtcaagaagcagcgcgccggggtgctctgggacgtgcccagcccgccgcccgtcggcaaggccgagctggaggacggggcctaccggatcaagcagaagggcatcctggggtacagccagatcggcgccggcgtgtacaaggaggggaccttccacacgatgtggcacgtgacccgcggcgcggtcctcatgcacaaggggaagcggatcgagccctcctgggccgacgtgaagaaggacctgatcagctacggcgggggctggaagctggagggcgagtggaaggagggggaggaggtgcaggtcctcgccctggagcccggcaagaacccccgcgccgtgcagaccaagcccgggctgttcaagaccaacacgggcaccatcggggccgtgtccctcgacttcagccccggcacctccggcagccccatcgtcgacaagaaggggaaggtggtgggcctgtacgggaacggcgtcgtgacccggtccggcacgtacgtgagcgcgatcgcccagaccgagaagtccatcgaggacaacccggagatcgaggacgacatcttccgcaagaagcggctgaccatcatggacctgcaccccggggccggcaagaccaagcgctacctccccgccatcgtccgggaggcgatcaagcgcgggctgcggacgctgatcctcgcccccacccgcgtggtggccgccgagatggaggaggccctgcgcggcctgccgatccggtaccagacccccgcgatccgcgccgagcacaccgggcgggagatcgtcgacctcatgtgccacgccacgttcaccatgcgcctgctgagccccatccgggtgcccaactacaacctcatcatcatggacgaggcccacttcaccgacccggccagcatcgcggcccgcggctacatctccacccgggtggagatgggcgaggccgccgggatcttcatgacggccacgccgcccggcagccgcgaccccttcccgcagtccaacgcgcccatcatggacgaggagaaggagatccccgagcggagctggaactccgggcacgagtgggtcaccgacttcaagggcaagaccgtgtggttcgtgcccagcatcaaggccgggaacgacatcgccgcctgcctgcgcaagaacggcaagaaggtcatccagctgtcccggaagacgttcgacagcgagtacatcaagacccgcaccaacgactgggacttcgtggtgaccacggacatctccgagatgggcgcgaacttcaaggccgagcgggtcatcgacccgcgccggtgcatgaagcccgtgatcctcaccgacggggaggagcgcgtgatcctggccggccccatgcccgtcacccacagctccgccgcccagcggcgcgggcgggtgggccgcaacccgaagaacgagaacgaccagtacatctacatgggggagcccctggagaacgacgaggactgcgcgcactggaaggaggccaagatgctcctggacaacatcaacacccccgagggcatcatccccagcatgttcgagccggagcgcgagaaggtggacgccatcgacggcgagtaccggctgcgcggggaggcccggaagacgttcgtcgacctcatgcgccggggcgacctgcccgtgtggctggcctaccgcgtcgcggccgaggggatcaactacgccgaccggcgctggtgcttcgacggcgtgaagaacaaccagatcctcgaggagaacgtggaggtcgagatctggaccaaggagggggagcggaagaagctgaagccccgctggctggacgcccggatctactccgacccgctcgccctgaaggagttcaaggagttcgcggccggccgcaagagcctgaccctcaacctgatcaccgagatgggccggctgcccacgttcatgacccagaaggccaagaacgccctcgacaacctggcggtgctgcacaccgccgaggccgggggccgcgcctacaaccacgccctctccgagctgcccgagaccctggagacgctcctgctgctcaccctgctggcgaccgtgaccgggggcatcttcctcttcctgatgagcggcaaggggatcggcaagatgaccctggggatgtgctgcatcatcacggcctccatcctcctgtggtacgcccagatccagccccactggatcgccgccagcatcatcctggagttcttcctcatcgtcctgctgatcccggagcccgagaagcagcggacgccccaggacaaccagctcacctacgtggtgatcgcgatcctgaccgtcgtggccgccacgatggccaacgagatgggcttcctggagaagaccaagaaggacttcgggctcggctccatcaccacccagcagcccgagagcaacatcctggacatcgacctgcgcccggccagcgcgtggacgctctacgccgtggccaccaccttcatcacccccatgctgcggcactccatcgagaacagctccgtcaacgtgagcctgacggccatcgccaaccaggcgaccgtgctcatgggcctggggaagggctggcccctgtccaagatggacatcggggtccccctcctggccatcggctgctacagccaggtgaacccgatcaccctgaccgccgccctcctgctgctcgtggcgcactacgccatcatcgggcccggcctgcaggccaaggccacgcgcgaggcccagaagcgggcggccgccggcatcatgaagaaccccaccgtcgacgggatgaccgtgatcgacctggaccccatcccgtacgaccccaagttcgagaagcagctcggccaggtgatgctgctggtcctctgcgtgacccaggtgctgatgatgcgcacgacctgggccctgtgcgaggccctcaccctggcgaccgggcccatctccacgctgtgggagggcaaccccgggcggttctggaacaccaccatcgccgtcagcatggccaacatcttccgcggctcctacctcgccggcgccgggctgctgttcagcatcatgaagaacaccgcgaacacgcgccggggcaccgggaacaccggcgagaccctcggcgagaagtggaagaaccgcctgaacgccctggggaagtccgagttccagatctacaagaagtccggcatccaggaggtggaccggacgctcgccaaggaggggatcaagcgcggcgagaccgaccaccacgccgtgagccgggggagcgcgaagctgcgctggttcgtcgagcggaacctggtgaccccggagggcaaggtggtcgacctcggctgcgggcgcggcgggtggtcctactactgcggcgggctgaagaacgtgaaggaggtgaagggcctgaccaagggcgggcccggccacgaggagcccatccccatgagcacgtacgggtggaacctcgtccggctgcagtccggcgtggacgtgttcttcaccccgcccgagaagtgcgacaccctgctctgcgacatcggggagagctcccccaaccccaccgtcgaggccggccgcaccctgcgggtgctgaacctcgtggagaactggctgaacaacaacacgcagttctgcatcaaggtcctgaacccgtacatgcccagcgtgatcgagaagatggaggccctgcagcgcaagtacggcggggccctcgtgcggaaccccctgagccgcaactccacccacgagatgtactgggtcagcaacgcctccggcaacatcgtgagctccgtgaacatgatcagccggatgctgatcaaccgcttcaccatgcggcacaagaaggcgacctacgagccggacgtcgacctcgggtccggcacgcgcaacatcgggatcgagagcgagacccccaacctggacatcatcggcaagcggatcgagaagatcaagcaggagcacgagacctcctggcactacgaccaggaccacccctacaagacctgggcctaccacggcagctacgagacgaagcagaccgggtccgccagctccatggtgaacggcgtggtccgcctgctcaccaagccctgggacgtgatcccgatggtgacccagatggccatgacggacaccacccccttcgggcagcagcgcgtcttcaaggagaaggtggacacccggacgcaggagcccaaggagggcaccaagaagctgatgaagatcaccgccgagtggctgtggaaggagctcggcaagaagaagacgccccgcatgtgcacgcgggaggagttcacccgcaaggtccggagcaacgcggccctgggggccatcttcaccgacgagaacaagtggaagtccgcccgcgaggccgtggaggacagcggcttctgggagctggtggacaaggagcggaacctccacctggaggggaagtgcgagacctgcgtctacaacatgatgggcaagcgcgagaagaagctgggggagttcggcaaggcgaagggctcccgggccatctggtacatgtggctcggggcccgcttcctggagttcgaggccctgggcttcctcaacgaggaccactggttcagccgggagaactccctgagcggggtggagggcgaggggctgcacaagctcggctacatcctgcgcgacgtgagcaagaaggagggcggggcgatgtacgccgacgacacggccggctgggacacccggatcaccctggaggacctcaagaacgaggagatggtcaccaaccacatggagggggagcacaagaagctggccgaggccatcttcaagctgacgtaccagaacaaggtggtgcgcgtccagcggccgacgccccgcggcaccgtgatggacatcatctcccggcgcgaccagcgggggagcggccaggtggtcacctacggcctcaacaccttcaccaacatggaggcgcagctgatccgccagatggagggggagggcgtgttcaagtccatccagcagctgaccgtgaaggaggagatcgccgtcaagaactggctcatccgggtggggcgcgagcgcctgagccggatggccatctccggcgacgactgcgtggtcaagcccctggacgaccgcttcgccagcgccctcaccgcgctgaacgacatgggcaaggtgcggaaggacatccagcagtgggagccctcccgcgggtggaacgactggacccaggtgccgttctgcagccaccacttccacgagctgatcatgaaggacggccgggtcctcgtggtgccctgccgcaaccaggacgagctgatcgggcgggcccgcatctcccagggcgccgggtggagcctgcgggagaccgcctgcctcggcaagtcctacgcccagatgtggagcctgatgtacttccaccgccgggacctgcgcctcgcggccaacgccatctgctccgccgtccccagccactggatccccacctcccggaccacctggagcatccacgccacgcacgagtggatgaccaccgaggacatgctgaccgtgtggaaccgcgtgtggatccaggagaacccgtggatggaggacaagacgcccgtcgagtcctgggaggagatcccctacctgggcaagcgggaggaccagtggtgcgggagcctcatcggcctgaccagccgcgcgacctgggccaagaacatccagaccgccatcaaccaggtgcggtccctgatcgggaacgaggagtacacggactacatgcccagcatgaagcgcttccggcgcgaggaggaggaggccggcgtgctctggtga

SEQ ID NO: 9082 - RNA, 9876 nt, synthetic construct
  misc_feature 1..9876: note = derived and/or modified CDS sequence (opt1) from DENV-2__KM279544__SS-prME
  source 1..9876: mol_type = other RNA
accgcggggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgagcagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggaccagcaaccgggacttcgtggagggcgtctccggcgggagctgggtggacatcgtgctggagcacggctcctgcgtcaccacgatggccaagaacaagcccaccctcgacttcgagctgatcaagaccgaggccaagcacctggccaccctccgcaagtactgcgtggaggccaagctgacgaacaccaccaccgcgagccggtgccccacgcagggggagccctccctgaacgaggagcaggacaagcgcttcgtgtgcaagcacagcatggtcgaccggggctggggcaacgggtgcggcctcttcgggaagggcgggatcgtgacctgcgccatgttcacgtgcaagaagaacatggagggcaaggtggtccagcccgagaacctggagtacaccatcgtgatcacgccccactccggcgaggagaacgccgtggggaacgacaccggcaagcacgggaaggagatcaaggtcacgccccagagctccatcaccgaggccgagctgaccggctacgggacggtgaccatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagacgctggtgaccttcaagaacccgcacgccaagaagcaggacgtcgtggtgctcggcagccaggagggggccatgcacaccgccctgaccggcgccacggagatccagatgagctccgggaacctcctgttcaccggccacctgaagtgccgcctgcggatggacaagctccagctgaagggcatgagctactccatgtgcaccgggaagttcaaggtcgtgaaggagatcgcggagacccagcacggcacgatcgtgatccgcgtccagtacgagggggacggcagcccctgcaagatccccttcgagatcatggacctggagaagcggcacgtgctcggccgcctgatcaccgtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccacgatgcgcggcgccaagcggatggccatcctgggcgacaccgcctgggacttcgggagcctgggcgggatgttcacctccatcggcaaggcgctccaccaggtcttcggggccatctacggcgccgccttcagcggcgtgtcctggaccatgaagatcctgatcggggtggtcatcacgtggatcggcatgaacagccgctccaccagcctgtccgtgagcctggtgctcgtcggggtggtgaccctgtacctgggcgtcatggtgcaggcggactccgggtgcgtggtcagctggaagaacaaggagctcaagtgcggcagcggcatcttcatcaccgacaacgtgcacacgtggaccgagcagtacaagttccagccggagtcccccagcaagctggcctccgccatccagaaggcccacgaggaggggatctgcggcatccggagcgtgacccgcctggagaacctcatgtggaagcagatcacccccgagctgaaccacatcctgacggagaacgaggtcaagctcaccatcatgaccggggacatcaagggcatcatgcaggccgggaagcggtccctgcgcccccagccgaccgagctgaagtacagctggaaggcgtggggcaaggccaagatgctctccacggagctgcacaaccacaccttcctgatcgacggccccgagaccgccgagtgccccaacaccaaccgggcctggaacagcctcgaggtggaggactacgggttcggcgtgttcacgaccaacatctggctgaagctgaaggagcgccaggacgtcttctgcgactccaagctcatgagcgccgcgatcaaggacaaccgggccgtgcacgccgacatggggtactggatcgagtccgccctgaacgacacctggaagatcgagaaggccagcttcatcgaggtgaagtcctgccactggcccaagagccacaccctgtggtccaacggcgtcctcgagagcgagatgatcatccccaagaacttcgcgggccccgtgtcccagcacaactaccgccccgggtaccacacccagacggccggcccgtggcacctggggcggctggagatggacttcgacttctgcgagggcaccaccgtggtcgtgaccgaggactgcgggaaccgcggccccagcctccggacgaccaccgccagcggcaagctgatcaccgagtggtgctgccgctcctgcacgctgccgcccctccggtaccgcggggaggacggctgctggtacgggatggagatccggccgctgaaggagaaggaggagaacctggtgaacagcctcgtcaccgccggccacgggcagatcgacaacttctccctgggcgtgctgggcatggccctcttcctggaggagatgctgcgcacccgggtggggaccaagcacgccatcctcctggtcgccgtgagcttcgtgacgctgatcaccggcaacatgtccttccgcgacctcgggcgcgtcatggtgatggtgggcgccaccatgaccgacgacatcgggatgggcgtcacgtacctggccctgctcgcggccttcaaggtgcggcccaccttcgccgccggcctgctgctccgcaagctgaccagcaaggagctgatgatgaccacgatcgggatcgtgctcctgtcccagagcaccatccccgagtccatcctggagctcaccgacgccctggcgctgggcatgatggtcctcaagatcgtgcggaacatggagaagtaccagctggccgtcaccatcatggccatcctgtgcgtgcccaacgccgtgatcctccagaacgcctggaaggtcagctgcacgaccctggcggtggtgtccgtcagcccgctgctcctgacctccagccagcagaaggccgactggatccccctggccctcaccatcaaggggctgaaccccacggccatcttcctgaccaccctctcccgcaccagcaagaagcggtcctggcccctgaacgaggcgatcatggccgtgggcatggtgagcatcctggcctccagcctcctgaagaacgacatcccgatgacgggccccctggtcgccgggggcctcctgaccgtgtgctacgtgctgaccgggcgcagcgccgacctcgagctggagcgggcggccgacgtccgctgggaggagcaggccgagatctccggcagctcccccatcctgagcatcaccatctccgaggacgggagcatgtccatcaagaacgaggaggaggagcagacgctcaccatcctgatccggaccggcctgctcgtgatcagcggcctgttccccgtgtccatcccgatcaccgccgccgcgtggtacctgtgggaggtcaagaagcagcgcgccggggtgctctgggacgtgccctccccgccgcccgtcggcaaggccgagctggaggacggggcctaccggatcaagcagaagggcatcctggggtactcccagatcggcgccggcgtgtacaaggaggggaccttccacacgatgtggcacgtgacccgcggcgcggtcctcatgcacaaggggaagcggatcgagcccagctgggccgacgtgaagaaggacctgatctcctacggcgggggctggaagctggagggcgagtggaaggagggggaggaggtgcaggtcctcgccctggagcccggcaagaacccgcgcgccgtgcagaccaagcccgggctgttcaagaccaacacgggcaccatcggggccgtgagcctcgacttctcccccggcaccagcggctcccccatcgtcgacaagaaggggaaggtggtgggcctgtacgggaacggcgtcgtgacccggagcggcacgtacgtgtccgcgatcgcccagaccgagaagtccatcgaggacaacccggagatcgaggacgacatcttccgcaagaagcggctgaccatcatggacctgcaccccggggccggcaagaccaagcgctacctccccgccatcgtccgggaggcgatcaagcgcgggctgcggacgctgatcctcgcccccacccgcgtggtggccgccgagatggaggaggccctgcgcggcctgccgatccggtaccagacccccgcgatccgcgccgagcacaccgggcgggagatcgtcgacctcatgtgccacgccacgttcaccatgcgcctgctgagccccatccgggtgcccaactacaacctcatcatcatggacgaggcccacttcaccgacccggcctccatcgcggcccgcggctacatcagcacccgggtggagatgggcgaggccgccgggatcttcatgacggccacgccgcccggctcccgcgaccccttcccgcagagcaacgcgcccatcatggacgaggagcgggagatccccgagcgctcctggaacagcgggcacgagtgggtcaccgacttcaagggcaagaccgtgtggttcgtgccctccatcaaggccgggaacgacatcgccgcctgcctgcggaagaacggcaagaaggtcatccagctgagccgcaagacgttcgactccgagtacatcaagacccggaccaacgactgggacttcgtggtgaccacggacatcagcgagatgggcgcgaacttcaaggccgagcgcgtcatcgacccgcggcgctgcatgaagcccgtgatcctcaccgacggggaggagcgggtgatcctggccggccccatgcccgtcacccactccagcgccgcccagcgccgggggcgcgtgggccgcaacccgaagaacgagaacgaccagtacatctacatgggggagcccctggagaacgacgaggactgcgcgcactggaaggaggccaagatgctcctggacaacatcaacacccccgagggcatcatcccctccatgttcgagccggagcgggagaaggtggacgccatcgacggcgagtaccgcctgcgcggggaggcccgcaagacgttcgtcgacctcatgcggcgcggcgacctgcccgtgtggctggcctaccgggtcgcggccgaggggatcaactacgccgaccgccggtggtgcttcgacggcgtgaagaacaaccagatcctcgaggagaacgtggaggtcgagatctggaccaaggagggggagcgcaagaagctgaagccccggtggctggacgcccgcatctacagcgacccgctcgccctgaaggagttcaaggagttcgcggccggccggaagtccctgaccctcaacctgatcaccgagatgggccgcctgcccacgttcatgacccagaaggccaagaacgccctcgacaacctggcggtgctgcacaccgccgaggccgggggccgggcctacaaccacgccctcagcgagctgcccgagaccctggagacgctcctgctgctcaccctgctggcgaccgtgaccgggggcatcttcctcttcctgatgtccggcaaggggatcggcaagatgaccctggggatgtgctgcatcatcacggccagcatcctcctgtggtacgcccagatccagccccactggatcgccgcctccatcatcctggagttcttcctcatcgtcctgctgatcccggagcccgagaagcagcgcacgccccaggacaaccagctcacctacgtggtgatcgcgatcctgaccgtcgtggccgccacgatggccaacgagatgggcttcctggagaagaccaagaaggacttcgggctcggcagcatcaccacccagcagcccgagagcaacatcctggacatcgacctgcggccggcctccgcgtggacgctctacgccgtggccaccaccttcatcacccccatgctgcgccacagcatcgagaactccagcgtcaacgtgtccctgacggccatcgccaaccaggcgaccgtgctcatgggcctggggaagggctggcccctgagcaagatggacatcggggtccccctcctggccatcggctgctactcccaggtgaacccgatcaccctgaccgccgccctcctgctgctcgtggcgcactacgccatcatcgggcccggcctgcaggccaaggccacgcgggaggcccagaagcgcgcggccgccggcatcatgaagaaccccaccgtcgacgggatgaccgtgatcgacctggaccccatcccgtacgaccccaagttcgagaagcagctcggccaggtgatgctgctggtcctctgcgtgacccaggtgctgatgatgcggacgacctgggccctgtgcgaggccctcaccctggcgaccgggcccatcagcacgctgtgggagggcaaccccgggcgcttctggaacaccaccatcgccgtctccatggccaacatcttccgcggcagctacctcgccggcgccgggctgctgttctccatcatgaagaacaccgcgaacacgcggcgcggcaccgggaacaccggcgagaccctcggcgagaagtggaagaaccggctgaacgccctgggcaagagcgagttccagatctacaagaagtccggcatccaggaggtggaccgcacgctcgccaaggaggggatcaagcggggcgagaccgaccaccacgccgtgagccgcgggtccgcgaagctgcggtggttcgtcgagcgcaacctggtgaccccggagggcaaggtggtcgacctcggctgcgggcggggcgggtggagctactactgcggcgggctgaagaacgtgaaggaggtgaagggcctgaccaagggcgggcccggccacgaggagcccatccccatgtccacgtacgggtggaacctcgtccgcctgcagagcggcgtggacgtgttcttcaccccgcccgagaagtgcgacaccctgctctgcgacatcggggagtccagccccaaccccaccgtcgaggccggccggaccctgcgcgtgctgaacctcgtggagaactggctgaacaacaacacgcagttctgcatcaaggtcctgaacccgtacatgcccagcgtgatcgagaagatggaggccctgcagcggaagtacggcggggccctcgtgcgcaaccccctgtcccggaacagcacccacgagatgtactgggtctccaacgccagcggcaacatcgtgtccagcgtgaacatgatctcccgcatgctgatcaaccggttcaccatgcgccacaagaaggcgacctacgagccggacgtcgacctcgggagcggcacgcggaacatcgggatcgagtccgagacccccaacctggacatcatcggcaagcgcatcgagaagatcaagcaggagcacgagaccagctggcactacgaccaggaccacccctacaagacctgggcctaccacggctcctacgagacgaagcagaccgggagcgcctccagcatggtgaacggcgtggtccgcctgctcaccaagccctgggacgtgatcccgatggtgacccagatggccatgacggacaccacccccttcgggcagcagcgggtcttcaaggagaaggtggacacccgcacgcaggagcccaaggagggcaccaagaagctgatgaagatcaccgccgagtggctgtggaaggagctcggcaagaagaagacgccccggatgtgcacgcgcgaggagttcacccggaaggtccgctccaacgcggccctgggggccatcttcaccgacgagaacaagtggaagtccgcccgggaggccgtggaggactccggcttctgggagctggtggacaaggagcgcaacctccacctggaggggaagtgcgagacctgcgtctacaacatgatgggcaagcgggagaagaagctgggggagttcggcaaggcgaagggcagccgcgccatctggtacatgtggctcggggcccggttcctggagttcgaggccctgggcttcctcaacgaggaccactggttctcccgcgagaacagcctgagcggggtggagggcgaggggctgcacaagctcggctacatcctgcgggacgtgtccaagaaggagggcggggcgatgtacgccgacgacacggccggctgggacacccgcatcaccctggaggacctcaagaacgaggagatggtcaccaaccacatggagggggagcacaagaagctggccgaggccatcttcaagctgacgtaccagaacaaggtggtgcgggtccagcgcccgacgccccggggcaccgtgatggacatcatcagccgccgggaccagcgcgggtccggccaggtggtcacctacggcctcaacaccttcaccaacatggaggcgcagctgatccggcagatggagggggagggcgtgttcaagagcatccagcagctgaccgtgaaggaggagatcgccgtcaagaactggctcatccgcgtggggcgcgagcggctgtcccgcatggccatcagcggcgacgactgcgtggtcaagcccctggacgaccggttcgcctccgccctcaccgcgctgaacgacatgggcaaggtgcgcaaggacatccagcagtgggagcccagccgggggtggaacgactggacccaggtgccgttctgctcccaccacttccacgagctgatcatgaaggacggccgcgtcctcgtggtgccctgccggaaccaggacgagctgatcgggcgcgcccggatcagccagggcgccgggtggtccctgcgcgagaccgcctgcctcggcaagagctacgcccagatgtggtccctgatgtacttccaccggcgcgacctgcggctcgcggccaacgccatctgcagcgccgtcccctcccactggatccccaccagccgcaccacctggtccatccacgccacgcacgagtggatgaccaccgaggacatgctgaccgtgtggaaccgggtgtggatccaggagaacccgtggatggaggacaagacgctggtcgagagctgggaggagatcccctacctcggcaagcgcgaggaccagtggtgcgggagcctgatcggcctgacctcccgggcgacctgggccaagaacatccagaccgccatcaaccaggtgcgcagcctcatcgggaacgaggagtacacggactacatgccctccatgaagcggttccgccgcgaggaggaggaggccggcgtgctgtggtga

SEQ ID NO: 9083 - RNA, 9876 nt, synthetic construct
  misc_feature 1..9876: note = derived and/or modified CDS sequence (opt1) from DENV-2__KM279549__SS-prME
  source 1..9876: mol_type = other RNA
accgcggggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgagcagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggtccctgcgcccccagccgaccgagctgaagtacagctggaaggcgtggggcaaggccaagatgctctccaccgagctgcacaaccacacgttcctgatcgacggccccgagaccgccgagtgccccaacaccaaccgggcctggaacagcctcgaggtggaggactacgggttcggcgtcttcaccacgaacatctggctgaagctgaaggagcgccaggacgtgttctgcgactccaagctcatgagcgccgcgatcaaggacaaccgggccgtgcacgccgacatggggtactggatcgagtccgccctgaacgacacctggaagatcgagaaggccagcttcatcgaggtcaagtcctgccactggcccaagagccacaccctgtggtccaacggcgtgctcgagagcgagatgatcatccccaagaacttcgcgggccccgtgtcccagcacaactaccgccccgggtaccacacccagaccgccggcccgtggcacctggggcggctggagatggacttcgacttctgcgagggcacgaccgtcgtggtgaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtcaacagcctcgtgacggccggccacgggcagatcgacaacttctccctgggcgtgctgggcatggccctcttcctggaggagatgctgcgcacccgggtcgggaccaagcacgccatcctcctggtggccgtgagcttcgtcaccctgatcacgggcaacatgtccttccgcgacctcgggcgcgtgatggtgatggtcggcgccaccatgaccgacgacatcgggatgggcgtgacctacctggccctgctcgcggccttcaaggtgcggcccacgttcgccgccggcctgctgctccgcaagctgaccagcaaggagctgatgatgaccaccatcgggatcgtcctcctgtcccagagcacgatccccgagtccatcctggagctcaccgacgccctggcgctgggcatgatggtgctcaagatcgtccggaacatggagaagtaccagctggccgtgaccatcatggccatcctgtgcgtgcccaacgccgtcatcctccagaacgcctggaaggtgagctgcaccacgctggcggtggtctccgtgagcccgctgctcctgacctccagccagcagaaggccgactggatccccctggccctcaccatcaaggggctgaaccccaccgccatcttcctgacgaccctctcccgcaccagcaagaagcggtcctggcccctgaacgaggcgatcatggccgtgggcatggtcagcatcctggcctccagcctcctgaagaacgacatcccgatgaccggccccctggtggccgggggcctcctgacggtgtgctacgtcctgaccgggcgcagcgccgacctcgagctggagcgggcggccgacgtgcgctgggaggagcaggccgagatctccggcagctcccccatcctgagcatcaccatctccgaggacgggagcatgtccatcaagaacgaggaggaggagcagaccctcacgatcctgatccggaccggcctgctcgtgatcagcggcctgttccccgtctccatcccgatcaccgccgccgcgtggtacctgtgggaggtgaagaagcagcgcgccggggtgctctgggacgtcccctccccgccgcccgtgggcaaggccgagctggaggacggggcctaccggatcaagcagaagggcatcctggggtactcccagatcggcgccggcgtgtacaaggaggggaccttccacaccatgtggcacgtcacgcgcggcgcggtgctcatgcacaaggggaagcggatcgagcccagctgggccgacgtgaagaaggacctgatctcctacggcgggggctggaagctggagggcgagtggaaggagggggaggaggtccaggtgctcgccctggagcccggcaagaacccgcgcgccgtgcagaccaagcccgggctgttcaagaccaacaccggcacgatcggggccgtcagcctcgacttctcccccggcaccagcggctcccccatcgtggacaagaaggggaaggtggtcggcctgtacgggaacggcgtggtgacccggagcggcacctacgtctccgcgatcgcccagacggagaagtccatcgaggacaacccggagatcgaggacgacatcttccgcaagaagcggctgaccatcatggacctgcaccccggggccggcaagaccaagcgctacctccccgccatcgtgcgggaggcgatcaagcgcgggctgcggaccctgatcctcgcccccacgcgcgtggtcgccgccgagatggaggaggccctgcgcggcctgccgatccggtaccagacccccgcgatccgcgccgagcacaccgggcgggagatcgtggacctcatgtgccacgccaccttcacgatgcgcctgctgagccccatccgggtgcccaactacaacctcatcatcatggacgaggcccacttcaccgacccggcctccatcgcggcccgcggctacatcagcacccgggtcgagatgggcgaggccgccgggatcttcatgaccgccacgccgcccggctcccgcgaccccttcccgcagagcaacgcgcccatcatggacgaggagcgggagatccccgagcgctcctggaacagcgggcacgagtgggtgaccgacttcaagggcaagaccgtgtggttcgtcccctccatcaaggccgggaacgacatcgccgcctgcctgcggaagaacggcaagaaggtgatccagctgagccgcaagaccttcgactccgagtacatcaagacgcggaccaacgactgggacttcgtggtcaccaccgacatcagcgagatgggcgcgaacttcaaggccgagcgcgtgatcgacccgcggcgctgcatgaagcccgtgatcctcacggacggggaggagcgggtcatcctggccggccccatgcccgtgacccactccagcgccgcccagcgccgggggcgcgtgggccgcaacccgaagaacgagaacgaccagtacatctacatgggggagcccctggagaacgacgaggactgcgcgcactggaaggaggccaagatgctcctggacaacatcaacacccccgagggcatcatcccctccatgttcgagccggagcgggagaaggtcgacgccatcgacggcgagtaccgcctgcgcggggaggcccgcaagaccttcgtggacctcatgcggcgcggcgacctgcccgtctggctggcctaccgggtggcggccgaggggatcaactacgtggaccgccggtggtgcttcgacggcgtcaagaacaaccagatcctcgaggagaacgtggaggtggagatctggacgaaggagggggagcgcaagaagctgaagccccggtggctggacgcccgcatctacagcgacccgctcgccctgaaggagttcaaggagttcgccgcgggccggaagtccctgaccctcaacctgatcaccgagatgggccgcctgcccaccttcatgacgcagaaggccaagaacgccctcgacaacctggccgtcctgcacaccgcggaggccgggggccgggcctacaaccacgccctcagcgagctgcccgagaccctggagaccctcctgctgctcacgctgctggccaccgtgaccgggggcatcttcctcttcctgatgtccggcaaggggatcggcaagatgaccctggggatgtgctgcatcatcaccgcgagcatcctcctgtggtacgcccagatccagccccactggatcgccgcctccatcatcctggagttcttcctcatcgtgctgctgatcccggagcccgagaagcagcgcacgccccaggacaaccagctcacctacgtcgtgatcgccatcctgaccgtggtcgcggccaccatggccaacgagatgggcttcctggagaagacgaagaaggacttcgggctcggcagcatcaccacccagcagcccgagagcaacatcctggacatcgacctgcggccggcctccgcctggaccctctacgcggtggccacgaccttcatcacccccatgctgcgccacagcatcgagaactccagcgtgaacgtctccctgaccgccatcgccaaccaggccacggtgctcatgggcctggggaagggctggcccctgagcaagatggacatcggggtgcccctcctggcgatcggctgctactcccaggtcaacccgatcaccctgaccgccgccctcctgctgctcgtggcccactacgcgatcatcgggcccggcctgcaggccaaggccacccgggaggcccagaagcgcgccgcggccggcatcatgaagaaccccacggtggacgggatgaccgtcatcgacctggaccccatcccgtacgaccccaagttcgagaagcagctcggccaggtgatgctgctggtgctctgcgtcacccaggtgctgatgatgcggaccacgtgggccctgtgcgaggccctcaccctggccaccgggcccatcagcaccctgtgggagggcaaccccgggcgcttctggaacacgaccatcgcggtgtccatggccaacatcttccgcggcagctacctcgccggcgccgggctgctgttctccatcatgaagaacaccgccaacacccggcgcggcacggggaacaccggcgagaccctcggcgagaagtggaagaaccggctgaacgcgctgggcaagagcgagttccagatctacaagaagtccggcatccaggaggtcgaccgcaccctcgccaaggaggggatcaagcggggcgagacggaccaccacgccgtgagccgcgggtccgccaagctgcggtggttcgtggagcgcaacctggtcaccccggagggcaaggtggtggacctcggctgcgggcggggcgggtggagctactactgcggcgggctgaagaacgtcaaggaggtgaagggcctgaccaagggcgggcccggccacgaggagcccatccccatgtccacctacgggtggaacctcgtgcgcctgcagagcggcgtcgacgtgttcttcacgccgcccgagaagtgcgacaccctgctctgcgacatcggggagtccagccccaaccccaccgtggaggcgggccggaccctgcgcgtcctgaacctcgtggagaactggctgaacaacaacacccagttctgcatcaaggtgctgaacccgtacatgcccagcgtcatcgagaagatggaggccctgcagcggaagtacggcggggccctcgtgcgcaaccccctgtcccggaacagcacgcacgagatgtactgggtgtccaacgccagcggcaacatcgtctccagcgtgaacatgatctcccgcatgctgatcaaccggttcaccatgcgccacaagaaggccacctacgagccggacgtggacctcgggagcggcacccggaacatcgggatcgagtccgagacgcccaacctggacatcatcggcaagcgcatcgagaagatcaagcaggagcacgagaccagctggcactacgaccaggaccacccctacaagacctgggcgtaccacggctcctacgagaccaagcagacggggagcgcctccagcatggtcaacggcgtggtgcgcctgctcaccaagccctgggacgtcatcccgatggtgacccagatggccatgaccgacacgacccccttcgggcagcagcgggtcttcaaggagaaggtggacacccgcacccaggagcccaaggagggcacgaagaagctgatgaagatcaccgccgagtggctgtggaaggagctcggcaagaagaagacgccccggatgtgcacccgcgaggagttcacgcggaaggtgcgctccaacgccgcgctgggggccatcttcaccgacgagaacaagtggaagtccgcccgggaggccgtcgaggactccggcttctgggagctggtggacaaggagcgcaacctccacctggaggggaagtgcgagacctgcgtgtacaacatgatgggcaagcgggagaagaagctgggggagttcggcaaggccaagggcagccgcgcgatctggtacatgtggctcggggcccggttcctggagttcgaggccctgggcttcctcaacgaggaccactggttctcccgcgagaacagcctgagcggggtcgagggcgaggggctgcacaagctcggctacatcctgcgggacgtgtccaagaaggagggcggggccatgtacgcggacgacaccgccggctgggacacgcgcatcaccctggaggacctcaagaacgaggagatggtgaccaaccacatggagggggagcacaagaagctggccgaggccatcttcaagctgacctaccagaacaaggtcgtgcgggtgcagcgcccgacgccccggggcaccgtcatggacatcatcagccgccgggaccagcgcgggtccggccaggtggtgacctacggcctcaacaccttcacgaacatggaggcccagctgatccggcagatggagggggagggcgtcttcaagagcatccagcagctgaccgtgaaggaggagatcgcggtgaagaactggctcatccgcgtcgggcgcgagcggctgtcccgcatggccatcagcggcgacgactgcgtggtgaagcccctggacgaccggttcgcctccgccctcaccgccctgaacgacatgggcaaggtccgcaaggacatccagcagtgggagcccagccgggggtggaacgactggacccaggtgccgttctgctcccaccacttccacgagctgatcatgaaggacggccgcgtgctcgtcgtgccctgccggaaccaggacgagctgatcgggcgcgcgcggatcagccagggcgccgggtggtccctgcgcgagacggcctgcctcggcaagagctacgcccagatgtggtccctgatgtacttccaccggcgcgacctgcggctcgccgcgaacgccatctgcagcgccgtgccctcccactggatccccaccagccgcaccacctggtccatccacgccacccacgagtggatgacgaccgaggacatgctgaccgtctggaaccgggtgtggatccaggagaacccgtggatggaggacaagacccccgtggagagctgggaggagatcccctacctgggcaagcgcgaggaccagtggtgcgggagcctcatcggcctgacgtcccgggccacctgggcgaagaacatccagaccgccatcaaccaggtccgcagcctgatcgggaacgaggagtacaccgactacatgccctccatgaagcggttccgccgcgaggaggaggaggccggcgtgctctggtga

SEQ ID NO: 9084 - RNA, 9876 nt, synthetic construct
  misc_feature 1..9876: note = derived and/or modified CDS sequence (opt1) from DENV-2__KM279552__SS-prME
  source 1..9876: mol_type = other RNA
accgcggggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgagcagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggtccctgcgcccccagccgaccgagctgaagtacagctggaaggcgtggggcaaggccaagatgctctccaccgagctgcacaaccacacgttcctgatcgacggccccgagaccgccgagtgccccaacaccaaccgggcctggaacagcctcgaggtggaggactacgggttcggcgtcttcaccacgaacatctggctgaagctgaaggagcgccaggacgtgttctgcgactccaagctcatgagcgccgcgatcaaggacaaccgggccgtgcacgccgacatggggtactggatcgagtccgccctgaacgacacctggaagatcgagaaggccagcttcatcgaggtcaagtcctgccactggcccaagagccacaccctgtggtccaacggcgtgctcgagagcgagatgatcatccccaagaacttcgcgggccccgtgtcccagcacaactaccgccccgggtaccacacccagaccgccggcccgtggcacctggggcggctggagatggacttcgacttctgcgagggcacgaccgtcgtggtgaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtcaacagcctcgtgacggccggccacgggcagatcgacaacttctccctgggcgtgctgggcatggccctcttcctggaggagatgctgcgcacccgggtcgggaccaagcacgccatcctcctggtggccgtgagcttcgtcaccctgatcacgggcaacatgtccttccgcgacctcgggcgcgtgatggtgatggtcggcgccaccatgaccgacgacatcgggatgggcgtgacctacctggccctgctcgcggccttcaaggtgcggcccacgttcgccgccggcctgctgctccgcaagctgaccagcaaggagctgatgatgaccaccatcgggatcgtcctcctgtcccacagcacgatccccgagtccatcctggagctcaccgacgccctggcgctgggcatgatggtgctcaagatcgtccggaacatggagaagtaccagctggccgtgaccatcatggccatcctgtgcgtgcccaacgccgtcatcctccagaacgcctggaaggtgagctgcaccacgctggcggtggtctccgtgagcccgctgctcctgacctccagccagcagaaggccgactggatccccctggccctcaccatcaaggggctgaaccccaccgccatcttcctgacgaccctctcccgcaccagcaagaagcggtcctggcccctgaacgaggcgatcatggccgtgggcatggtcagcatcctggcctccagcctcctgaagaacgacatcccgatgaccggccccctggtggccgggggcctcctgacggtgtgctacgtcctgaccgggcgcagcgccgacctcgagctggagcgggcggccgacgtgcgctgggaggagcaggccgagatctccggcagctcccccatcctgagcatcaccatctccgaggacgggagcatgtccatcaagaacgaggaggaggagcagaccctcacgatcctgatccggaccggcctgctcgtgatcagcggcctgttccccgtctccatcccgatcaccgccgccgcgtggtacctgtgggaggtgaagaagcagcgcgccggggtgctctgggacgtcccctccccgccgcccgtgggcaaggccgagctggaggacggggcctaccggatcaagcagaagggcatcctggggtactcccagatcggcgccggcgtgtacaaggaggggaccttccacaccatgtggcacgtcacgcgcggcgcggtgctcatgcacaaggggaagcggatcgagcccagctgggccgacgtgaagaaggacctgatctcctacggcgggggctggaagctggagggcgagtggaaggagggggaggaggtccaggtgctcgccctggagcccggcaagaacccgcgcgccgtgcagaccaagcccgggctgttcaagaccaacaccggcacgatcggggccgtcagcctcgacttctcccccggcaccagcggctcccccatcgtggacaagaaggggaaggtggtcggcctgtacgggaacggcgtggtgacccggagcggcacctacgtctccgcgatcgcccagacggagaagtccatcgaggacaacccggagatcgaggacgacatcttccgcaagaagcggctgaccatcatggacctgcaccccggggccggcaagaccaagcgctacctccccgccatcgtgcgggaggcgatcaagcgcgggctgcggaccctgatcctcgcccccacgcgcgtggtcgccgccgagatggaggaggccctgcgcggcctgccgatccggtaccagacccccgcgatccgcgccgagcacaccgggcgggagatcgtggacctcatgtgccacgccaccttcacgatgcgcctgctgagccccatccgggtgcccaactacaacctcatcatcatggacgaggcccacttcaccgacccggcctccatcgcggcccgcggctacatcagcacccgggtcgagatgggcgaggccgccgggatcttcatgaccgccacgccgcccggctcccgcgaccccttcccgcagagcaacgcgcccatcatggacgaggagcgggagatccccgagcgctcctggaacagcgggcacgagtgggtgaccgacttcaagggcaagaccgtgtggttcgtcccctccatcaaggccgggaacgacatcgccgcctgcctgcggaagaacggcaagaaggtgatccagctgagccgcaagaccttcgactccgagtacatcaagacgcggaccaacgactgggacttcgtggtcaccaccgacatcagcgagatgggcgcgaacttcaaggccgagcgcgtgatcgacccgcggcgctgcatgaagcccgtgatcctcacggacggggaggagcgggtcatcctggccggccccatgcccgtgacccactccagcgccgcccagcgccgggggcgcgtgggccgcaacccgaagaacgagaacgaccagtacatctacatgggggagcccctggagaacgacgaggactgcgcgcactggaaggaggccaagatgctcctggacaacatcaacacccccgagggcatcatcccctccatgttcgagccggagcgggagaaggtcgacgccatcgacggcgagtaccgcctgcgcggggaggcccgcaagaccttcgtggacctcatgcggcgcggcgacctgcccgtctggctggcctaccgggtggcggccgaggggatcaactacgccgaccgccggtggtgcttcgacggcgtgaagaacaaccagatcctcgaggagaacgtcgaggtggagatctggacgaaggagggggagcgcaagaagctgaagccccggtggctggacgcccgcatctacagcgacccgctcgccctgaaggagttcaaggagttcgcggccggccggaagtccctgaccctcaacctgatcaccgagatgggccgcctgcccaccttcatgacgcagaaggccaagaacgccctcgacaacctggcggtgctgcacaccgccgaggccgggggccgggcctacaaccacgccctcagcgagctgcccgagaccctggagaccctcctgctgctcacgctgctggcgaccgtcaccgggggcatcttcctcttcctgatgtccggcaaggggatcggcaagatgaccctggggatgtgctgcatcatcaccgccagcatcctcctgtggtacgcccagatccagccccactggatcgccgcctccatcatcctggagttcttcctcatcgtgctgctgatcccggagcccgagaagcagcgcacgccccaggacaaccagctcacctacgtggtcatcgcgatcctgaccgtggtggccgccaccatggccaacgagatgggcttcctggagaagacgaagaaggacttcgggctcggcagcatcaccacccagcagcccgagagcaacatcctggacatcgacctgcggccggcctccgcgtggaccctctacgccgtcgccacgaccttcatcacccccatgctgcgccacagcatcgagaactccagcgtgaacgtgtccctgaccgccatcgccaaccaggcgacggtcctcatgggcctggggaagggctggcccctgagcaagatggacatcggggtgcccctcctggccatcggctgctactcccaggtgaacccgatcaccctgaccgccgccctcctgctgctcgtcgcgcactacgccatcatcgggcccggcctgcaggccaaggccacccgggaggcccagaagcgcgcggccgccggcatcatgaagaaccccacggtggacgggatgaccgtgatcgacctggaccccatcccgtacgaccccaagttcgagaagcagctcggccaggtcatgctgctggtgctctgcgtgacccaggtcctgatgatgcggaccacgtgggccctgtgcgaggccctcaccctggcgaccgggcccatcagcaccctgtgggagggcaaccccgggcgcttctggaacacgaccatcgccgtgtccatggccaacatcttccgcggcagctacctcgccggcgccgggctgctgttctccatcatgaagaacaccgcgaacacccggcgcggcacggggaacaccggcgagaccctcggcgagaagtggaagaaccggctgaacgccctgggcaagagcgagttccagatctacaagaagtccggcatccaggaggtggaccgcaccctcgccaaggaggggatcaagcggggcgagacggaccaccacgccgtcagccgcgggtccgcgaagctgcggtggttcgtggagcgcaacctggtgaccccggagggcaaggtcgtggacctcggctgcgggcggggcgggtggagctactactgcggcgggctgaagaacgtgaaggaggtcaagggcctgaccaagggcgggcccggccacgaggagcccatccccatgtccacctacgggtggaacctcgtgcgcctgcagagcggcgtggacgtcttcttcacgccgcccgagaagtgcgacaccctgctctgcgacatcggggagtccagccccaaccccaccgtggaggccggccggaccctgcgcgtgctgaacctcgtcgagaactggctgaacaacaacacccagttctgcatcaaggtgctgaacccgtacatgcccagcgtgatcgagaagatggaggccctgcagcggaagtacggcggggccctcgtccgcaaccccctgtcccggaacagcacgcacgagatgtactgggtgtccaacgccagcggcaacatcgtgtccagcgtcaacatgatctcccgcatgctgatcaaccggttcaccatgcgccacaagaaggcgacctacgagccggacgtggacctcgggagcggcacccggaacatcgggatcgagtccgagacgcccaacctggacatcatcggcaagcgcatcgagaagatcaagcaggagcacgagaccagctggcactacgaccaggaccacccctacaagacctgggcctaccacggctcctacgagaccaagcagacggggagcgcctccagcatggtgaacggcgtcgtgcgcctgctcaccaagccctgggacgtgatcccgatggtcacccagatggccatgaccgacacgacccccttcgggcagcagcgggtgttcaaggagaaggtcgacacccgcacccaggagcccaaggagggcacgaagaagctgatgaagatcaccgccgagtggctgtggaaggagctcggcaagaagaagacgccccggatgtgcacccgcgaggagttcacgcggaaggtgcgctccaacgcggccctgggggccatcttcaccgacgagaacaagtggaagtccgcccgggaggccgtggaggactccggcttctgggagctggtcgacaaggagcgcaacctccacctggaggggaagtgcgagacctgcgtgtacaacatgatgggcaagcgggagaagaagctgggggagttcggcaaggcgaagggcagccgcgccatctggtacatgtggctcggggcccggttcctggagttcgaggccctgggcttcctcaacgaggaccactggttctcccgcgagaacagcctgagcggggtggagggcgaggggctgcacaagctcggctacatcctgcgggacgtctccaagaaggagggcggggcgatgtacgccgacgacaccgccggctgggacacgcgcatcaccctggaggacctcaagaacgaggagatggtgaccaaccacatggagggggagcacaagaagctggccgaggccatcttcaagctgacctaccagaacaaggtggtccgggtgcagcgcccgacgccccggggcaccgtgatggacatcatcagccgccgggaccagcgcgggtccggccaggtcgtgacctacggcctcaacaccttcacgaacatggaggcgcagctgatccggcagatggagggggagggcgtgttcaagagcatccagcagctgaccgtcaaggaggagatcgccgtgaagaactggctcatccgcgtggggcgcgagcggctgtcccgcatggccatcagcggcgacgactgcgtcgtgaagcccctggacgaccggttcgcctccgccctcaccgcgctgaacgacatgggcaaggtgcgcaaggacatccagcagtgggagcccagccgggggtggaacgactggacccaggtcccgttctgctcccaccacttccacgagctgatcatgaaggacggccgcgtgctcgtggtcccctgccggaaccaggacgagctgatcgggcgcgcccggatcagccagggcgccgggtggtccctgcgcgagacggcctgcctcggcaagagctacgcccagatgtggtccctgatgtacttccaccggcgcgacctgcggctcgcggccaacgccatctgcagcgccgtgccctcccactggatccccaccagccgcaccacctggtccatccacgccacccacgagtggatgacgaccgaggacatgctgaccgtgtggaaccgggtctggatccaggagaacccgtggatggaggacaagacccccgtggagagctgggaggagatcccctacctgggcaagcgcgaggaccagtggtgcgggagcctcatcggcctgacgtcccgggcgacctgggccaagaacatccagaccgccatcaaccaggtgcgcagcctgatcgggaacgaggagtacaccgactacatgccctccatgaagcggttccgccgcgaggaggaggaggccggcgtcctctggtga

SEQ ID NO: 9085 - RNA, 9876 nt, synthetic construct
  misc_feature 1..9876: note = derived and/or modified CDS sequence (opt1) from DENV-2__KM279557__SS-prME
  source 1..9876: mol_type = other RNA
accgcggggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgagcagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggtccctgcgcccccagccgaccgagctgaagtacagctggaaggcgtggggcaaggccaagatgctctccaccgagctgcacaaccacacgttcctgatcgacggccccgagaccgccgagtgccccaacaccaaccgggcctggaacagcctcgaggtggaggactacgggttcggcgtcttcaccacgaacatctggctgaagctgaaggagcgccaggacgtgttctgcgactccaagctcatgagcgccgcgatcaaggacaaccgggccgtgcacgccgacatggggtactggatcgagtccgccctgaacgacacctggaagatcgagaaggccagcttcatcgaggtcaagtcctgccactggcccaagagccacaccctgtggtccaacggcgtgctcgagagcgagatgatcatccccaagaacttcgcgggccccgtgtcccagcacaactaccgccccgggtaccacacccagaccgccggcccgtggcacctggggcggctggagatggacttcgacttctgcgagggcacgaccgtcgtggtgaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtcaacagcctcgtgacggccggccacgggcagatcgacaacttctccctgggcgtgctgggcatggccctcttcctggaggagatgctgcgcacccgggtcgggaccaagcacgccatcctcctggtggccgtgagcttcgtcaccctgatcacgggcaacatgtccttccgcgacctcgggcgcgtgatggtgatggtcggcgccaccatgaccgacgacatcgggatgggcgtgacctacctggccctgctcgcggccttcaaggtgcggcccacgttcgccgccggcctgctgctccgcaagctgaccagcaaggagctgatgatgaccaccatcgggatcgtcctcctgtcccagagcacgatccccgagtccatcctggagctcaccgacgccctggcgctgggcatgatggtgctcaagatcgtccggaacatggagaagtaccagctggccgtgaccatcatggccatcctgtgcgtgcccaacgccgtcatcctccagaacgcctggaaggtgagctgcaccacgctggcggtggtctccgtgagcccgctgctcctgacctccagccagcagaaggccgactggatccccctggccctcaccatcaaggggctgaaccccaccgccatcttcctgacgaccctctcccgcaccagcaagaagcggtcctggcccctgaacgaggcgatcatggccgtgggcatggtcagcatcctggcctccagcctcctgaagaacgacatcccgatgaccggccccctggtggccgggggcctcctgacggtgtgctacgtcctgaccgggcgcagcgccgacctcgagctggagcgggcggccgacgtgcgctgggaggagcaggccgagatctccggcagctcccccatcctgagcatcaccatctccgaggacgggagcatgtccatcaagaacgaggaggaggagcagaccctcacgatcctgatccggaccggcctgctcgtgatcagcggcctgttccccgtctccatcccgatcaccgccgccgcgtggtacctgtgggaggtgaagaagcagcgcgccggggtgctctgggacgtcccctccccgccgcccgtgggcaaggccgagctggaggacggggcctaccggatcaagcagaagggcatcctggggtactcccagatcggcgccggcgtgtacaaggaggggaccttccacaccatgtggcacgtcacgcgcggcgcggtgctcatgcacaaggggaagcggatcgagcccagctgggccgacgtgaagaaggacctgatctcctacggcgggggctggaagctggagggcgagtggaaggagggggaggaggtccaggtgctcgccctggagcccggcaagaacccgcgcgccgtgcagaccaagcccgggctgttcaagaccaacaccggcacgatcggggccgtcagcctcgacttctcccccggcaccagcggctcccccatcgtggacaagaaggggaaggtggtcggcctgtacgggaacggcgtggtgacccggagcggcacctacgtctccgcgatcgcccagacggagaagtccatcgaggacaacccggagatcgaggacgacatcttccgcaagaagcggctgaccatcatggacctgcaccccggggccggcaagaccaagcgctacctccccgccatcgtgcgggaggcgatcaagcgcgggctgcggaccctgatcctcgcccccacgcgcgtggtcgccgccgagatggaggaggccctgcgcggcctgccgatccggtaccagacccccgcgatccgcgccgagcacaccgggcgggagatcgtggacctcatgtgccacgccaccttcacgatgcgcctgctgagccccatccgggtgcccaactacaacctcatcatcatggacgaggcccacttcaccgacccggcctccatcgcggcccgcggctacatcagcacccgggtcgagatgggcgaggccgccgggatcttcatgaccgccacgccgcccggctcccgcgaccccttcccgcagagcaacgcgcccatcatggacgaggagcgggagatccccgagcgctcctggaacagcgggcacgagtgggtgaccgacttcaagggcaagaccgtgtggttcgtcccctccatcaaggccgggaacgacatcgccgcctgcctgcggaagaacggcaagaaggtgatccagctgagccgcaagaccttcgactccgagtacatcaagacgcggaccaacgactgggacttcgtggtcaccaccgacatcagcgagatgggcgcgaacttcaaggccgagcgcgtgatcgacccgcggcgctgcatgaagcccgtgatcctcacggacggggaggagcgggtcatcctggccggccccatgcccgtgacccactccagcgccgcccagcgccgggggcgcgtgggccgcaacccgaagaacgagaacgaccagtacatctacatgggggagcccctggagaacgacgaggactgcgcgcactggaaggaggccaagatgctcctggacaacatcaacacccccgagggcatcatcccctccatgttcgagccggagcgggagaaggtcgacgccatcgacggcgagtaccgcctgcgcggggaggcccgcaagaccttcgtggacctcatgcggcgcggcgacctgcccgtctggctggcctaccgggtggcggccgaggggatcaactacgccgaccgccggtggtgcttcgacggcgtgaagaacaaccagatcctcgaggagaacgtcgaggtggagatctggacgaaggagggggagcgcaagaagctgaagccccggtggctggacgcccgcatctacagcgacccgctcgccctgaaggagttcaaggagttcgcggccggccggaagtccctgaccctcaacctgatcaccgagatgggccgcctgcccaccttcatgacgcagaaggccaagaacgccctcgacaacctggcggtgctgcacaccgccgaggccgggggccgggcctacaaccacgccctcagcgagctgcccgagaccctggagaccctcctgctgctcacgctgctggcgaccgtcaccgggggcatcttcctcttcctgatgtccggcaaggggatcggcaagatgaccctggggatgtgctgcatcatcaccgccagcatcctcctgtggtacgcccagatccagccccactggatcgccgcctccatcatcctggagttcttcctcatcgtgctgctgatcccggagcccgagaagcagcgcacgccccaggacaaccagctcacctacgtggtcatcgcgatcctgaccgtggtggccgccaccatggccaacgagatgggcttcctggagaagacgaagaaggacttcgggctcggcagcatcaccacccagcagcccgagagcaacatcctggacatcgacctgcggccggcctccgcgtggaccctctacgccgtcgccacgaccttcatcacccccatgctgcgccacagcatcgagaactccagcgtgaacgtgtccctgaccgccatcgccaaccaggcgacggtcctcatgggcctggggaagggctggcccctgagcaagatggacatcggggtgcccctcctggccatcggctgctactcccaggtgaacccgatcaccctgaccgccgccctcctgctgctcgtcgcgcactacgccatcatcgggcccggcctgcaggccaaggccacccgggaggcccagaagcgcgcggccgccggcatcatgaagaaccccacggtggacgggatgaccgtgatcgacctggaccccatcccgtacgaccccaagttcgagaagcagctcggccaggtcatgctgctggtgctctgcgtgacccaggtcctgatgatgcggaccacgtgggccctgtgcgaggccctcaccctggcgaccgggcccatcagcaccctgtgggagggcaaccccgggcgcttctggaacacgaccatcgccgtgtccatggccaacatcttccgcggcagctacctcgccggcgccgggctgctgttctccatcatgaagaacaccgcgaacacccggcgcggcacggggaacaccggcgagaccctcggcgagaagtggaagaaccggctgaacgccctgggcaagagcgagttccagatctacaagaagtccggcatccaggaggtggaccgcaccctcgccaaggaggggatcaagcggggcgagacggaccaccacgccgtcagccgcgggtccgcgaagctgcggtggttcgtggagcgcaacctggtgaccccggagggcaaggtcgtggacctcggctgcgggcggggcgggtggagctactactgcggcgggctgaagaacgtgaaggaggtcaagggcctgaccaagggcgggcccggccacgaggagcccatccccatgtccacctacgggtggaacctcgtgcgcctgcagagcggcgtggacgtcttcttcacgccgcccgagaagtgcgacaccctgctctgcgacatcggggagtccagccccaaccccaccgtggaggccggccggaccctgcgcgtgctgaacctcgtcgagaactggctgaacaacaacacccagttctgcatcaaggtgctgaacccgtacatgcccagcgtgatcgagaagatggaggccctgcagcggaagtacggcggggccctcgtccgcaaccccctgtcccggaacagcacgcacgagatgtactgggtgtccaacgccagcggcaacatcgtgtccagcgtcaacatgatctcccgcatgctgatcaaccggttcaccatgcgccacaagaaggcgacctacgagccggacgtggacctcgggagcggcacccggaacatcgggatcgagtccgagacgcccaacctggacatcatcggcaagcgcatcgagaagatcaagcaggagcacgagaccagctggcactacgaccaggaccacccctacaagacctgggcctaccacggctcctacgagaccaagcagacggggagcgcctccagcatggtgaacggcgtcgtgcgcctgctcaccaagccctgggacgtgatcccgatggtcacccagatggccatgaccgacacgacccccttcgggcagcagcgggtgttcaaggagaaggtcgacacccgcacccaggagcccaaggagggcacgaagaagctgatgaagatcaccgccgagtggctgtggaaggagctcggcaagaagaagacgccccggatgtgcacccgcgaggagttcacgcggaaggtgcgctccaacgcggccctgggggccatcttcaccgacgagaacaagtggaagtccgcccgggaggccgtggaggactccggcttctgggagctggtcgacaaggagcgcaacctccacctggaggggaagtgcgagacctgcgtgtacaacatgatgggcaagcgggagaagaagctgggggagttcggcaaggcgaagggcagccgcgccatctggtacatgtggctcggggcccggttcctggagttcgaggccctgggcttcctcaacgaggaccactggttctcccgcgagaacagcctgagcggggtggagggcgaggggctgcacaagctcggctacatcctgcgggacgtctccaagaaggagggcggggcgatgtacgccgacgacaccgccggctgggacacgcgcatcaccctggaggacctcaagaacgaggagatggtgaccaaccacatggagggggagcacaagaagctggccgaggccatcttcaagctgacctaccagaacaaggtggtccgggtgcagcgcccgacgccccggggcaccgtgatggacatcatcagccgccgggaccagcgcgggtccggccaggtcgtgacctacggcctcaacaccttcacgaacatggaggcgcagctgatccggcagatggagggggagggcgtgttcaagagcatccagcagctgaccgtcaaggaggagatcgccgtgaagaactggctcatccgcgtggggcgcgagcggctgtcccgcatggccatcagcggcgacgactgcgtcgtgaagcccctggacgaccggttcgcctccgccctcaccgcgctgaacgacatgggcaaggtgcgcaaggacatccagcagtgggagcccagccgggggtggaacgactggacccaggtcccgttctgctcccaccacttccacgagctgatcatgaaggacggccgcgtgctcgtggtcccctgccggaaccaggacgagctgatcgggcgcgcccggatcagccagggcgccgggtggtccctgcgcgagacggcctgcctcggcaagagctacgcccagatgtggtccctgatgtacttccaccggcgcgacctgcggctcgcggccaacagcatctgctccgccgtgcccagccactggatccccacctcccgcaccacctggagcatccacgccacccacgagtggatgacgaccgaggacatgctgaccgtgtggaaccgggtctggatccaggagaacccgtggatggaggacaagacccccgtggagagctgggaggagatcccctacctgggcaagcgcgaggaccagtggtgcgggtccctcatcggcctgacgagccgggccacctgggcgaagaacatccagaccgccatcaaccaggtgcgctccctgatcgggaacgaggagtacaccgactacatgcccagcatgaagcggttccgccgcgaggaggaggaggccggcgtcctctggtga

SEQ ID NO: 9086 - RNA, 9876 nt, synthetic construct
  misc_feature 1..9876: note = derived and/or modified CDS sequence (opt1) from DENV-2__KM279591__SS-prME
  source 1..9876: mol_type = other RNA
accgcgggcatcatcatcatgatgatccccaccgtgatggccttccacctgaccacccggaacggggagccccacatgatcgtcagccggcaggagaagggcaagtccctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcaccatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggaccctgcgcccccagccgaccgagctgaagtactcctggaaggcgtggggcaaggccaagatgctcagcacggagctgcacaaccacaccttcctgatcgacggccccgagaccgccgagtgccccaacaccaaccgggcctggaactccctcgaggtggaggactacgggttcggcgtcttcacgaccaacatctggctgaagctgaaggagcgccaggacgtgttctgcgacagcaagctcatgtccgccgcgatcaaggacaaccgggccgtgcacgccgacatggggtactggatcgagagcgccctgaacgacacctggaagatcgagaaggcctccttcatcgaggtcaagagctgccactggccgaagtcccacaccctgtggagcaacggcgtgctcgagtccgagatgatcatccccaagaacttcgcgggccccgtgagccagcacaactaccgccccgggtaccacacccagacggccggcccgtggcacctggggcggctggagatggacttcgacttctgcgagggcaccaccgtcgtggtgaccgaggactgcgggaaccgcggcccctccctccggacgaccaccgccagcggcaagctgatcaccgagtggtgctgccgcagctgcacgctgccgcccctccggtaccgcggggaggacggctgctggtacgggatggagatccggccgctgaaggagaaggaggagaacctggtcaactccctcgtgaccgccggccacgggcagatcgacaacttcagcctgggcgtgctgggcatggccctcttcctggaggagatgctgcgcacccgggtcgggaccaagcacgccatcctcctggtggccgtgtccttcgtcacgctgatcaccggcaacatgagcttccgcgacctcgggcgcgtgatggtgatggtcggcgccaccatgaccgacgacatcgggatgggcgtgacgtacctggccctgctcgcggccttcaaggtgcggcccaccttcgccgccggcctgctgctccgcaagctgacctccaaggagctgatgatgaccacgatcgggatcgtcctcctgagccagtccaccatccccgagagcatcctggagctcaccgacgccctggcgctgggcatgatggtgctcaagatcgtccggaacatggagaagtaccagctggccgtgaccatcatggccatcctgtgcgtgcccaacgccgtcatcctccagaacgcctggaaggtgtcctgcacgaccctggcggtggtcagcgtgtccccgctgctcctgaccagctcccagcagaaggccgactggatccccctggccctcaccatcaaggggctgaaccccacggccatcttcctgaccaccctcagccgcacctccaagaagcggagctggcccctgaacgaggcgatcatggccgtgggcatggtctccatcctggccagctccctcctgaagaacgacatcccgatgacgggccccctggtggccgggggcctcctgaccgtgtgctacgtcctgaccgggcgcagcgccgacctcgagctggagcgggcggccgacgtgcgctgggaggagcaggccgagatcagcggctccagccccatcctgtccatcaccatcagcgaggacgggtccatgagcatcaagaacgaggaggaggagcagacgctcaccatcctgatccggaccggcctgctcgtgatctccggcctgttccccgtcagcatcccgatcaccgccgccgcgtggtacctgtgggaggtgaagaagcagcgcgccggggtgctctgggacgtccccagcccgccgcccgtgggcaaggccgagctggaggacggggcctaccggatcaagcagaagggcatcctggggtacagccagatcggcgccggcgtgtacaaggaggggaccttccacacgatgtggcacgtcacccgcggcgcggtgctcatgcacaaggggaagcggatcgagccctcctgggccgacgtgaagaaggacctgatcagctacggcgggggctggaagctggagggcgagtggaaggagggggaggaggtccaggtgctcgccctggagcccggcaagaacccccgcgccgtgcagaccaagcccgggctgttcaagaccaacacgggcaccatcggggccgtctccctcgacttcagccccggcacctccggcagccccatcgtggacaagaaggggaaggtggtcggcctgtacgggaacggcgtggtgacccggtccggcacgtacgtcagcgcgatcgcccagaccgagaagtccatcgaggacaacccggagatcgaggacgacatcttccgcaagaagcggctgaccatcatggacctgcaccccggggccggcaagaccaagcgctacctccccgccatcgtgcgggaggcgatcaagcgcgggctgcggacgctgatcctcgcccccacccgcgtggtcgccgccgagatggaggaggccctgcgcggcctgccgatccggtaccagacccccgcgatccgcgccgagcacaccgggcgggagatcgtggacctcatgtgccacgccacgttcaccatgcgcctgctgagccccatccgggtgcccaactacaacctcatcatcatggacgaggcccacttcaccgacccggccagcatcgcggcccgcggctacatctccacccgggtcgagatgggcgaggccgccgggatcttcatgacggccacgccgcccggcagccgcgaccccttcccgcagtccaacgcgcccatcatggacgaggagcgggagatccccgagcgcagctggaactccgggcacgagtgggtgaccgacttcaagggcaagaccgtgtggttcgtccccagcatcaaggccgggaacgacatcgccgcctgcctgcggaagaacggcaagaaggtgatccagctgtcccgcaagacgttcgacagcgagtacatcaagacccggaccaacgactgggacttcgtggtcaccacggacatctccgagatgggcgcgaacttcaaggccgagcgcgtgatcgacccgcggcgctgcatgaagcccgtgatcctcaccgacggggaggagcgggtcatcctggccggccccatgcccgtgacccacagctccgccgcccagcgccgggggcgcgtgggccgcaacccgaagaacgagaacgaccagtacatctacatgggggagcccctggagaacgacgaggactgcgcgcactggaaggaggccaagatgctcctggacaacatcaacacccccgagggcatcatccccagcatgttcgagccggagcgggagaaggtcgacgccatcgacggcgagtaccgcctgcgcggggaggcccgcaagacgttcgtggacctcatgcggcgcggcgacctgcccgtctggctggcctaccgggtggcggccgaggggatcaactacgtggaccgccggtggtgcttcgacggcgtcaagaacaaccagatcctcgaggagaacgtggaggtggagatctggaccaaggagggggagcgcaagaagctgaagccccggtggctggacgcccgcatctactccgacccgctcgccctgaaggagttcaaggagttcgccgcgggccgcaagagcctgaccctcaacctgatcaccgagatgggccggctgcccacgttcatgacccagaaggccaagaacgccctcgacaacctggccgtcctgcacaccgcggaggccgggggccgggcctacaaccacgccctctccgagctgcccgagaccctggagacgctcctgctgctcaccctgctggccaccgtgaccgggggcatcttcctcttcctgatgagcggcaaggggatcggcaagatgaccctggggatgtgctgcatcatcacggcgtccatcctcctgtggtacgcccagatccagccccactggatcgccgccagcatcatcctggagttcttcctcatcgtgctgctgatcccggagcccgagaagcagcgcacgccccaggacaaccagctcacctacgtcgtgatcgccatcctgaccgtggtcgcggccacgatggccaacgagatgggcttcctggagaagaccaagaaggacttcgggctcggctccatcaccacccagcagcccgagagcaacatcctggacatcgacctgcggccggccagcgcctggacgctctacgcggtggccaccaccttcatcacccccatgctgcgccactccatcgagaacagctccgtgaacgtcagcctgacggccatcgccaaccaggccaccgtgctcatgggcctggggaagggctggcccctgtccaagatggacatcggggtgcccctcctggcgatcggctgctacagccaggtcaacccgatcaccctgaccgccgccctcctgctgctcgtggcccactacgcgatcatcgggcccggcctgcaggccaaggccacgcgggaggcccagaagcgcgccgcggccggcatcatgaagaaccccaccgtggacgggatgaccgtcatcgacctggaccccatcccgtacgaccccaagttcgagaagcagctcggccaggtgatgctgctggtgctctgcgtcacccaggtgctgatgatgcggacgacctgggccctgtgcgaggccctcaccctggccaccgggcccatctccacgctgtgggagggcaaccccgggcgcttctggaacaccaccatcgcggtgagcatggccaacatcttccgcggctcctacctcgccggcgccgggctgctgttcagcatcatgaagaacaccgccaacacgcggcgcggcaccgggaacaccggcgagaccctcggcgagaagtggaagaaccggctgaacgcgctggggaagtccgagttccagatctacaagaagtccggcatccaggaggtcgaccgcacgctcgccaaggaggggatcaagcggggcgagaccgaccaccacgccgtgtcccgcgggagcgccaagctgcggtggttcgtggagcgcaacctggtcaccccggagggcaaggtggtggacctcggctgcgggcggggcgggtggtcctactactgcggcgggctgaagaacgtcaaggaggtgaagggcctgaccaagggcgggcccggccacgaggagcccatccccatgagcacgtacgggtggaacctcgtgcgcctgcagtccggcgtcgacgtgttcttcaccccgcccgagaagtgcgacaccctgctctgcgacatcggggagagctcccccaaccccaccgtggaggcgggccggaccctgcgcgtcctgaacctcgtggagaactggctgaacaacaacacgcagttctgcatcaaggtgctgaacccgtacatgcccagcgtcatcgagaagatggaggccctgcagcggaagtacggcggggccctcgtgcgcaaccccctgagccggaactccacccacgagatgtactgggtgagcaacgcctccggcaacatcgtcagctccgtgaacatgatcagccgcatgctgatcaaccggttcaccatgcgccacaagaaggccacctacgagccggacgtggacctcgggtccggcacgcggaacatcgggatcgagagcgagacccccaacctggacatcatcggcaagcgcatcgagaagatcaagcaggagcacgagacctcctggcactacgaccaggaccacccctacaagacctgggcgtaccacggcagctacgagacgaagcagaccgggtccgccagctccatggtcaacggcgtggtgcgcctgctcaccaagccctgggacgtcatcccgatggtgacccagatggccatgacggacaccacccccttcgggcagcagcgggtcttcaaggagaaggtggacacccgcacgcaggagcccaaggagggcaccaagaagctgatgaagatcaccgccgagtggctgtggaaggagctcggcaagaagaagacgccccggatgtgcacgcgcgaggagttcacccggaaggtgcgcagcaacgccgcgctgggggccatcttcaccgacgagaacaagtggaagtccgcccgggaggccgtcgaggacagcggcttctgggagctggtggacaaggagcgcaacctccacctggaggggaagtgcgagacctgcgtgtacaacatgatgggcaagcgggagaagaagctgggggagttcggcaaggccaagggctcccgcgcgatctggtacatgtggctcggggcccggttcctggagttcgaggccctgggcttcctcaacgaggaccactggttcagccgcgagaactccctgagcggggtcgagggcgaggggctgcacaagctcggctacatcctgcgggacgtgagcaagaaggagggcggggccatgtacgcggacgacacggccggctgggacacccgcatcaccctggaggacctcaagaacgaggagatggtgaccaaccacatggagggggagcacaagaagctggccgaggccatcttcaagctgacgtaccagaacaaggtcgtgcgggtgcagcgcccgacgccccggggcaccgtcatggacatcatctcccgccgggaccagcgcgggagcggccaggtggtgacctacggcctcaacaccttcaccaacatggaggcccagctgatccggcagatggagggggagggcgtcttcaagtccatccagcagctgaccgtgaaggaggagatcgcggtgaagaactggctcatccgcgtcgggcgcgagcggctgagccgcatggccatctccggcgacgactgcgtggtgaagcccctggacgaccggttcgccagcgccctcaccgccctgaacgacatgggcaaggtccgcaaggacatccagcagtgggagccctcccgggggtggaacgactggacccaggtgccgttctgcagccaccacttccacgagctgatcatgaaggacggccgcgtgctcgtcgtgccctgccggaaccaggacgagctgatcgggcgcgcgcggatctcccagggcgccgggtggagcctgcgcgagaccgcctgcctcggcaagtcctacgcccagatgtggagcctgatgtacttccaccggcgcgacctgcggctcgccgcgaacgccatctgctccgccgtgcccagccactggatccccacctcccgcaccacctggagcatccacgccacgcacgagtggatgaccaccgaggacatgctgaccgtctggaaccgggtgtggatccaggagaacccgtggatggaggacaagacgcccgtggagtcctgggaggagatcccctacctgggcaagcgcgaggaccagtggtgcgggagcctcatcggcctgaccagccgggccacctgggcgaagaacatccagaccgccatcaaccaggtccgctccctgatcgggaacgaggagtacacggactacatgcccagcatgaagcggttccgccgcgaggaggaggaggccggcgtgctctggtga

SEQ ID NO: 9087 - RNA, 9876 nt, synthetic construct
  misc_feature 1..9876: note = derived and/or modified CDS sequence (opt1) from DENV-2__KM279558__SS-prME
  source 1..9876: mol_type = other RNA
accgcgggcatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaagatcacgccccagagctccatcaccgaggccgagctgaccggctacgggaccgtcacgatggagtgcagcccgcgcaccggcctcgacttcaacgagatggtgctgctgcagatggagaacaaggcctggctcgtgcaccggcagtggttcctggacctgcccctcccctggctgcccggcgcggacacccaggggtccaactggatccagaaggagaccctggtcacgttcaagaacccgcacgccaagaagcaggacgtggtcgtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctcggccgcctgatcacggtgaaccccatcgtgaccgagaaggactccccggtcaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtgttcacctccatcggcaaggcgctccaccaggtcttcggggccatctacggcgccgccttcagcggcgtgtcctggaccatgaagatcctgatcggggtggtcatcacctggatcggcatgaacagccgctccacgagcctgtccgtgagcctggtgctcgtcggggtggtgaccctgtacctgggcgtcatggtgcaggcggactccgggtgcgtggtcagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtgacccgcctggagaacctcatgtggaagcagatcacccccgagctgaaccacatcctgaccgagaacgaggtcaagctcacgatcatgaccggggacatcaagggcatcatgcaggccgggaagcggtccctgcgcccccagccgaccgagctgaagtacagctggaaggcgtggggcaaggccaagatgctctccaccgagctgcacaaccacacgttcctgatcgacggccccgagaccgccgagtgccccaacaccaaccgggcctggaacagcctcgaggtggaggactacgggttcggcgtgttcaccacgaacatctggctgaagctgaaggagcgccaggacgtcttctgcgactccaagctcatgagcgccgcgatcaaggacaaccgggccgtgcacgccgacatggggtactggatcgagtccgccctgaacgacacctggaagatcgagaaggccagcttcatcgaggtgaagtcctgccactggcccaagagccacaccctgtggtccaacggcgtcctcgagagcgagatgatcatccccaagaacttcgcgggccccgtgtcccagcacaactaccgccccgggtaccacacccagaccgccggcccgtggcacctggggcggctggagatggacttcgacttctgcgagggcacgaccgtggtcgtgaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtgaacagcctcgtcacggccggccacgggcagatcgacaacttctccctgggcgtgctgggcatggccctcttcctggaggagatgctgcgcacccgggtggggaccaagcacgccatcctcctggtcgccgtgagcttcgtgaccctgatcacgggcaacatgtccttccgcgacctcgggcgcgtcatggtgatggtgggcgccaccatgaccgacgacatcgggatgggcgtcacctacctggccctgctcgcggccttcaaggtgcggcccacgttcgccgccggcctgctgctccgcaagctgaccagcaaggagctgatgatgaccaccatcgggatcgtgctcctgtcccagagcacgatccccgagtccatcctggagctcaccgacgccctggcgctgggcatgatggtcctcaagatcgtgcggaacatggagaagtaccagctggccgtcaccatcatggccatcagctgcgtgcccaacgccgtgatcctgcagaacgcctggaaggtctcctgcaccacgctcgcggtggtgagcgtctccccgctgctgctcaccagctcccagcagaaggccgactggatccccctggccctgaccatcaaggggctcaaccccaccgccatcttcctgacgaccctgagccgcacctccaagaagcggagctggcccctcaacgaggcgatcatggccgtgggcatggtgtccatcctggccagcagcctgctcaagaacgacatcccgatgaccggccccctggtcgccgggggcctgctcacggtgtgctacgtgctgaccgggcgctccgccgacctggagctcgagcgggcggccgacgtccgctgggaggagcaggccgagatcagcggctccagccccatcctgtccatcaccatcagcgaggacgggtccatgagcatcaagaacgaggaggaggagcagaccctgacgatcctcatccggaccggcctgctggtgatctccggcctcttccccgtgagcatcccgatcaccgccgccgcgtggtacctgtgggaggtcaagaagcagcgcgccggggtgctgtgggacgtgcccagcccgccgcccgtcggcaaggccgagctcgaggacggggcctaccggatcaagcagaagggcatcctggggtacagccagatcggcgccggcgtgtacaaggaggggaccttccacaccatgtggcacgtgacgcgcggcgcggtcctgatgcacaaggggaagcggatcgagccctcctgggccgacgtgaagaaggacctcatcagctacggcgggggctggaagctggagggcgagtggaaggagggggaggaggtgcaggtcctggccctcgagcccggcaagaacccgcgcgccgtgcagaccaagcccgggctgttcaagaccaacaccggcacgatcggggccgtgtccctggacttcagccccggcacctccggcagccccatcgtcgacaagaaggggaaggtggtgggcctctacgggaacggcgtcgtgacccggtccggcacctacgtgagcgcgatcgcccagacggagaagtccatcgaggacaacccggagatcgaggacgacatcttccgcaagaagcggctgaccatcatggacctgcaccccggggccggcaagaccaagcgctacctgcccgccatcgtccgggaggcgatcaagcgcgggctccggaccctgatcctggcccccacgcgcgtggtggccgccgagatggaggaggccctccgcggcctgccgatccggtaccagacccccgcgatccgcgccgagcacaccgggcgggagatcgtcgacctgatgtgccacgccaccttcacgatgcgcctcctgagccccatccgggtgcccaactacaacctgatcatcatggacgaggcccacttcaccgacccggccagcatcgcggcccgcggctacatctccacccgggtggagatgggcgaggccgccgggatcttcatgaccgccacgccgcccggcagccgcgaccccttcccgcagtccaacgcgcccatcatggacgaggagcgggagatccccgagcgcagctggaactccgggcacgagtgggtcaccgacttcaagggcaagaccgtgtggttcgtgcccagcatcaaggccgggaacgacatcgccgcctgcctccggaagaacggcaagaaggtcatccagctgtcccgcaagaccttcgacagcgagtacatcaagacgcggaccaacgactgggacttcgtggtgaccaccgacatctccgagatgggcgcgaacttcaaggccgagcgcgtcatcgacccgcggcgctgcatgaagcccgtgatcctgacggacggggaggagcgggtgatcctcgccggccccatgcccgtcacccacagctccgccgcccagcgccgggggcgcgtgggccgcaacccgaagaacgagaacgaccagtacatctacatgggggagcccctggagaacgacgaggactgcgcgcactggaaggaggccaagatgctgctcgacaacatcaacacccccgagggcatcatccccagcatgttcgagccggagcgggagaaggtggacgccatcgacggcgagtaccgcctgcgcggggaggcccgcaagaccttcgtcgacctgatgcggcgcggcgacctccccgtgtggctggcctaccgggtcgcggccgaggggatcaactacgccgaccgccggtggtgcttcgacggcgtgaagaacaaccagatcctggaggagaacgtggaggtcgagatctggacgaaggagggggagcgcaagaagctcaagccccggtggctggacgcccgcatctactccgacccgctggccctcaaggagttcaaggagttcgcggccggccggaagtccctgaccctgaacctcatcaccgagatgggccgcctgcccaccttcatgacgcagaaggccaagaacgccctggacaacctcgcggtgctgcacaccgccgaggccgggggccgggcctacaaccacgccctgtccgagctccccgagaccctggagaccctgctcctgctgacgctcctggcgaccgtgaccgggggcatcttcctgttcctcatgagcggcaaggggatcggcaagatgaccctggggatgtgctgcatcatcaccgcctccatcctgctctggtacgcccagatccagccccactggatcgccgccagcatcatcctggagttcttcctgatcgtcctcctgatcccggagcccgagaagcagcgcacgccccaggacaaccagctgacctacgtggtgatcgcgatcctcaccgtcgtggccgccaccatggccaacgagatgggcttcctggagaagacgaagaaggacttcgggctgggcagcatcaccacccagcagcccgagtccaacatcctcgacatcgacctgcggccggccagcgcgtggaccctgtacgccgtggccacgaccttcatcacccccatgctccgccactccatcgagaacagctccgtcaacgtgagcctgaccgccatcgccaaccaggcgacggtgctgatgggcctcgggaagggctggcccctgtccaagatggacatcggggtccccctgctcgccatcggctgctacagccaggtgaacccgatcaccctgaccgccgccctgctcctgctggtggcgcactacgccatcatcgggcccggcctccaggccaaggccacccgggaggcccagaagcgcgcggccgccggcatcatgaagaaccccacggtcgacgggatgaccgtgatcgacctggaccccatcccgtacgaccccaagttcgagaagcagctgggccaggtgatgctcctggtcctgtgcgtgacccaggtgctcatgatgcggaccacgtgggccctgtgcgaggccctgaccctcgcgaccgggcccatctccaccctgtgggagggcaaccccgggcgcttctggaacacgaccatcgccgtcagcatggccaacatcttccgcggctcctacctggccggcgccgggctcctgttcagcatcatgaagaacaccgcgaacacccggcgcggcacggggaacaccggcgagaccctgggcgagaagtggaagaaccggctcaacgccctggggaagtccgagttccagatctacaagaagtccggcatccaggaggtggaccgcaccctggccaaggaggggatcaagcggggcgagacggaccaccacgccgtgtcccgcgggagcgcgaagctccggtggttcgtcgagcgcaacctggtgaccccggagggcaaggtggtcgacctgggctgcgggcggggcgggtggtcctactactgcggcgggctcaagaacgtgaaggaggtgaagggcctgaccaagggcgggcccggccacgaggagcccatccccatgagcacctacgggtggaacctggtccgcctccagtccggcgtggacgtgttcttcacgccgcccgagaagtgcgacaccctgctgtgcgacatcggggagagcagccccaaccccaccgtcgaggccggccggaccctccgcgtgctgaacctggtggagaactggctcaacaacaacacccagttctgcatcaaggtcctgaacccgtacatgccctccgtgatcgagaagatggaggccctgcagcggaagtacggcggggccctggtgcgcaaccccctcagccggaactccacgcacgagatgtactgggtcagcaacgcctccggcaacatcgtgagctccgtgaacatgatcagccgcatgctgatcaaccggttcaccatgcgccacaagaaggcgacctacgagccggacgtcgacctggggtccggcacccggaacatcgggatcgagagcgagacgcccaacctcgacatcatcggcaagcgcatcgagaagatcaagcaggagcacgagacctcctggcactacgaccaggaccacccctacaagacctgggcctaccacggcagctacgagaccaagcagacggggtccgccagctccatggtgaacggcgtggtccgcctgctgaccaagccctgggacgtgatcccgatggtgacccagatggccatgaccgacacgacccccttcgggcagcagcgggtcttcaaggagaaggtggacacccgcacccaggagcccaaggagggcacgaagaagctcatgaagatcaccgccgagtggctgtggaaggagctgggcaagaagaagacgccccggatgtgcacccgcgaggagttcacgcggaaggtccgcagcaacgcggccctcggggccatcttcaccgacgagaacaagtggaagtccgcccgggaggccgtggaggacagcggcttctgggagctggtggacaaggagcgcaacctgcacctcgaggggaagtgcgagacctgcgtctacaacatgatgggcaagcgggagaagaagctgggggagttcggcaaggcgaagggctcccgcgccatctggtacatgtggctgggggcccggttcctcgagttcgaggccctgggcttcctgaacgaggaccactggttcagccgcgagaacagcctctccggggtggagggcgaggggctgcacaagctgggctacatcctccgggacgtgagcaagaaggagggcggggcgatgtacgccgacgacaccgccggctgggacacgcgcatcaccctggaggacctgaagaacgaggagatggtcaccaaccacatggagggggagcacaagaagctcgccgaggccatcttcaagctgacctaccagaacaaggtggtgcgggtccagcgcccgacgccccggggcaccgtgatggacatcatctcccgccgggaccagcgcgggagcggccaggtggtcacctacggcctgaacaccttcacgaacatggaggcgcagctcatccggcagatggagggggagggcgtgttcaagtccatccagcagctgaccgtgaaggaggagatcgccgtcaagaactggctgatccgcgtggggcgcgagcggctcagccgcatggccatctccggcgacgactgcgtggtcaagcccctggacgaccggttcgccagcgccctgaccgcgctcaacgacatgggcaaggtgcgcaaggacatccagcagtgggagccctcccgggggtggaacgactggacccaggtgccgttctgcagccaccacttccacgagctgatcatgaaggacggccgcgtcctggtggtgccctgccggaaccaggacgagctcatcgggcgcgcccggatctcccagggcgccgggtggagcctgcgcgagacggcctgcctgggcaagtcctacgcccagatgtggagcctcatgtacttccaccggcgcgacctgcggctggcggccaacgccatctgctccgccgtccccagccactggatccccacctcccgcaccacctggagcatccacgccacccacgagtggatgacgaccgaggacatgctcaccgtgtggaaccgggtgtggatccaggagaacccgtggatggaggacaagacccccgtcgagagctgggaggagatcccctacctgggcaagcgcgaggaccagtggtgcgggtccctgatcggcctcacgagccgggcgacctgggccaagaacatccagaccgccatcaaccaggtgcgctccctgatcgggaacgaggagtacaccgactacatgcccagcatgaagcggttccgccgcgaggaggaggaggccggcgtgctgtggtga

SEQ ID NO: 9088 - RNA, 9876 nt, synthetic construct
  misc_feature 1..9876: note = derived and/or modified CDS sequence (opt1) from DENV-2__KM279564__SS-prME
  source 1..9876: mol_type = other RNA
accgcgggcatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaagatcacgccccagagctccatcaccgaggccgagctgaccggctacgggaccgtcacgatggagtgcagcccgcgcaccggcctcgacttcaacgagatggtgctgctgcagatggagaacaaggcctggctcgtgcaccggcagtggttcctggacctgcccctcccctggctgcccggcgcggacacccaggggtccaactggatccagaaggagaccctggtcacgttcaagaacccgcacgccaagaagcaggacgtggtcgtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctcggccgcctgatcacggtgaaccccatcgtgaccgagaaggactccccggtcaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtgttcacctccatcggcaaggcgctccaccaggtcttcggggccatctacggcgccgccttcagcggcgtgtcctggaccatgaagatcctgatcggggtggtcatcacctggatcggcatgaacagccgctccacgagcctgtccgtgagcctggtgctcgtcggggtggtgaccctgtacctgggcgtcatggtgcaggcggactccgggtgcgtggtcagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtgacccgcctggagaacctcatgtggaagcagatcacccccgagctgaaccacatcctgaccgagaacgaggtcaagctcacgatcatgaccggggacatcaagggcatcatgcaggccgggaagcggtccctgcgcccccagccgaccgagctgaagtacagctggaaggcgtggggcaaggccaagatgctctccaccgagctgcacaaccacacgttcctgatcgacggccccgagaccgccgagtgccccaacaccaaccgggcctggaacagcctcgaggtggaggactacgggttcggcgtgttcaccacgaacatctggctgaagctgaaggagcgccaggacgtcttctgcgactccaagctcatgagcgccgcgatcaaggacaaccgggccgtgcacgccgacatggggtactggatcgagtccgccctgaacgacacctggaagatcgagaaggccagcttcatcgaggtgaagtcctgccactggcccaagagccacaccctgtggtccaacggcgtcctcgagagcgagatgatcatccccaagaacttcgcgggccccgtgtcccagcacaactaccgccccgggtaccacacccagaccgccggcccgtggcacctggggcggctggagatggacttcgacttctgcgagggcacgaccgtggtcgtgaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtgaacagcctcgtcacggccggccacgggcagatcgacaacttctccctgggcgtgctgggcatggccctcttcctggaggagatgctgcgcacccgggtggggaccaagcacgccatcctcctggtcgccgtgagcttcgtgaccctgatcacgggcaacatgtccttccgcgacctcgggcgcgtcatggtgatggtgggcgccaccatgaccgacgacatcgggatgggcgtcacctacctggccctgctcgcggccttcaaggtgcggcccacgttcgccgccggcctgctgctccgcaagctgaccagcaaggagctgatgatgaccaccatcgggatcgtgctcctgtcccagagcacgatccccgagtccatcctggagctcaccgacgccctggcgctgggcatgatggtcctcaagatcgtgcggaacatggagaagtaccagctggccgtcaccatcatggccatcagctgcgtgcccaacgccgtgatcctgcagaacgcctggaaggtctcctgcaccacgctcgcggtggtgagcgtctccccgctgctgctcaccagctcccagcagaaggccgactggatccccctggccctgaccatcaaggggctcaaccccaccgccatcttcctgacgaccctgagccgcacctccaagaagcggagctggcccctcaacgaggcgatcatggccgtgggcatggtgtccatcctggccagcagcctgctcaagaacgacatcccgatgaccggccccctggtcgccgggggcctgctcacggtgtgctacgtgctgaccgggcgctccgccgacctggagctcgagcgggcggccgacgtccgctgggaggagcaggccgagatcagcggctccagccccatcctgtccatcaccatcagcgaggacgggtccatgagcatcaagaacgaggaggaggagcagaccctgacgatcctcatccggaccggcctgctggtgatctccggcctcttccccgtgagcatcccgatcaccgccgccgcgtggtacctgtgggaggtcaagaagcagcgcgccggggtgctgtgggacgtgcccagcccgccgcccgtcggcaaggccgagctcgaggacggggcctaccggatcaagcagaagggcatcctggggtacagccagatcggcgccggcgtgtacaaggaggggaccttccacaccatgtggcacgtgacgcgcggcgcggtcctgatgcacaaggggaagcggatcgagccctcctgggccgacgtgaagaaggacctcatcagctacggcgggggctggaagctggagggcgagtggaaggagggggaggaggtgcaggtcctggccctcgagcccggcaagaacccgcgcgccgtgcagaccaagcccgggctgttcaagaccaacaccggcacgatcggggccgtgtccctggacttcagccccggcacctccggcagccccatcgtcgacaagaaggggaaggtggtgggcctctacgggaacggcgtcgtgacccggtccggcacctacgtgagcgcgatcgcccagacggagaagtccatcgaggacaacccggagatcgaggacgacatcttccgcaagaagcggctgaccatcatggacctgcaccccggggccggcaagaccaagcgctacctgcccgccatcgtccgggaggcgatcaagcgcgggctccggaccctgatcctggcccccacgcgcgtggtggccgccgagatggaggaggccctccgcggcctgccgatccggtaccagacccccgcgatccgcgccgagcacaccgggcgggagatcgtcgacctgatgtgccacgccaccttcacgatgcgcctcctgagccccatccgggtgcccaactacaacctgatcatcatggacgaggcccacttcaccgacccggccagcatcgcggcccgcggctacatctccacccgggtggagatgggcgaggccgccgggatcttcatgaccgccacgccgcccggcagccgcgaccccttcccgcagtccaacgcgcccatcatggacgaggagcgggagatccccgagcgcagctggaactccgggcacgagtgggtcaccgacttcaagggcaagaccgtgtggttcgtgcccagcatcaaggccgggaacgacatcgccgcctgcctccggaagaacggcaagaaggtcatccagctgtcccgcaagaccttcgacagcgagtacatcaagacgcggaccaacgactgggacttcgtggtgaccaccgacatctccgagatgggcgcgaacttcaaggccgagcgcgtcatcgacccgcggcgctgcatgaagcccgtgatcctgacggacggggaggagcgggtgatcctcgccggccccatgcccgtcacccacagctccgccgcccagcgccgggggcgcgtgggccgcaacccgaagaacgagaacgaccagtacatctacatgggggagcccctggagaacgacgaggactgcgcgcactggaaggaggccaagatgctgctcgacaacatcaacacccccgagggcatcatccccagcatgttcgagccggagcgggagaaggtggacgccatcgacggcgagtaccgcctgcgcggggaggcccgcaagaccttcgtcgacctgatgcggcgcggcgacctccccgtgtggctggcctaccgggtcgcggccgaggggatcaactacgccgaccgccggtggtgcttcgacggcgtgaagaacaaccagatcctggaggagaacgtggaggtcgagatctggacgaaggagggggagcgcaagaagctcaagccccggtggctggacgcccgcatctactccgacccgctggccctcaaggagttcaaggagttcgcggccggccggaagtccctgaccctgaacctcatcaccgagatgggccgcctgcccaccttcatgacgcagaaggccaagaacgccctggacaacctcgcggtgctgcacaccgccgaggccgggggccgggcctacaaccacgccctgtccgagctccccgagaccctggagaccctgctcctgctgacgctcctggcgaccgtgaccgggggcatcttcctgttcctcatgagcggcaaggggatcggcaagatgaccctggggatgtgctgcatcatcaccgcctccatcctgctctggtacgcccagatccagccccactggatcgccgccagcatcatcctggagttcttcctgatcgtcctcctgatcccggagcccgagaagcagcgcacgccccaggacaaccagctgacctacgtggtgatcgcgatcctcaccgtcgtggccgccaccatggccaacgagatgggcttcctggagaagacgaagaaggacttcgggctgggcagcatcaccacccagcagcccgagtccaacatcctcgacatcgacctgcggccggccagcgcgtggaccctgtacgccgtggccacgaccttcatcacccccatgctccgccactccatcgagaacagctccgtcaacgtgagcctgaccgccatcgccaaccaggcgacggtgctgatgggcctcgggaagggctggcccctgtccaagatggacatcggggtccccctgctcgccatcggctgctacagccaggtgaacccgatcaccctgaccgccgccctgctcctgctggtggcgcactacgccatcatcgggcccggcctccaggccaaggccacccgggaggcccagaagcgcgcggccgccggcatcatgaagaaccccacggtcgacgggatgaccgtgatcgacctggaccccatcccgtacgaccccaagttcgagaagcagctgggccaggtgatgctcctggtcctgtgcgtgacccaggtgctcatgatgcggaccacgtgggccctgtgcgaggccctgaccctcgcgaccgggcccatctccaccctgtgggagggcaaccccgggcgcttctggaacacgaccatcgccgtcagcatggccaacatcttccgcggctcctacctggccggcgccgggctcctgttcagcatcatgaagaacaccgcgaacacccggcgcggcacggggaacaccggcgagaccctgggcgagaagtggaagaaccggctcaacgccctggggaagtccgagttccagatctacaagaagtccggcatccaggaggtggaccgcaccctggccaaggaggggatcaagcggggcgagacggaccaccacgccgtgtcccgcgggagcgcgaagctccggtggttcgtcgagcgcaacctggtgaccccggagggcaaggtggtcgacctgggctgcgggcggggcgggtggtcctactactgcggcgggctcaagaacgtgaaggaggtgaagggcctgaccaagggcgggcccggccacgaggagcccatccccatgagcacctacgggtggaacctggtccgcctccagtccggcgtggacgtgttcttcacgccgcccgagaagtgcgacaccctgctgtgcgacatcggggagagcagccccaaccccaccgtcgaggccggccggaccctccgcgtgctgaacctggtggagaactggctcaacaacaacacccagttctgcatcaaggtcctgaacccgtacatgccctccgtgatcgagaagatggaggccctgcagcggaagtacggcggggccctggtgcgcaaccccctcagccggaactccacgcacgagatgtactgggtcagcaacgcctccggcaacatcgtgagctccgtgaacatgatcagccgcatgctgatcaaccggttcaccatgcgccacaagaaggcgacctacgagccggacgtcgacctggggtccggcacccggaacatcgggatcgagagcgagacgcccaacctcgacatcatcggcaagcgcatcgagaagatcaagcaggagcacgagacctcctggcactacgaccaggaccacccctacaagacctgggcctaccacggcagctacgagaccaagcagacggggtccgccagctccatggtgaacggcgtggtccgcctgctgaccaagccctgggacgtgatcccgatggtgacccagatggccatgaccgacacgacccccttcgggcagcagcgggtcttcaaggagaaggtggacacccgcacccaggagcccaaggagggcacgaagaagctcatgaagatcaccgccgagtggctgtggaaggagctgggcaagaagaagacgccccggatgtgcacccgcgaggagttcacgcggaaggtccgcagcaacgcggccctcggggccatcttcaccgacgagaacaagtggaagtccgcccgggaggccgtggaggacagcggcttctgggagctggtggacaaggagcgcaacctgcacctcgaggggaagtgcgagacctgcgtctacaacatgatgggcaagcgggagaagaagctgggggagttcggcaaggcgaagggctcccgcgccatctggtacatgtggctgggggcccggttcctcgagttcgaggccctgggcttcctgaacgaggaccactggttcagccgcgagaacagcctctccggggtggagggcgaggggctgcacaagctgggctacatcctccgggacgtgagcaagaaggagggcggggcgatgtacgccgacgacaccgccggctgggacacgcgcatcaccctggaggacctgaagaacgaggagatggtcaccaaccacatggagggggagcacaagaagctcgccgaggccatcttcaagctgacctaccagaacaaggtggtgcgggtccagcgcccgacgccccggggcaccgtgatggacatcatctcccgccgggaccagcgcgggagcggccaggtggtcacctacggcctgaacaccttcacgaacatggaggcgcagctcatccggcagatggagggggagggcgtgttcaagtccatccagcagctgaccgtgaaggaggagatcgccgtcaagaactggctgatccgcgtggggcgcgagcggctcagccgcatggccatctccggcgacgactgcgtggtcaagcccctggacgaccggttcgccagcgccctgaccgcgctcaacgacatgggcaaggtgcgcaaggacatccagcagtgggagccctcccgggggtggaacgactggacccaggtgccgttctgcagccaccacttccacgagctgatcatgaaggacggccgcgtcctggtggtgccctgccggaaccaggacgagctcatcgggcgcgcccggatctcccagggcgccgggtggagcctgcgcgagacggcctgcctgggcaagtcctacgcccagatgtggagcctcatgtacttccaccggcgcgacctgcggctggcggccaacgccatctgctccgccgtccccagccactggatccccacctcccgcaccacctggagcatccacgccacccacgagtggatgacgaccgaggacatgctcaccgtgtggaaccgggtgtggatccaggagaacccgtggatggaggacaagacccccgtcgagagctgggaggagatcccctacctgggcaagcgcgaggaccagtggtgcgggtccctgatcggcctcacgagccgggcgacctgggccaagaacatccagaccgccatcaaccaggtgcgctccctgatcgggaacgaggagtacaccgactacatgcccagcatgaagcggttccgcatcgaggaggaggaggccggcgtgctgtggtga

SEQ ID NO: 9089 - RNA, 9876 nt, synthetic construct
  misc_feature 1..9876: note = derived and/or modified CDS sequence (opt1) from DENV-2__KM279595__SS-prME
  source 1..9876: mol_type = other RNA
accgcgggcatcatcatcatgatgatccccaccgtgatggccttccacctgaccacccgcaacggggagccccacatgatcgtcagccggcaggagaagggcaagtccctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcaccatcatggcggccatcctggcctacaccatcggcaccacctacttccagcgggtcctgatcttcatcctcctgaccgccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggaccctgcgcccccagccgaccgagctgaagtactcctggaaggcgtggggcaaggccaagatgctcagcacggagctgcacaaccacaccttcctgatcgacggccccgagaccgccgagtgccccaacaccaaccgggcctggaactccctcgaggtggaggactacgggttcggcgtcttcacgaccaacatctggctgaagctgaaggagcgccaggacgtgttctgcgacagcaagctcatgtccgccgcgatcaaggacaaccgggccgtgcacgccgacatggggtactggatcgagagcgccctgaacgacacctggaagatcgagaaggcctccttcatcgaggtcaagagctgccactggccgaagtcccacaccctgtggagcaacggcgtgctcgagtccgagatgatcatccccaagaacttcgcgggccccgtgagccagcacaactaccgccccgggtaccacacccagacggccggcccgtggcacctggggcggctggagatggacttcgacttctgcgagggcaccaccgtcgtggtgaccgaggactgcgggaaccgcggcccctccctccggacgaccaccgccagcggcaagctgatcaccgagtggtgctgccgcagctgcacgctgccgcccctccggtaccgcggggaggacggctgctggtacgggatggagatccggccgctgaaggagaaggaggagaacctggtcaactccctcgtgaccgccggccacgggcagatcgacaacttcagcctgggcgtgctgggcatggccctcttcctggaggagatgctgcgcacccgggtcgggaccaagcacgccatcctcctggtggccgtgtccttcgtcacgctgatcaccggcaacatgagcttccgcgacctcgggcgcgtgatggtgatggtcggcgccaccatgaccgacgacatcgggatgggcgtgacgtacctggccctgctcgcggccttcaaggtgcggcccaccttcgccgccggcctgctgctccgcaagctgacctccaaggagctgatgatgaccacgatcgggatcgtcctcctgagccagtccaccatccccgagagcatcctggagctcaccgacgccctggcgctgggcatgatggtgctcaagatcgtccggaacatggagaagtaccagctggccgtgaccatcatggccatcctgtgcgtgcccaacgccgtcatcctccagaacgcctggaaggtgtcctgcacgaccctggcggtggtcagcgtgtccccgctgctcctgaccagctcccagcagaaggccgactggatccccctggccctcaccatcaaggggctgaaccccacggccatcttcctgaccaccctcagccgcacctccaagaagcggagctggcccctgaacgaggcgatcatggccgtgggcatggtctccatcctggccagctccctcctgaagaacgacatcccgatgacgggccccctggtggccgggggcctcctgaccgtgtgctacgtcctgaccgggcgcagcgccgacctcgagctggagcgggcggccgacgtgcgctgggaggagcaggccgagatcagcggctccagccccatcctgtccatcaccatcagcgaggacgggtccatgagcatcaagaacgaggaggaggagcagacgctcaccatcctgatccggaccggcctgctcgtgatctccggcctgttccccgtcagcatcccgatcaccgccgccgcgtggtacctgtgggaggtgaagaagcagcgcgccggggtgctctgggacgtccccagcccgccgcccgtgggcaaggccgagctggaggacggggcctaccggatcaagcagaagggcatcctggggtacagccagatcggcgccggcgtgtacaaggaggggaccttccacacgatgtggcacgtcacccgcggcgcggtgctcatgcacaaggggaagcggatcgagccctcctgggccgacgtgaagaaggacctgatcagctacggcgggggctggaagctggagggcgagtggaaggagggggaggaggtccaggtgctcgccctggagcccggcaagaacccccgcgccgtgcagaccaagcccgggctgttcaagaccaacacgggcaccatcggggccgtctccctcgacttcagccccggcacctccggcagccccatcgtggacaagaaggggaaggtggtcggcctgtacgggaacggcgtggtgacccggtccggcacgtacgtcagcgcgatcgcccagaccgagaagaacatcgaggacaacccggagatcgaggacgacatcttccgcaagaagcggctgaccatcatggacctgcaccccggggccggcaagaccaagcgctacctccccgccatcgtgcgggaggcgatcaagcgcgggctgcggacgctgatcctcgcccccacccgcgtggtcgccgccgagatggaggaggccctgcgcggcctgccgatccggtaccagacccccgcgatccgcgccgagcacaccgggcgggagatcgtggacctcatgtgccacgccacgttcaccatgcgcctgctgtcccccatccgggtgcccaactacaacctcatcatcatggacgaggcccacttcaccgacccggccagcatcgcggcccgcggctacatcagcacccgggtcgagatgggcgaggccgccgggatcttcatgacggccacgccgcccggctcccgcgaccccttcccgcagagcaacgcgcccatcatggacgaggagaaggagatccccgagcggtcctggaacagcgggcacgagtgggtgaccgacttcaagggcaagaccgtgtggttcgtcccctccatcaaggccgggaacgacatcgccgcctgcctgcgcaagaacggcaagaaggtgatccagctgagccggaagacgttcgactccgagtacatcaagacccgcaccaacgactgggacttcgtggtcaccacggacatcagcgagatgggcgcgaacttcaaggccgagcgggtgatcgacccgcgccggtgcatgaagcccgtgatcctcaccgacggggaggagcgcgtcatcctggccggccccatgcccgtgacccactccagcgccgcccagcggcgcgggcgggtgggccgcaacccgaagaacgagaacgaccagtacatctacatgggggagcccctggagaacgacgaggactgcgcgcactggaaggaggccaagatgctcctggacaacatcaacacccccgagggcatcatcccctccatgttcgagccggagcgcgagaaggtcgacgccatcgacggcgagtaccggctgcgcggggaggcccggaagacgttcgtggacctcatgcgccggggcgacctgcccgtctggctggcctaccgcgtggcggccgaggggatcaactacgccgaccggcgctggtgcttcgacggcgtgaagaacaaccagatcctcgaggagaacgtcgaggtggagatctggaccaaggagggggagcggaagaagctgaagccccgctggctggacgcccggatctacagcgacccgctcgccctgaaggagttcaaggagttcgcggccggccgcaagtccctgaccctcaacctgatcaccgagatgggccggctgcccacgttcatgacccagaaggccaagaacgccctcgacaacctggcggtgctgcacaccgccgaggccgggggccgcgcctacaaccacgccctcagcgagctgcccgagaccctggagacgctcctgctgctcaccctgctggcgaccgtcaccgggggcatcttcctcttcctgatgtccggcaaggggatcggcaagatgaccctggggatgtgctgcatcatcacggccagcatcctcctgtggtacgcccagatccagccccactggatcgccgcctccatcatcctggagttcttcctcatcgtgctgctgatcccggagcccgagaagcagcggacgccccaggacaaccagctcacctacgtggtcatcgcgatcctgaccgtggtggccgccacgatggccaacgagatgggcttcctggagaagaccaagaaggacttcgggctcggcagcatcaccacccagcagcccgagtccaacatcctggacatcgacctgcgcccggccagcgcgtggacgctctacgccgtcgccaccaccttcatcacccccatgctgcggcacagcatcgagaactccagcgtgaacgtgtccctgacggccatcgccaaccaggcgaccgtcctcatgggcctggggaagggctggcccctgagcaagatggacatcggggtgcccctcctggccatcggctgctactcccaggtgaacccgatcaccctgaccgccgccctcctgctgctcgtcgcgcactacgccatcatcgggcccggcctgcaggccaaggccacgcgcgaggcccagaagcgggcggccgccggcatcatgaagaaccccaccgtggacgggatgaccgtgatcgacctggaccccatcccgtacgaccccaagttcgagaagcagctcggccaggtcatgctgctggtgctctgcgtgacccaggtcctgatgatgcgcacgacctgggccctgtgcgaggccctcaccctggcgaccgggcccatcagcacgctgtgggagggcaaccccgggcggttctggaacaccaccatcgccgtgtccatggccaacatcttccgcggcagctacctcgccggcgccgggctgctgttctccatcatgaagaacaccgcgaacacgcgccggggcaccgggaacaccggcgagaccctcggcgagaagtggaagaaccgcctgaacgccctgggcaagagcgagttccagatctacaagaagtccgggatccaggaggtggaccggacgctcgccaaggaggggatcaagcgcggcgagaccgaccaccacgccgtcagccgggggtccgcgaagctgcgctggttcgtggagcggaacctggtgaccccggagggcaaggtcgtggacctcggctgcgggcgcggcgggtggagctactactgcggcgggctgaagaacgtgaaggaggtcaagggcctgaccaagggcgggcccggccacgaggagcccatccccatgtccacgtacgggtggaacctcgtgcggctgcagagcggcgtggacgtcttcttcaccccgcccgagaagtgcgacaccctgctctgcgacatcggggagtccagccccaaccccaccgtggaggccggccgcaccctgcgggtgctgaacctcgtcgagaactggctgaacaacaacacgcagttctgcatcaaggtgctgaacccgtacatgccctccgtgatcgagaagatggaggccctgcagcgcaagtacggcggggccctcgtccggaaccccctgagccgcaacagcacccacgagatgtactgggtgtccaacgccagcggcaacatcgtgtccagcgtcaacatgatctcccggatgctgatcaaccgcttcaccatgcggcacaagaaggcgacctacgagccggacgtggacctcgggagcggcacgcgcaacatcgggatcgagtccgagacccccaacctggacatcatcggcaagcggatcgagaagatcaagcaggagcacgagaccagctggcactacgaccaggaccacccctacaagacctgggcctaccacggctcctacgagacgaagcagaccgggagcgcctccagcatggtgaacggcgtcgtgcgcctgctcaccaagccctgggacgtgatcccgatggtcacccagatggccatgacggacaccacccccttcgggcagcagcgcgtgttcaaggagaaggtcgacacccggacgcaggagcccaaggagggcaccaagaagctgatgaagatcaccgccgagtggctgtggaaggagctcggcaagaagaagacgccccgcatgtgcacgcgggaggagttcacccgcaaggtgcggtccaacgcggccctgggggccatcttcaccgacgagaacaagtggaagtccgcccgcgaggccgtggaggactccggcttctgggagctggtcgacaaggagcggaacctccacctggaggggaagtgcgagacctgcgtgtacaacatgatgggcaagcgcgagaagaagctgggggagttcggcaaggcgaagggcagccgggccatctggtacatgtggctcggggcccgcttcctggagttcgaggccctgggcttcctcaacgaggaccactggttctcccgggagaacagcctgtccggggtggagggcgaggggctgcacaagctcggctacatcctgcgcgacgtcagcaagaaggagggcggggcgatgtacgccgacgacacggccggctgggacacccggatcaccctggaggacctcaagaacgaggagatggtgaccaaccacatggagggggagcacaagaagctggccgaggccatcttcaagctgacgtaccagaacaaggtggtccgcgtgcagcggccgacgccccgcggcaccgtgatggacatcatcagccggcgcgaccagcgggggtccggccaggtcgtgacctacggcctcaacaccttcaccaacatggaggcgcagctgatccgccagatggagggggagggcgtgttcaagagcatccagcagctgaccgtcaaggaggagatcgccgtgaaggactggctcatccgggtggggcgcgagcgcctgtcccggatggccatcagcggcgacgactgcgtcgtgaagcccctggacgaccgcttcgcctccgccctcaccgcgctgaacgacatgggcaaggtgcggaaggacatccagcagtgggagcccagccgcgggtggaacgactggacgcaggtcccgttctgctcccaccacttccacgagctgatcatgaaggacggccgggtgctcgtggtcccctgccgcaaccaggacgagctgatcgggcgggcccgcatcagccagggcgccgggtggtccctgcgggagaccgcctgcctcggcaagagctacgcccagatgtggtccctgatgtacttccaccgccgggacctgcgcctcgcggccaacgccatctgcagcgccgtgccctcccactggatccccaccagccggaccacctggtccatccacgccacgcacgagtggatgaccaccgaggacatgctgaccgtgtggaaccgcgtctggatccaggagaacccgtggatggaggacaagacgcccgtggagagctgggaggagatcccctacctgggcaagcgggaggaccagtggtgcgggtccctcatcggcctgaccagccgcgcgacctgggccaagaacatccagaccgccatcaaccaggtgcggagcctgatcgggaacgaggagtacacggactacatgccctccatgaagcgcttccggcgcgaggaggaggaggccggcgtcctctggtga

SEQ ID NO: 9090 - RNA, 9876 nt, synthetic construct
  misc_feature 1..9876: note = derived and/or modified CDS sequence (opt1) from DENV-2__KM279566__SS-prME
  source 1..9876: mol_type = other RNA
accgcgggcatcatcatcatgatgatccccaccgtgatggccttccacctgaccacccgcaacggggagccccacatgatcgtctcccggcaggagaagggcaagtccctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcaccatcatggcggccatcctggcctacaccatcggcaccacctacttccagcgggtcctgatcttcatcctcctgaccgccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggaccctgcgcccccagccgaccgagctgaagtactcctggaaggcgtggggcaaggccaagatgctcagcacggagctgcacaaccacaccttcctgatcgacggccccgagaccgccgagtgccccaacaccaaccgggcctggaactccctcgaggtggaggactacgggttcggcgtcttcacgaccaacatctggctgaagctgaaggagcgccaggacgtgttctgcgacagcaagctcatgtccgccgcgatcaaggacaaccgggccgtgcacgccgacatggggtactggatcgagagcgccctgaacgacacctggaagatcgagaaggcctccttcatcgaggtcaagagctgccactggccgaagtcccacaccctgtggagcaacggcgtgctcgagtccgagatgatcatccccaagaacttcgcgggccccgtgagccagcacaactaccgccccgggtaccacacccagacggccggcccgtggcacctggggcggctggagatggacttcgacttctgcgagggcaccaccgtcgtggtgaccgaggactgcgggaaccgcggcccctccctccggacgaccaccgccagcggcaagctgatcaccgagtggtgctgccgcagctgcacgctgccgcccctccggtaccgcggggaggacggctgctggtacgggatggagatccggccgctgaaggagaaggaggagaacctggtcaactccctcgtgaccgccggccacgggcagatcgacaacttcagcctgggcgtgctgggcatggccctcttcctggaggagatgctgcgcacccgggtcgggaccaagcacgccatcctcctggtggccgtgtccttcgtcacgctgatcaccggcaacatgagcttccgcgacctcgggcgcgtgatggtgatggtcggcgccaccatgaccgacgacatcgggatgggcgtgacgtacctggccctgctcgcggccttcaaggtgcggcccaccttcgccgccggcctgctgctccgcaagctgacctccaaggagctgatgatgaccacgatcgggatcgtcctcctgagccagtccaccatccccgagagcatcctggagctcaccgacgccctggcgctgggcatgatggtgctcaagatcgtccggaacatggagaagtaccagctggccgtgaccatcatggccatcctgtgcgtgcccaacgccgtcatcctccagaacgcctggaaggtgtcctgcacgaccctggcggtggtcagcgtgtccccgctgctcctgaccagctcccagcagaaggccgactggatccccctggccctcaccatcaaggggctgaaccccacggccatcttcctgaccaccctcagccgcacctccaagaagcggagctggcccctgaacgaggcgatcatggccgtgggcatggtctccatcctggccagctccctcctgaagaacgacatcccgatgacgggccccctggtggccgggggcctcctgaccgtgtgctacgtcctgaccgggcgcagcgccgacctcgagctggagcgggcggccgacgtgcgctgggaggagcaggccgagatcagcggctccagccccatcctgtccatcaccatcagcgaggacgggtccatgagcatcaagaacgaggaggaggagcagacgctcaccatcctgatccggaccggcctgctcgtgatctccggcctgttccccgtcagcatcccgatcaccgccgccgcgtggtacctgtgggaggtgaagaagcagcgcgccggggtgctctgggacgtccccagcccgccgcccgtgggcaaggccgagctggaggacggggcctaccggatcaagcagaagggcatcctggggtacagccagatcggcgccggcgtgtacaaggaggggaccttccacacgatgtggcacgtcacccgcggcgcggtgctcatgcacaaggggaagcggatcgagccctcctgggccgacgtgaagaaggacctgatcagctacggcgggggctggaagctggagggcgagtggaaggagggggaggaggtccaggtgctcgccctggagcccggcaagaacccccgcgccgtgcagaccaagcccgggctgttcaagaccaacacgggcaccatcggggccgtctccctcgacttcagccccggcacctccggcagccccatcgtggacaagaaggggaaggtggtcggcctgtacgggaacggcgtggtgacccggtccggcacgtacgtcagcgcgatcgcccagaccgagaagtccatcgaggacaacccggagatcgaggacgacatcttccgcaagaagcggctgaccatcatggacctgcaccccggggccggcaagaccaagcgctacctccccgccatcgtgcgggaggcgatcaagcgcgggctgcggacgctgatcctcgcccccacccgcgtggtcgccgccgagatggaggaggccctgcgcggcctgccgatccggtaccagacccccgcgatccgcgccgagcacaccgggcgggagatcgtggacctcatgtgccacgccacgttcaccatgcgcctgctgagccccatccgggtgcccaactacaacctcatcatcatggacgaggcccacttcaccgacccggccagcatcgcggcccgcggctacatctccacccgggtcgagatgggcgaggccgccgggatcttcatgacggccacgccgcccggcagccgcgaccccttcccgcagtccaacgcgcccatcatggacgaggagaaggagatccccgagcggagctggaactccgggcacgagtgggtgaccgacttcaagggcaagaccgtgtggttcgtccccagcatcaaggccgggaacgacatcgccgcctgcctgcgcaagaacggcaagaaggtgatccagctgtcccggaagacgttcgacagcgagtacatcaagacccgcaccaacgactgggacttcgtggtcaccacggacatctccgagatgggcgcgaacttcaaggccgagcgggtgatcgacccgcgccggtgcatgaagcccgtgatcctcaccgacggggaggagcgcgtcatcctggccggccccatgcccgtgacccacagctccgccgcccagcggcgcgggcgggtgggccgcaacccgaagaacgagaacgaccagtacatctacatgggggagcccctggagaacgacgaggactgcgcgcactggaaggaggccaagatgctcctggacaacatcaacacccccgagggcatcatccccagcatgttcgagccggagcgcgagaaggtcgacgccatcgacggcgagtaccggctgcgcggggaggcccggaagacgttcgtggacctcatgcgccggggcgacctgcccgtctggctggcctaccgcgtggcggccgaggggatcaactacgccgaccggcgctggtgcttcgacggcgtgaagaacaaccagatcctcgaggagaacgtcgaggtggagatctggaccaaggagggggagcggaagaagctgaagccccgctggctggacgcccggatctactccgacccgctcgccctgaaggagttcaaggagttcgcggccggccgcaagagcctgaccctcaacctgatcaccgagatgggccggctgcccacgttcatgacccagaaggccaagaacgccctcgacaacctggcggtgctgcacaccgccgaggccgggggccgcgcctacaaccacgccctctccgagctgcccgagaccctggagacgctcctgctgctcaccctgctggcgaccgtcaccgggggcatcttcctcttcctgatgagcggcaaggggatcggcaagatgaccctggggatgtgctgcatcatcacggcctccatcctcctgtggtacgcccagatccagccccactggatcgccgccagcatcatcctggagttcttcctcatcgtgctgctgatcccggagcccgagaagcagcggacgccccaggacaaccagctcacctacgtggtcatcgcgatcctgaccgtggtggccgccacgatggccaacgagatgggcttcctggagaagaccaagaaggacttcgggctcggctccatcaccacccagcagcccgagagcaacatcctggacatcgacctgcgcccggccagcgcgtggacgctctacgccgtcgccaccaccttcatcacccccatgctgcggcactccatcgagaacagctccgtgaacgtgagcctgacggccatcgccaaccaggcgaccgtcctcatgggcctggggaagggctggcccctgtccaagatggacatcggggtgcccctcctggccatcggctgctacagccaggtgaacccgatcaccctgaccgccgccctcctgctgctcgtcgcgcactacgccatcatcgggcccggcctgcaggccaaggccacgcgcgaggcccagaagcgggcggccgccggcatcatgaagaaccccaccgtggacgggatgaccgtgatcgacctggaccccatcccgtacgaccccaagttcgagaagcagctcggccaggtcatgctgctggtgctctgcgtgacccaggtcctgatgatgcgcacgacctgggccctgtgcgaggccctcaccctggcgaccgggcccatctccacgctgtgggagggcaaccccgggcggttctggaacaccaccatcgccgtgagcatggccaacatcttccgcggctcctacctcgccggcgccgggctgctgttcagcatcatgaagaacaccgcgaacacgcgccggggcaccgggaacaccggcgagaccctcggcgagaagtggaagaaccgcctgaacgccctggggaagtccgagttccagatctacaagaagtccggcatccaggaggtggaccggacgctcgccaaggaggggatcaagcgcggcgagaccgaccaccacgccgtcagccgggggagcgcgaagctgcgctggttcgtggagcggaacctggtgaccccggagggcaaggtcgtggacctcggctgcgggcgcggcgggtggtcctactactgcggcgggctgaagaacgtgaaggaggtcaagggcctgaccaagggcgggcccggccacgaggagcccatccccatgagcacgtacgggtggaacctcgtgcggctgcagtccggcgtggacgtcttcttcaccccgcccgagaagtgcgacaccctgctctgcgacatcggggagagctcccccaaccccaccgtggaggccggccgcaccctgcgggtgctgaacctcgtcgagaactggctgaacaacaacacgcagttctgcatcaaggtgctgaacccgtacatgcccagcgtgatcgagaagatggaggccctgcagcgcaagtacggcggggccctcgtccggaaccccctgagccgcaactccacccacgagatgtactgggtgagcaacgcctccggcaacatcgtgagctccgtcaacatgatcagccggatgctgatcaaccgcttcaccatgcggcacaagaaggcgacctacgagccggacgtggacctcgggtccggcacgcgcaacatcgggatcgagagcgagacccccaacctggacatcatcggcaagcggatcgagaagatcaagcaggagcacgagacctcctggcactacgaccaggaccacccctacaagacctgggcctaccacggcagctacgagacgaagcagaccgggtccgccagctccatggtgaacggcgtcgtgcgcctgctcaccaagccctgggacgtgatcccgatggtcacccagatggccatgacggacaccacccccttcgggcagcagcgcgtgttcaaggagaaggtcgacacccggacgcaggagcccaaggagggcaccaagaagctgatgaagatcaccgccgagtggctgtggaaggagctcggcaagaagaagacgccccgcatgtgcacgcgggaggagttcacccgcaaggtgcggagcaacgcggccctgggggccatcttcaccgacgagaacaagtggaagtccgcccgcgaggccgtggaggacagcggcttctgggagctggtcgacaaggagcggaacctccacctggaggggaagtgcgagacctgcgtgtacaacatgatgggcaagcgcgagaagaagctgggggagttcggcaaggcgaagggctcccgggccatctggtacatgtggctcggggcccgcttcctggagttcgaggccctgggcttcctcaacgaggaccactggttcagccgggagaactccctgagcggggtggagggcgaggggctgcacaagctcggctacatcctgcgcgacgtcagcaagaaggagggcggggcgatgtacgccgacgacacggccggctgggacacccggatcaccctggaggacctcaagaacgaggagatggtgaccaaccacatggagggggagcacaagaagctggccgaggccatcttcaagctgacgtaccagaacaaggtggtccgcgtgcagcggccgacgccccgcggcaccgtgatggacatcatctcccggcgcgaccagcgggggagcggccaggtcgtgacctacggcctcaacaccttcaccaacatggaggcgcagctgatccgccagatggagggggagggcgtgttcaagtccatccagcagctgaccgtcaaggaggagatcgccgtgaagaactggctcatccgggtggggcgcgagcgcctgagccggatggccatctccggcgacgactgcgtcgtgaagcccctggacgaccgcttcgccagcgccctcaccgcgctgaacgacatgggcaaggtgcggaaggacatccagcagtgggagccctcccgcgggtggaacgactggacgcaggtcccgttctgcagccaccacttccacgagctgatcatgaaggacggccgggtgctcgtggtcccctgccgcaaccaggacgagctgatcgggcgggcccgcatctcccagggcgccgggtggagcctgcgggagaccgcctgcctcggcaagtcctacgcccagatgtggagcctgatgtacttccaccgccgggacctgcgcctcgcggccaacgccatctgctccgccgtgcccagccactggatccccacctcccggaccacctggagcatccacgccacgcacgagtggatgaccaccgaggacatgctgaccgtgtggaaccgcgtctggatccaggagaacccgtggatggaggacaagacgcccgtggagtcctgggaggagatcccctacctgggcaagcgggaggaccagtggtgcgggagcctcatcggcctgaccagccgcgcgacctgggccaagaacatccagaccgccatcaaccaggtgcggtccctgatcgggaacgaggagtacacggactacatgcccagcatgaagcgcttccggcgcgaggaggaggaggccggcgtcctctggtga

SEQ ID NO: 9091 - RNA, 9876 nt, synthetic construct
  misc_feature 1..9876: note = derived and/or modified CDS sequence (opt1) from DENV-2__KM279574__SS-prME
  source 1..9876: mol_type = other RNA
accgcgggcatcatcatcatgatgatccccaccgtgatggccttccacctgaccacccgcaacggggagccccacatgatcgtcagccggcaggagaagggcaagtccctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcaccatcatggcggccatcctggcctacaccatcggcaccacctacttccagcgggtcctgatcttcatcctcctgaccgccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggaccctgcgcccccagccgaccgagctgaagtactcctggaaggcgtggggcaaggccaagatgctcagcacggagctgcacaaccacaccttcctgatcgacggccccgagaccgccgagtgccccaacaccaaccgggcctggaactccctcgaggtggaggactacgggttcggcgtcttcacgaccaacatctggctgaagctgaaggagcgccaggacgtgttctgcgacagcaagctcatgtccgccgcgatcaaggacaaccgggccgtgcacgccgacatggggtactggatcgagagcgccctgaacgacacctggaagatcgagaaggcctccttcatcgaggtcaagagctgccactggccgaagtcccacaccctgtggagcaacggcgtgctcgagtccgagatgatcatccccaagaacttcgcgggccccgtgagccagcacaactaccgccccgggtaccacacccagacggccggcccgtggcacctggggcggctggagatggacttcgacttctgcgagggcaccaccgtcgtggtgaccgaggactgcgggaaccgcggcccctccctccggacgaccaccgccagcggcaagctgatcaccgagtggtgctgccgcagctgcacgctgccgcccctccggtaccgcggggaggacggctgctggtacgggatggagatccggccgctgaaggagaaggaggagaacctggtcaactccctcgtgaccgccggccacgggcagatcgacaacttcagcctgggcgtgctgggcatggccctcttcctggaggagatgctgcgcacccgggtcgggaccaagcacgccatcctcctggtggccgtgtccttcgtcacgctgatcaccggcaacatgagcttccgcgacctcgggcgcgtgatggtgatggtcggcgccaccatgaccgacgacatcgggatgggcgtgacgtacctggccctgctcgcggccttcaagatccggcccaccttcgccgccggcctgctgctccgcaagctgacctccaaggagctgatgatgaccacgatcgggatcgtgctcctgagccagtccaccatccccgagagcatcctggagctcaccgacgccctggcgctgggcatgatggtcctcaagatcgtgcggaacatggagaagtaccagctggccgtcaccatcatggccatcctgtgcgtgcccaacgccgtgatcctccagaacgcctggaaggtctcctgcacgaccctggcggtggtgagcgtctccccgctgctcctgaccagctcccagcagaaggccgactggatccccctggccctcaccatcaaggggctgaaccccacggccatcttcctgaccaccctcagccgcacctccaagaagcggagctggcccctgaacgaggcgatcatggccgtgggcatggtgtccatcctggccagctccctcctgaagaacgacatcccgatgacgggccccctggtcgccgggggcctcctgaccgtgtgctacgtgctgaccgggcgcagcgccgacctcgagctggagcgggcggccgacgtccgctgggaggagcaggccgagatcagcggctccagccccatcctgtccatcaccatcagcgaggacgggtccatgagcatcaagaacgaggaggaggagcagacgctcaccatcctgatccggaccggcctgctcgtgatctccggcctgttccccgtgagcatcccgatcaccgccgccgcgtggtacctgtgggaggtcaagaagcagcgcgccggggtgctctgggacgtgcccagcccgccgcccgtcggcaaggccgagctggaggacggggcctaccggatcaagcagaagggcatcctggggtacagccagatcggcgccggcgtgtacaaggaggggaccttccacacgatgtggcacgtgacccgcggcgcggtcctcatgcacaaggggaagcggatcgagccctcctgggccgacgtgaagaaggacctgatcagctacggcgggggctggaagctggagggcgagtggaaggagggggaggaggtgcaggtcctcgccctggagcccggcaagaacccccgcgccgtgcagaccaagcccgggctgttcaagaccaacacgggcaccatcggggccgtgtccctcgacttcagccccggcacctccggcagccccatcgtcgacaagaaggggaaggtggtgggcctgtacgggaacggcgtcgtgacccggtccggcacgtacgtgagcgcgatcgcccagaccgagaagtccatcgaggacaacccggagatcgaggacgacatcttccgcaagaagcggctgaccatcatggacctgcaccccggggccggcaagaccaagcgctacctccccgccatcgtccgggaggcgatcaagcgcgggctgcggacgctgatcctcgcccccacccgcgtggtggccgccgagatggaggaggccctgcgcggcctgccgatccggtaccagacccccgcgatccgcgccgagcacaccgggcgggagatcgtcgacctcatgtgccacgccacgttcaccatgcgcctgctgagccccatccgggtgcccaactacaacctcatcatcatggacgaggcccacttcaccgacccggccagcatcgcggcccgcggctacatctccacccgggtggagatgggcgaggccgccgggatcttcatgacggccacgccgcccggcagccgcgaccccttcccgcagtccaacgcgcccatcatggacgaggagaaggagatccccgagcggagctggaactccgggcacgagtgggtcaccgacttcaagggcaagaccgtgtggttcgtgcccagcatcaaggccgggaacgacatcgccgcctgcctgcgcaagaacggcaagaaggtcatccagctgtcccggaagacgttcgacagcgagtacatcaagacccgcaccaacgactgggacttcgtggtgaccacggacatctccgagatgggcgcgaacttcaaggccgagcgggtcatcgacccgcgccggtgcatgaagcccgtgatcctcaccgacggggaggagcgcgtgatcctggccggccccatgcccgtcacccacagctccgccgcccagcggcgcgggcgggtgggccgcaacccgaagaacgagaacgaccagtacatctacatgggggagcccctggagaacgacgaggactgcgcgcactggaaggaggccaagatgctcctggacaacatcaacacccccgagggcatcatccccagcatgttcgagccggagcgcgagaaggtggacgccatcgacggcgagtaccggctgcgcggggaggcccggaagacgttcgtcgacctcatgcgccggggcgacctgcccgtgtggctggcctaccgcgtcgcggccgaggggatcaactacgccgaccggcgctggtgcttcgacggcgtgaagaacaaccagatcctcgaggagaacgtggaggtcgagatctggaccaaggagggggagcggaagaagctgaagccccgctggctggacgcccggatctactccgacccgctcgccctgaaggagttcaaggagttcgcggccggccgcaagagcctgaccctcaacctgatcaccgagatgggccggctgcccacgttcatgacccagaaggccaagaacgccctcgacaacctggcggtgctgcacaccgccgaggccgggggccgcgcctacaaccacgccctctccgagctgcccgagaccctggagacgctcctgctgctcaccctgctggcgaccgtgaccgggggcatcttcctcttcctgatgagcggcaaggggatcggcaagatgaccctggggatgtgctgcatcatcacggcctccatcctcctgtggtacgcccagatccagccccactggatcgccgccagcatcatcctggagttcttcctcatcgtcctgctgatcccggagcccgagaagcagcggacgccccaggacaaccagctcacctacgtggtgatcgcgatcctgaccgtcgtggccgccacgatggccaacgagatgggcttcctggagaagaccaagaaggacttcgggctcggctccatcaccacccagcagcccgagagcaacatcctggacatcgacctgcgcccggccagcgcgtggacgctctacgccgtggccaccaccttcatcacccccatgctgcggcactccatcgagaacagctccgtcaacgtgagcctgacggccatcgccaaccaggcgaccgtgctcatgggcctggggaagggctggcccctgtccaagatggacatcggggtccccctcctggccatcggctgctacagccaggtgaacccgatcaccctgaccgccgccctcctgctgctcgtggcgcactacgccatcatcgggcccggcctgcaggccaaggccacgcgcgaggcccagaagcgggcggccgccggcatcatgaagaaccccaccgtcgacgggatgaccgtgatcgacctggaccccatcccgtacgaccccaagttcgagaagcagctcggccaggtgatgctgctggtcctctgcgtgacccaggtgctgatgatgcgcacgacctgggccctgtgcgaggccctcaccctggcgaccgggcccatctccacgctgtgggagggcaaccccgggcggttctggaacaccaccatcgccgtcagcatggccaacatcttccgcggctcctacctcgccggcgccgggctgctgttcagcatcatgaagaacaccgcgaacacgcgccggggcaccgggaacaccggcgagaccctcggcgagaagtggaagaaccgcctgaacgccctggggaagtccgagttccagatctacaagaagtccggcatccaggaggtggaccggacgctcgccaaggaggggatcaagcgcggcgagaccgaccaccacgccgtgagccgggggagcgcgaagctgcgctggttcgtcgagcggaacctggtgaccccggagggcaaggtggtcgacctcggctgcgggcgcggcgggtggtcctactactgcggcgggctgaagaacgtgaaggaggtgaagggcctgaccaagggcgggcccggccacgaggagcccatccccatgagcacgtacgggtggaacctcgtccggctgcagtccggcgtggacgtgttcttcaccagcccggagaagtgcgacaccctgctctgcgacatcggggagtccagccccaaccccaccgtcgaggccggccgcaccctgcgggtgctgaacctcgtggagaactggctgaacaacaacacgcagttctgcatcaaggtcctgaacccctacatgccgagcgtgatcgagaagatggaggccctgcagcgcaagtacggcggggccctcgtgcggaaccccctgtcccgcaacagcacccacgagatgtactgggtctccaacgccagcggcaacatcgtgtccagcgtgaacatgatctcccggatgctgatcaaccgcttcaccatgcggcacaagaaggcgacctacgagcccgacgtcgacctcgggagcggcacgcgcaacatcgggatcgagtccgagaccccgaacctggacatcatcggcaagcggatcgagaagatcaagcaggagcacgagaccagctggcactacgaccaggaccacccctacaagacctgggcctaccacggctcctacgagacgaagcagaccgggagcgcctccagcatggtgaacggcgtggtccgcctgctcaccaagccctgggacgtgatccccatggtgacccagatggccatgacggacaccaccccgttcgggcagcagcgcgtcttcaaggagaaggtggacacccggacgcaggagcccaaggagggcaccaagaagctgatgaagatcaccgccgagtggctgtggaaggagctcggcaagaagaagacgccccgcatgtgcacgcgggaggagttcacccgcaaggtccggtccaacgcggccctgggggccatcttcaccgacgagaacaagtggaagtccgcccgcgaggccgtggaggactccggcttctgggagctggtggacaaggagcggaacctccacctggaggggaagtgcgagacctgcgtctacaacatgatgggcaagcgcgagaagaagctgggggagttcggcaaggcgaagggcagccgggccatctggtacatgtggctcggggcccgcttcctggagttcgaggccctgggcttcctcaacgaggaccactggttctcccgggagaacagcctgagcggggtggagggcgaggggctgcacaagctcggctacatcctgcgcgacgtgtccaagaaggagggcggggcgatgtacgccgacgacacggccggctgggacacccggatcaccctggaggacctcgagaacgaggagatggtcaccaaccacatggagggggagcacaagaagctggccgaggccatcttcaagctgacgtaccagaacaaggtggtgcgcgtccagcggcccaccccgcgcggcaccgtgatggacatcatcagccggcgcgaccagcgggggtccggccaggtggtcacctacggcctcaacacgttcaccaacatggaggcgcagctgatccgccagatggagggggagggcgtgttcaagagcatccagcagctgaccgtgaaggaggagatcgccgtcaagaactggctcacccgggtggggcgcgagcgcctgtcccggatggccatcagcggcgacgactgcgtggtcaagcccctggacgaccgcttcgcctccgccctcacggcgctgaacgacatgggcaaggtgcggaaggacatccagcagtgggagcccagccgcgggtggaacgactggacccaggtgcccttctgctcccaccacttccacgagctgatcatgaaggacggccgggtcctcgtggtgccgtgccgcaaccaggacgagctgatcgggcgggcccgcatcagccagggcgccgggtggtccctgcgggagaccgcctgcctcggcaagagctacgcccagatgtggtccctgatgtacttccaccgccgggacctgcgcctcgcggccaacgccatctgcagcgccgtcccctcccactggatccccaccagccggaccacgtggtccatccacgccacccacgagtggatgaccaccgaggacatgctgacggtgtggaaccgcgtgtggatccaggagaacccctggatggaggacaagaccccggtcgagagctgggaggagatcccctacctgggcaagcgggaggaccagtggtgcgggagcctcatcggcctgacctcccgcgcgacctgggccaagaacatccagacggccatcaaccaggtgcggagcctgatcgggaacgaggagtacaccgactacatgccctccatgaagcgcttccggcgcgaggaggaggaggccggcgtgctctggtga

SEQ ID NO: 9092 - RNA, 9876 nt, synthetic construct
  misc_feature 1..9876: note = derived and/or modified CDS sequence (opt1) from DENV-2__KM279568__SS-prME
  source 1..9876: mol_type = other RNA
accgcgggcatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaagatcacgccccagagctccatcaccgaggccgagctgaccggctacgggaccgtcacgatggagtgcagcccgcgcaccggcctcgacttcaacgagatggtgctgctgcagatggagaacaaggcctggctcgtgcaccggcagtggttcctggacctgcccctcccctggctgcccggcgcggacacccaggggtccaactggatccagaaggagaccctggtcacgttcaagaacccgcacgccaagaagcaggacatcgtggtcctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtggtgaaggagatcgcggagacccagcacggcaccatcgtcatccgcgtgcagtacgagggggacggcagcccctgcaagatccccttcgagatcatggacctggagaagcggcacgtgctcggccgcctgatcacggtcaaccccatcgtgaccgagaaggactccccggtgaacatcgaggccgagccgcccttcggggacagctacatcatcatcggcgtcgagcccgggcagctgaagctctcctggttcaagaagggcagctccatcgggcagatgttcgagaccaccatgcgcggcgccaagcggatggccatcctgggcgacacggcctgggacttcgggagcctgggcggggtgttcacctccatcggcaaggcgctccaccaggtgttcggggccatctacggcgccgccttcagcggcgtctcctggaccatgaagatcctgatcggggtggtgatcacctggatcggcatgaacagccgctccacgagcctgtccgtcagcctggtgctcgtgggggtcgtgaccctgtacctgggcgtgatggtccaggcggactccgggtgcgtggtgagctggaagaacaaggagctcaagtgcggcagcggcatcttcatcaccgacaacgtccacacctggacggagcagtacaagttccagccggagtcccccagcaagctggcctccgccatccagaaggcccacgaggaggggatctgcggcatccggagcgtgacccgcctggagaacctcatgtggaagcagatcacccccgagctgaaccacatcctgaccgagaacgaggtgaagctcacgatcatgaccggggacatcaagggcatcatgcaggccgggaagcggtccctgcgcccccagccgaccgagctgaagtacagctggaaggcgtggggcaaggccaagatgctctccaccgagctgcacaaccacacgttcctgatcgacggccccgagaccgccgagtgccccaacaccaaccgggcctggaacagcctcgaggtcgaggactacgggttcggcgtgttcaccacgaacatctggctgaagctgaaggagcgccaggacgtgttctgcgactccaagctcatgagcgccgcgatcaaggacaaccgggccgtccacgccgacatggggtactggatcgagtccgccctgaacgacacctggaagatcgagaaggccagcttcatcgaggtgaagtcctgccactggcccaagagccacaccctgtggtccaacggcgtgctcgagagcgagatgatcatccccaagaacttcgcgggccccgtctcccagcacaactaccgccccgggtaccacacccagaccgccggcccgtggcacctggggcggctggagatggacttcgacttctgcgagggcacgaccgtggtggtcaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtgaacagcctcgtgacggccggccacgggcagatcgacaacttctccctgggcgtcctgggcatggccctcttcctggaggagatgctgcgcacccgggtggggaccaagcacgccatcctcctggtggccgtcagcttcgtgaccctgatcacgggcaacatgtccttccgcgacctcgggcgcgtgatggtcatggtgggcgccaccatgaccgacgacatcgggatgggcgtgacctacctggccctgctcgcggccttcaaggtccggcccacgttcgccgccggcctgctgctccgcaagctgaccagcaaggagctgatgatgaccaccatcgggatcgtgctcctgtcccagagcacgatccccgagtccatcctggagctcaccgacgccctggcgctgggcatgatggtgctcaagatcgtccggaacatggagaagtaccagctggccgtgaccatcatggccatcagctgcgtccccaacgccgtgatcctgcagaacgcctggaaggtgtcctgcaccacgctcgcggtcgtgagcgtgtccccgctgctgctcaccagctcccagcagaaggccgactggatccccctggccctgaccatcaaggggctcaaccccaccgccatcttcctgacgaccctgagccgcacctccaagaagcggagctggcccctcaacgaggcgatcatggccgtcggcatggtgtccatcctggccagcagcctgctcaagaacgacatcccgatgaccggccccctggtggccgggggcctgctcacggtctgctacgtgctgaccgggcgctccgccgacctggagctcgagcgggcggccgacgtgcgctgggaggagcaggccgagatcagcggctccagccccatcctgtccatcaccatcagcgaggacgggtccatgagcatcaagaacgaggaggaggagcagaccctgacgatcctcatccggaccggcctgctggtcatctccggcctcttccccgtgagcatcccgatcaccgccgccgcgtggtacctgtgggaggtgaagaagcagcgcgccggggtcctgtgggacgtgcccagcccgccgcccgtgggcaaggccgagctcgaggacggggcctaccggatcaagcagaagggcatcctggggtacagccagatcggcgccggcgtctacaaggaggggaccttccacaccatgtggcacgtgacgcgcggcgcggtgctgatgcacaaggggaagcggatcgagccctcctgggccgacgtcaagaaggacctcatcagctacggcgggggctggaagctggagggcgagtggaaggagggggaggaggtccaggtgctggccctcgagcccggcaagaacccgcgcgccgtccagaccaagcccgggctgttcaagaccaacaccggcacgatcggggccgtgtccctggacttcagccccggcacctccggcagccccatcgtggacaagaaggggaaggtcgtgggcctctacgggaacggcgtggtcacccggtccggcacctacgtgagcgcgatcgcccagacggagaagtccatcgaggacaacccggagatcgaggacgacatcttccgcaagaagcggctgaccatcatggacctgcaccccggggccggcaagaccaagcgctacctgcccgccatcgtgcgggaggcgatcaagcgcgggctccggaccctgatcctggcccccacgcgcgtcgtggccgccgagatggaggaggccctccgcggcctgccgatccggtaccagacccccgcgatccgcgccgagcacaccgggcgggagatcgtggacctgatgtgccacgccaccttcacgatgcgcctcctgagccccatccgggtccccaactacaacctgatcatcatggacgaggcccacttcaccgacccggccagcatcgcggcccgcggctacatctccacccgggtggagatgggcgaggccgccgggatcttcatgaccgccacgccgcccggcagccgcgaccccttcccgcagtccaacgcgcccatcatggacgaggagcgggagatccccgagcgcagctggaactccgggcacgagtgggtgaccgacttcaagggcaagaccgtctggttcgtgcccagcatcaaggccgggaacgacatcgccgcctgcctccggaagaacggcaagaaggtgatccagctgtcccgcaagaccttcgacagcgagtacatcaagacgcggaccaacgactgggacttcgtcgtgaccaccgacatctccgagatgggcgcgaacttcaaggccgagcgcgtgatcgacccgcggcgctgcatgaagcccgtcatcctgacggacggggaggagcgggtgatcctcgccggccccatgcccgtgacccacagctccgccgcccagcgccgggggcgcgtcggccgcaacccgaagaacgagaacgaccagtacatctacatgggggagcccctggagaacgacgaggactgcgcgcactggaaggaggccaagatgctgctcgacaacatcaacacccccgagggcatcatccccagcatgttcgagccggagcgggagaaggtggacgccatcgacggcgagtaccgcctgcgcggggaggcccgcaagaccttcgtggacctgatgcggcgcggcgacctccccgtctggctggcctaccgggtggcggccgaggggatcaactacgccgaccgccggtggtgcttcgacggcgtcaagaacaaccagatcctggaggagaacgtggaggtggagatctggacgaaggagggggagcgcaagaagctcaagccccggtggctggacgcccgcatctactccgacccgctggccctcaaggagttcaaggagttcgcggccggccggaagtccctgaccctgaacctcatcaccgagatgggccgcctgcccaccttcatgacgcagaaggccaagaacgccctggacaacctcgcggtcctgcacaccgccgaggccgggggccgggcctacaaccacgccctgtccgagctccccgagaccctggagaccctgctcctgctgacgctcctggcgaccgtgaccgggggcatcttcctgttcctcatgagcggcaaggggatcggcaagatgaccctggggatgtgctgcatcatcaccgcctccatcctgctctggtacgcccagatccagccccactggatcgccgccagcatcatcctggagttcttcctgatcgtgctcctgatcccggagcccgagaagcagcgcacgccccaggacaaccagctgacctacgtcgtgatcgcgatcctcaccgtggtcgccgccaccatggccaacgagatgggcttcctggagaagacgaagaaggacttcgggctgggcagcatcaccacccagcagcccgagtccaacatcctcgacatcgacctgcggccggccagcgcgtggaccctgtacgccgtggccacgaccttcatcacccccatgctccgccactccatcgagaacagctccgtgaacgtcagcctgaccgccatcgccaaccaggcgacggtgctgatgggcctcgggaagggctggcccctgtccaagatggacatcggggtgcccctgctcgccatcggctgctacagccaggtcaacccgatcaccctgaccgccgccctgctcctgctggtggcgcactacgccatcatcgggcccggcctccaggccaaggccacccgggaggcccagaagcgcgcggccgccggcatcatgaagaaccccacggtggacgggatgaccgtcatcgacctggaccccatcccgtacgaccccaagttcgagaagcagctgggccaggtgatgctcctggtgctgtgcgtcacccaggtgctcatgatgcggaccacgtgggccctgtgcgaggccctgaccctcgcgaccgggcccatctccaccctgtgggagggcaaccccgggcgcttctggaacacgaccatcgccgtgagcatggccaacatcttccgcggctcctacctggccggcgccgggctcctgttcagcatcatgaagaacaccgcgaacacccggcgcggcacggggaacaccggcgagaccctgggcgagaagtggaagaaccggctcaacgccctggggaagtccgagttccagatctacaagaagtccggcatccaggaggtcgaccgcaccctggccaaggaggggatcaagcggggcgagacggaccaccacgccgtgtcccgcgggagcgcgaagctccggtggttcgtggagcgcaacctggtcaccccggagggcaaggtggtggacctgggctgcgggcggggcgggtggtcctactactgcggcgggctcaagaacgtcaaggaggtgaagggcctgaccaagggcgggcccggccacgaggagcccatccccatgagcacctacgggtggaacctggtgcgcctccagtccggcgtcgacgtgttcttcacgccgcccgagaagtgcgacaccctgctgtgcgacatcggggagagcagccccaaccccaccgtggaggccggccggaccctccgcgtcctgaacctggtggagaactggctcaacaacaacacccagttctgcatcaaggtgctgaacccgtacatgccctccgtcatcgagaagatggaggccctgcagcggaagtacggcggggccctggtgcgcaaccccctcagccggaactccacgcacgagatgtactgggtgagcaacgcctccggcaacatcgtcagctccgtgaacatgatcagccgcatgctgatcaaccggttcaccatgcgccacaagaaggcgacctacgagccggacgtggacctggggtccggcacccggaacatcgggatcgagagcgagacgcccaacctcgacatcatcggcaagcgcatcgagaagatcaagcaggagcacgagacctcctggcactacgaccaggaccacccctacaagacctgggcctaccacggcagctacgagaccaagcagacggggtccgccagctccatggtcaacggcgtggtgcgcctgctgaccaagccctgggacgtcatcccgatggtgacccagatggccatgaccgacacgacccccttcgggcagcagcgggtgttcaaggagaaggtcgacacccgcacccaggagcccaaggagggcacgaagaagctcatgaagatcaccgccgagtggctgtggaaggagctgggcaagaagaagacgccccggatgtgcacccgcgaggagttcacgcggaaggtgcgcagcaacgcggccctcggggccatcttcaccgacgagaacaagtggaagtccgcccgggaggccgtcgaggacagcggcttctgggagctggtggacaaggagcgcaacctgcacctcgaggggaagtgcgagacctgcgtgtacaacatgatgggcaagcgggagaagaagctgggggagttcggcaaggcgaagggctcccgcgccatctggtacatgtggctgggggcccggttcctcgagttcgaggccctgggcttcctgaacgaggaccactggttcagccgcgagaacagcctctccggggtcgagggcgaggggctgcacaagctgggctacatcctccgggacgtgagcaagaaggagggcggggcgatgtacgccgacgacaccgccggctgggacacgcgcatcaccctggaggacctgaagaacgaggagatggtgaccaaccacatggagggggagcacaagaagctcgccgaggccatcttcaagctgacctaccagaacaaggtcgtgcgggtgcagcgcccgacgccccggggcaccgtcatggacatcatctcccgccgggaccagcgcgggagcggccaggtggtgacctacggcctgaacaccttcacgaacatggaggcgcagctcatccggcagatggagggggagggcgtcttcaagtccatccagcagctgaccgtgaaggaggagatcgccgtgaagaactggctgatccgcgtcgggcgcgagcggctcagccgcatggccatctccggcgacgactgcgtggtgaagcccctggacgaccggttcgccagcgccctgaccgcgctcaacgacatgggcaaggtccgcaaggacatccagcagtgggagccctcccgggggtggaacgactggacccaggtgccgttctgcagccaccacttccacgagctgatcatgaaggacggccgcgtgctggtcgtgccctgccggaaccaggacgagctcatcgggcgcgcccggatctcccagggcgccgggtggagcctgcgcgagacggcctgcctgggcaagtcctacgcccagatgtggagcctcatgtacttccaccggcgcgacctgcggctggcggccaacgccatctgctccgccgtgcccagccactggatccccacctcccgcaccacctggagcatccacgccacccacgagtggatgacgaccgaggacatgctcaccgtctggaaccgggtgtggatccaggagaacccgtggatggaggacaagacccccgtggagagctgggaggagatcccctacctgggcaagcgcgaggaccagtggtgcgggtccctgatcggcctcacgagccgggcgacctgggccaagaacatccagaccgccatcaaccaggtccgctccctgatcgggaacgaggagtacaccgactacatgcccagcatgaagcggttccgccgcgaggaggaggaggccggcgtgctgtggtga

SEQ ID NO: 9093 - RNA, 9876 nt, synthetic construct
  misc_feature 1..9876: note = derived and/or modified CDS sequence (opt1) from DENV-2__KM279569__SS-prME
  source 1..9876: mol_type = other RNA
accgcgggcatcatcatcatgatgatccccaccgtgatggccttccacctgaccacccgcaacggggagccccacatgatcgtctcccggcaggagaagggcaagtccctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcaccatcatggcggccatcctggcctacaccatcggcaccacctacttccagcgggtcctgatcttcatcctcctgaccgccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggaccctgcgcccccagccgaccgagctgaagtactcctggaaggcgtggggcaaggccaagatgctcagcacggagctgcacaaccacaccttcctgatcgacggccccgagaccgccgagtgccccaacaccaaccgggcctggaactccctcgaggtggaggactacgggttcggcgtcttcacgaccaacatctggctgaagctgaaggagcgccaggacgtgttctgcgacagcaagctcatgtccgccgcgatcaaggacaaccgggccgtgcacgccgacatggggtactggatcgagagcgccctgaacgacacctggaagatcgagaaggcctccttcatcgaggtcaagagctgccactggccgaagtcccacaccctgtggagcaacggcgtgctcgagtccgagatgatcatccccaagaacttcgcgggccccgtgagccagcacaactaccgccccgggtaccacacccagacggccggcccgtggcacctggggcggctggagatggacttcgacttctgcgagggcaccaccgtcgtggtgaccgaggactgcgggaaccgcggcccctccctccggacgaccaccgccagcggcaagctgatcaccgagtggtgctgccgcagctgcacgctgccgcccctccggtaccgcggggaggacggctgctggtacgggatggagatccggccgctgaaggagaaggaggagaacctggtcaactccctcgtgaccgccggccacgggcagatcgacaacttcagcctgggcgtgctgggcatggccctcttcctggaggagatgctgcgcacccgggtcgggaccaagcacgccatcctcctggtggccgtgtccttcgtcacgctgatcaccggcaacatgagcttccgcgacctcgggcgcgtgatggtgatggtcggcgccaccatgaccgacgacatcgggatgggcgtgacgtacctggccctgctcgcggccttcaaggtgcggcccaccttcgccgccggcctgctgctccgcaagctgacctccaaggagctgatgatgaccacgatcgggatcgtcctcctgagccagtccaccatccccgagagcatcctggagctcaccgacgccctggcgctgggcatgatggtgctcaagatcgtccggaacatggagaagtaccagctggccgtgaccatcatggccatcctgtgcgtgcccaacgccgtcatcctccagaacgcctggaaggtgtcctgcacgaccctggcggtggtcagcgtgtccccgctgctcctgaccagctcccagcagaaggccgactggatccccctggccctcaccatcaaggggctgaaccccacggccatcttcctgaccaccctcagccgcacctccaagaagcggagctggcccctgaacgaggcgatcatggccgtgggcatggtctccatcctggccagctccctcctgaagaacgacatcccgatgacgggccccctggtggccgggggcctcctgaccgtgtgctacgtcctgaccgggcgcagcgccgacctcgagctggagcgggcggccgacgtgcgctgggaggagcaggccgagatcagcggctccagccccatcctgtccatcaccatcagcgaggacgggtccatgagcatcaagaacgaggaggaggagcagacgctcaccatcctgatccggaccggcctgctcgtgatctccggcctgttccccgtcagcatcccgatcaccgccgccgcgtggtacctgtgggaggtgaagaagcagcgcgccggggtgctctgggacgtccccagcccgccgcccgtgggcaaggccgagctggaggacggggcctaccggatcaagcagaagggcatcctggggtacagccagatcggcgccggcgtgtacaaggaggggaccttccacacgatgtggcacgtcacccgcggcgcggtgctcatgcacaaggggaagcggatcgagccctcctgggccgacgtgaagaaggacctgatcagctacggcgggggctggaagctggagggcgagtggaaggagggggaggaggtccaggtgctcgccctggagcccggcaagaacccccgcgccgtgcagaccaagcccgggctgttcaagaccaacacgggcaccatcggggccgtctccctcgacttcagccccggcacctccggcagccccatcgtggacaagaaggggaaggtggtcggcctgtacgggaacggcgtggtgacccggtccggcacgtacgtcagcgcgatcgcccagaccgagaagtccatcgaggacaacccggagatcgaggacgacatcttccgcaagaagcggctgaccatcatggacctgcaccccggggccggcaagaccaagcgctacctccccgccatcgtgcgggaggcgatcaagcgcgggctgcggacgctgatcctcgcccccacccgcgtggtcgccgccgagatggaggaggccctgcgcggcctgccgatccggtaccagacccccgcgatccgcgccgagcacaccgggcgggagatcgtggacctcatgtgccacgccacgttcaccatgcgcctgctgagccccatccgggtgcccaactacaacctcatcatcatggacgaggcccacttcaccgacccggccagcatcgcggcccgcggctacatctccacccgggtcgagatgggcgaggccgccgggatcttcatgacggccacgccgcccggcagccgcgaccccttcccgcagtccaacgcgcccatcatggacgaggagaaggagatccccgagcggagctggaactccgggcacgagtgggtgaccgacttcaagggcaagaccgtgtggttcgtccccagcatcaaggccgggaacgacatcgccgcctgcctgcgcaagaacggcaagaaggtgatccagctgtcccggaagacgttcgacagcgagtacatcaagacccgcaccaacgactgggacttcgtggtcaccacggacatctccgagatgggcgcgaacttcaaggccgagcgggtgatcgacccgcgccggtgcatgaagcccgtgatcctcaccgacggggaggagcgcgtcatcctggccggccccatgcccgtgacccacagctccgccgcccagcggcgcgggcgggtgggccgcaacccgaagaacgagaacgaccagtacatctacatgggggagcccctggagaacgacgaggactgcgcgcactggaaggaggccaagatgctcctggacaacatcaacacccccgagggcatcatccccagcatgttcgagccggagcgcgagaaggtcgacgccatcgacggcgagtaccggctgcgcggggaggcccggaagacgttcgtggacctcatgcgccggggcgacctgcccgtctggctggcctaccgcgtggcggccgaggggatcaactacgccgaccggcgctggtgcttcgacggcgtgaagaacaaccagatcctcgaggagaacgtcgaggtggagatctggaccaaggagggggagcggaagaagctgaagccccgctggctggacgcccggatctactccgacccgctcgccctgaaggagttcaaggagttcgcggccggccgcaagagcctgaccctcaacctgatcaccgagatgggccggctgcccacgttcatgacccagaaggccaagaacgccctcgacaacctggcggtgctgcacaccgccgaggccgggggccgcgcctacaaccacgccctctccgagctgcccgagaccctggagacgctcctgctgctcaccctgctggcgaccgtcaccgggggcatcttcctcttcctgatgagcggcaaggggatcggcaagatgaccctggggatgtgctgcatcatcacggcctccatcctcctgtggtacgcccagatccagccccactggatcgccgccagcatcatcctggagttcttcctcatcgtgctgctgatcccggagcccgagaagcagcggacgccccaggacaaccagctcacctacgtggtcatcgcgatcctgaccgtggtggccgccacgatggccaacgagatgggcttcctggagaagaccaagaaggacttcgggctcggctccatcaccacccagcagcccgagagcaacatcctggacatcgacctgcgcccggccagcgcgtggacgctctacgccgtcgccaccaccttcatcacccccatgctgcggcactccatcgagaacagctccgtgaacgtgagcctgacggccatcgccaaccaggcgaccgtcctcatgggcctggggaagggctggcccctgtccaagatggacatcggggtgcccctcctggccatcggctgctacagccaggtgaacccgatcaccctgaccgccgccctcctgctgctcgtcgcgcactacgccatcatcgggcccggcctgcaggccaaggccacgcgcgaggcccagaagcgggcggccgccggcatcatgaagaaccccaccgtggacgggatgaccgtgatcgacctggaccccatcccgtacgaccccaagttcgagaagcagctcggccaggtcatgctgctggtgctctgcgtgacccaggtcctgatgatgcgcacgacctgggccctgtgcgaggccctcaccctggcgaccgggcccatctccacgctgtgggagggcaaccccgggcggttctggaacaccaccatcgccgtgagcatggccaacatcttccgcggctcctacctcgccggcgccgggctgctgttcagcatcatgaagaacaccgcgaacacgcgccggggcaccgggaacaccggcgagaccctcggcgagaagtggaagaaccgcctgaacgccctggggaagtccgagttccagatctacaagaagtccggcatccaggaggtggaccggacgctcgccaaggaggggatcaagcgcggcgagaccgaccaccacgccgtcagccgggggagcgcgaagctgcgctggttcgtggagcggaacctggtgaccccggagggcaaggtcgtggacctcggctgcgggcgcggcgggtggtcctactactgcggcgggctgaagaacgtgaaggaggtcaagggcctgaccaagggcgggcccggccacgaggagcccatccccatgagcacgtacgggtggaacctcgtgcggctgcagtccggcgtggacgtcttcttcaccccgcccgagaagtgcgacaccctgctctgcgacatcggggagagctcccccaaccccaccgtggaggccggccgcaccctgcgggtgctgaacctcgtcgagaactggctgaacaacaacacgcagttctgcatcaaggtgctgaacccgtacatgcccagcgtgatcgagaagatggaggccctgcagcgcaagtacggcggggccctcgtccggaaccccctgagccgcaactccacccacgagatgtactgggtgagcaacgcctccggcaacatcgtgagctccgtcaacatgatcagccggatgctgatcaaccgcttcaccatgcggcacaagaaggcgacctacgagccggacgtggacctcgggtccggcacgcgcaacatcgggatcgagagcgagacccccaacctggacatcatcggcaagcggatcgagaagatcaagcaggagcacgagacctcctggcactacgaccaggaccacccctacaagacctgggcctaccacggcagctacgagacgaagcagaccgggtccgccagctccatggtgaacggcgtcgtgcgcctgctcaccaagccctgggacgtgatcccgatggtcacccagatggccatgacggacaccacccccttcgggcagcagcgcgtgttcaaggagaaggtcgacacccggacgcaggagcccaaggagggcaccaagaagctgatgaagatcaccgccgagtggctgtggaaggagctcggcaagaagaagacgccccgcatgtgcacgcgggaggagttcacccgcaaggtgcggagcaacgcggccctgggggccatcttcaccgacgagaacaagtggaagtccgcccgcgaggccgtggaggacagcggcttctgggagctggtcgacaaggagcggaacctccacctggaggggaagtgcgagacctgcgtgtacaacatgatgggcaagcgcgagaagaagctgggggagttcggcaaggcgaagggctcccgggccatctggtacatgtggctcggggcccgcttcctggagttcgaggccctgggcttcctcaacgaggaccactggttcagccgggagaactccctgagcggggtggagggcgaggggctgcacaagctcggctacatcctgcgcgacgtcagcaagaaggagggcggggcgatgtacgccgacgacacggccggctgggacacccggatcaccctggaggacctcaagaacgaggagatggtgaccaaccacatggagggggagcacaagaagctggccgaggccatcttcaagctgacgtaccagaacaaggtggtccgcgtgcagcggccgacgccccgcggcaccgtgatggacatcatctcccggcgcgaccagcgggggagcggccaggtcgtgacctacggcctcaacaccttcaccaacatggaggcgcagctgatccgccagatggagggggagggcgtgttcaagtccatccagcagctgaccgtcaaggaggagatcgccgtgaaggactggctcatccgggtggggcgcgagcgcctgagccggatggccatctccggcgacgactgcgtcgtgaagcccctggacgaccgcttcgccagcgccctcaccgcgctgaacgacatgggcaaggtgcggaaggacatccagcagtgggagccctcccgcgggtggaacgactggacgcaggtcccgttctgcagccaccacttccacgagctgatcatgaaggacggccgggtgctcgtggtcccctgccgcaaccaggacgagctgatcgggcgggcccgcatctcccagggcgccgggtggagcctgcgggagaccgcctgcctcggcaagtcctacgcccagatgtggagcctgatgtacttccaccgccgggacctgcgcctcgcggccaacgccatctgctccgccgtgcccagccactggatccccacctcccggaccacctggagcatccacgccacgcacgagtggatgaccaccgaggacatgctgaccgtgtggaaccgcgtctggatccaggagaacccgtggatggaggacaagacgcccgtggagtcctgggaggagatcccctacctgggcaagcgggaggaccagtggtgcgggagcctcatcggcctgaccagccgcgcgacctgggccaagaacatccagaccgccatcaaccaggtgcggtccctgatcgggaacgaggagtacacggactacatgcccagcatgaagcgcttccggcgcgaggaggaggaggccggcgtcctctggtga

SEQ ID NO: 9094 - RNA, 9876 nt, synthetic construct
  misc_feature 1..9876: note = derived and/or modified CDS sequence (opt1) from DENV-2__KM279570__SS-prME
  source 1..9876: mol_type = other RNA
accgccgggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgagcagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggtccctgcgcccccagccgaccgagctgaagtacagctggaaggcgtggggcaaggccaagatgctctccaccgagctgcacaaccacacgttcctgatcgacggccccgagaccgccgagtgccccaacaccaaccgggcctggaacagcctcgaggtggaggactacgggttcggcgtcttcaccacgaacatctggctgaagctgaaggagcgccaggacgtgttctgcgactccaagctcatgagcgccgcgatcaaggacaaccgggccgtgcacgccgacatggggtactggatcgagtccgccctgaacgacacctggaagatcgagaaggccagcttcatcgaggtcaagtcctgccactggcccaagagccacaccctgtggtccaacggcgtgctcgagagcgagatgatcatccccaagaacttcgcgggccccgtgtcccagcacaactaccgccccgggtaccacacccagaccgccggcccgtggcacctggggcggctggagatggacttcgacttctgcgagggcacgaccgtcgccgtgaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtgaacagcctcgtcacggcgggccacgggcagatcgacaacttctccctgggcgtgctgggcatggccctcttcctggaggagatgctgcgcacccgggtggggaccaagcacgccatcctcctggtcgccgtgagcttcgtgaccctgatcacgggcaacatgtccttccgcgacctcgggcgcgtcatggtgatggtgggcgccaccatgaccgacgacatcgggatgggcgtcacctacctggcgctgctcgccgccttcaaggtgcggcccacgttcgccgccggcctgctgctccgcaagctgaccagcaaggagctgatgatgaccaccatcgggatcgtgctcctgtcccagagcacgatccccgagtccatcctggagctcaccgacgcgctggccctgggcatgatggtcctcaagatcgtgcggaacatggagaagtaccagctggccgtcaccatcatggccatcctgtgcgtgcccaacgccgtgatcctccagaacgcgtggaaggtcagctgcaccacgctggccgtggtgtccgtcagcccgctgctcctgacctccagccagcagaaggccgactggatccccctggccctcaccatcaaggggctgaaccccaccgcgatcttcctgacgaccctctcccgcaccagcaagaagcggtcctggcccctgaacgaggccatcatggccgtgggcatggtgagcatcctggcctccagcctcctgaagaacgacatcccgatgaccggccccctggtcgccgggggcctcctgacggtgtgctacgtgctgaccgggcgcagcgcggacctcgagctggagcgggccgccgacgtccgctgggaggagcaggccgagatctccggcagctcccccatcctgagcatcaccatctccgaggacgggagcatgtccatcaagaacgaggaggaggagcagaccctcacgatcctgatccggaccggcctgctcgtgatcagcggcctgttccccgtgtccatcccgatcaccgccgcggcctggtacctgtgggaggtcaagaagcagcgcgccggggtgctctgggacgtgccctccccgccgcccgtcggcaaggccgagctggaggacggggcctaccggatcaagcagaagggcatcctggggtactcccagatcggcgcgggcgtgtacaaggaggggaccttccacaccatgtggcacgtgacgcgcggcgccgtcctcatgcacaaggggaagcggatcgagcccagctgggccgacgtgaagaaggacctgatctcctacggcgggggctggaagctggagggcgagtggaaggagggggaggaggtgcaggtcctcgccctggagcccggcaagaacccgcgcgccgtgcagaccaagcccgggctgttcaagaccaacaccggcacgatcggggcggtgagcctcgacttctcccccggcaccagcggctcccccatcgtcgacaagaaggggaaggtggtgggcctgtacgggaacggcgtcgtgacccggagcggcacctacgtgtccgccatcgcccagacggagaagtccatcgaggacaacccggagatcgaggacgacatcttccgcaagaagcggctgaccatcatggacctgcaccccggggccggcaagaccaagcgctacctccccgcgatcgtccgggaggccatcaagcgcgggctgcggaccctgatcctcgcccccacgcgcgtggtggccgccgagatggaggaggcgctgcgcggcctgccgatccggtaccagacccccgccatccgcgccgagcacaccgggcgggagatcgtcgacctcatgtgccacgccaccttcacgatgcgcctgctgagccccatccgggtgcccaactacaacctcatcatcatggacgaggcccacttcaccgacccggcgtccatcgccgcccgcggctacatcagcacccgggtggagatgggcgaggccgccgggatcttcatgaccgcgacgccgcccggctcccgcgaccccttcccgcagagcaacgcccccatcatggacgaggagcgggagatccccgagcgctcctggaacagcgggcacgagtgggtcaccgacttcaagggcaagaccgtgtggttcgtgccctccatcaaggccgggaacgacatcgccgcgtgcctgcggaagaacggcaagaaggtcatccagctgagccgcaagaccttcgactccgagtacatcaagacgcggaccaacgactgggacttcgtggtgaccaccgacatcagcgagatgggcgccaacttcaaggccgagcgcgtcatcgacccgcggcgctgcatgaagcccgtgatcctcacggacggggaggagcgggtgatcctggccggccccatgcccgtcacccactccagcgccgcgcagcgccgggggcgcgtgggccgcaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgggagaaggtggacgccatcgacggcgagtaccgcctgcgcggggaggcccgcaagaccttcgtcgacctcatgcggcgcggcgacctgcccgtgtggctggcgtaccgggtcgccgccgaggggatcaactacgccgaccgccggtggtgcttcgacggcgtgaagaacaaccagatcctcgaggagaacgtggaggtcgagatctggacgaaggagggggagcgcaagaagctgaagccccggtggctggacgcccgcatctacagcgacccgctcgcgctgaaggagttcaaggagttcgccgccggccggaagtccctgaccctcaacctgatcaccgagatgggccgcctgcccaccttcatgacgcagaaggccaagaacgcgctcgacaacctggccgtgctgcacaccgccgaggccgggggccgggcctacaaccacgcgctcagcgagctgcccgagaccctggagaccctcctgctgctcacgctgctggccaccgtgaccgggggcatcttcctcttcctgatgtccggcaaggggatcggcaagatgaccctggggatgtgctgcatcatcaccgccagcatcctcctgtggtacgcccagatccagccccactggatcgccgcgtccatcatcctggagttcttcctcatcgtcctgctgatcccggagcccgagaagcagcgcacgccccaggacaaccagctcacctacgtggtgatcgccatcctgaccgtcgtggccgccaccatggccaacgagatgggcttcctggagaagacgaagaaggacttcgggctcggcagcatcaccacccagcagcccgagagcaacatcctggacatcgacctgcggccggcgtccgcctggaccctctacgccgtggccacgaccttcatcacccccatgctgcgccacagcatcgagaactccagcgtcaacgtgtccctgaccgccatcgcgaaccaggccacggtgctcatgggcctggggaagggctggcccctgagcaagatggacatcggggtccccctcctggccatcggctgctactcccaggtgaacccgatcaccctgaccgccgcgctcctgctgctcgtggcccactacgccatcatcgggcccggcctgcaggccaaggccacccgggaggcgcagaagcgcgccgccgccggcatcatgaagaaccccacggtcgacgggatgaccgtgatcgacctggaccccatcccgtacgaccccaagttcgagaagcagctcggccaggtgatgctgctggtcctctgcgtgacccaggtgctgatgatgcggaccacgtgggccctgtgcgaggcgctcaccctggccaccgggcccatcagcaccctgtgggagggcaaccccgggcgcttctggaacacgaccatcgccgtctccatggccaacatcttccgcggcagctacctcgccggcgcggggctgctgttctccatcatgaagaacaccgccaacacccggcgcggcacggggaacaccggcgagaccctcggcgagaagtggaagaaccggctgaacgccctgggcaagagcgagttccagatctacaagaagtccggcatccaggaggtggaccgcaccctcgccaaggaggggatcaagcggggcgagacggaccaccacgcggtgagccgcgggtccgccaagctgcggtggttcgtcgagcgcaacctggtgaccccggagggcaaggtggtcgacctcggctgcgggcggggcgggtggagctactactgcggcgggctgaagaacgtgaaggaggtgaagggcctgaccaagggcgggcccggccacgaggagcccatccccatgtccacctacgggtggaacctcgtccgcctgcagagcggcgtggacgtgttcttcacgccgcccgagaagtgcgacaccctgctctgcgacatcggggagtccagccccaaccccaccgtcgaggccggccggaccctgcgcgtgctgaacctcgtggagaactggctgaacaacaacacccagttctgcatcaaggtcctgaacccgtacatgcccagcgtgatcgagaagatggaggccctgcagcggaagtacggcggggccctcgtgcgcaaccccctgtcccggaacagcacgcacgagatgtactgggtctccaacgcgagcggcaacatcgtgtccagcgtgaacatgatctcccgcatgctgatcaaccggttcaccatgcgccacaagaaggccacctacgagccggacgtcgacctcgggagcggcacccggaacatcgggatcgagtccgagacgcccaacctggacatcatcggcaagcgcatcgagaagatcaagcaggagcacgagaccagctggcactacgaccaggaccacccctacaagacctgggcctaccacggctcctacgagaccaagcagacggggagcgcctccagcatggtgaacggcgtggtccgcctgctcaccaagccctgggacgtgatcccgatggtgacccagatggccatgaccgacacgacccccttcgggcagcagcgggtcttcaaggagaaggtggacacccgcacccaggagcccaaggagggcacgaagaagctgatgaagatcaccgcggagtggctgtggaaggagctcggcaagaagaagacgccccggatgtgcacccgcgaggagttcacgcggaaggtccgctccaacgccgccctgggggccatcttcaccgacgagaacaagtggaagtccgcccgggaggcggtggaggactccggcttctgggagctggtggacaaggagcgcaacctccacctggaggggaagtgcgagacctgcgtctacaacatgatgggcaagcgggagaagaagctgggggagttcggcaaggccaagggcagccgcgccatctggtacatgtggctcggggcccggttcctggagttcgaggcgctgggcttcctcaacgaggaccactggttctcccgcgagaacagcctgagcggggtggagggcgaggggctgcacaagctcggctacatcctgcgggacgtgtccaagaaggagggcggggccatgtacgccgacgacaccgccggctgggacacgcgcatcaccctggaggacctcaagaacgaggagatggtcaccaaccacatggagggggagcacaagaagctggccgaggcgatcttcaagctgacctaccagaacaaggtggtgcgggtccagcgcccgacgccccggggcaccgtgatggacatcatcagccgccgggaccagcgcgggtccggccaggtggtcacctacggcctcaacaccttcacgaacatggaggcccagctgatccggcagatggagggggagggcgtgttcaagagcatccagcagctgaccgtgaaggaggagatcgccgtcaagaactggctcatccgcgtggggcgcgagcggctgtcccgcatggccatcagcggcgacgactgcgtggtcaagcccctggacgaccggttcgcctccgcgctcaccgccctgaacgacatgggcaaggtgcgcaaggacatccagcagtgggagcccagccgggggtggaacgactggacccaggtgccgttctgctcccaccacttccacgagctgatcatgaaggacggccgcgtcctcgtggtgccctgccggaaccaggacgagctgatcgggcgcgcccggatcagccagggcgccgggtggtccctgcgcgagacggcctgcctcggcaagagctacgcgcagatgtggtccctgatgtacttccaccggcgcgacctgcggctcgccgccaacgccatctgcagcgccgtcccctcccactggatccccaccagccgcaccacctggtccatccacgcgacccacgagtggatgacgaccgaggacatgctgaccgtgtggaaccgggtgtggatccaggagaacccgtggatggaggacaagacccccgtcgagagctgggaggagatcccctacctgggcaagcgcgaggaccagtggtgcgggagcctcatcggcctgacgtcccgggccacctgggccaagaacatccagaccgccatcaaccaggtgcgcagcctgatcgggaacgaggagtacaccgactacatgccctccatgaagcggttccgccgcgaggaggaggaggcgggcgtgctctggtga

SEQ ID NO: 9095 - RNA, 9876 nt, synthetic construct
  misc_feature 1..9876: note = derived and/or modified CDS sequence (opt1) from DENV-2__KM279596__SS-prME
  source 1..9876: mol_type = other RNA
accgccgggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgagcagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggtccctgcgcccccagccgaccgagctgaagtacagctggaaggcgtggggcaaggccaagatgctctccaccgagctgcacaaccacacgttcctgatcgacggccccgagaccgccgagtgccccaacaccaaccgggcctggaacagcctcgaggtggaggactacgggttcggcgtcttcaccacgaacatctggctgaagctgaaggagcgccaggacgtgttctgcgactccaagctcatgagcgccgcgatcaaggacaaccgggccgtgcacgccgacatggggtactggatcgagtccgccctgaacgacacctggaagatcgagaaggccagcttcatcgaggtcaagtcctgccactggcccaagagccacaccctgtggtccaacggcgtgctcgagagcgagatgatcatccccaagaacttcgcgggccccgtgtcccagcacaactaccgccccgggtaccacacccagaccgccggcccgtggcacctggggcggctggagatggacttcgacttctgcgagggcacgaccgtcgccgtgaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtgaacagcctcgtcacggcgggccacgggcagatcgacaacttctccctgggcgtgctgggcatggccctcttcctggaggagatgctgcgcacccgggtggggaccaagcacgccatcctcctggtcgccgtgagcttcgtgaccctgatcacgggcaacatgtccttccgcgacctcgggcgcgtcatggtgatggtgggcgccaccatgaccgacgacatcgggatgggcgtcacctacctggcgctgctcgccgccttcaaggtgcggcccacgttcgccgccggcctgctgctccgcaagctgaccagcaaggagctgatgatgaccaccatcgggatcgtgctcctgtcccagagcacgatccccgagtccatcctggagctcaccgacgcgctggccctgggcatgatggtcctcaagatcgtgcggaacatggagaagtaccagctggccgtcaccatcatggccatcctgtgcgtgcccaacgccgtgatcctccagaacgcgtggaaggtcagctgcaccacgctggccgtggtgtccgtcagcccgctgctcctgacctccagccagcagaaggccgactggatccccctggccctcaccatcaaggggctgaaccccaccgcgatcttcctgacgaccctctcccgcaccagcaagaagcggtcctggcccctgaacgaggccatcatggccgtgggcatggtgagcatcctggcctccagcctcctgaagaacgacatcccgatgaccggccccctggtcgccgggggcctcctgacggtgtgctacgtgctgaccgggcgcagcgcggacctcgagctggagcgggccgccgacgtccgctgggaggagcaggccgagatctccggcagctcccccatcctgagcatcaccatctccgaggacgggagcatgtccatcaagaacgaggaggaggagcagaccctcacgatcctgatccggaccggcctgctcgtgatcagcggcctgttccccgtgtccatcccgatcaccgccgcggcctggtacctgtgggaggtcaagaagcagcgcgccggggtgctctgggacgtgccctccccgccgcccgtcggcaaggccgagctggaggacggggcctaccggatcaagcagaagggcatcctggggtactcccagatcggcgcgggcgtgtacaaggaggggaccttccacaccatgtggcacgtgacgcgcggcgccgtcctcatgcacaaggggaagcggatcgagcccagctgggccgacgtgaagaaggacctgatctcctacggcgggggctggaagctggagggcgagtggaaggagggggaggaggtgcaggtcctcgccctggagcccggcaagaacccgcgcgccgtgcagaccaagcccgggctgttcaagaccaacaccggcacgatcggggcggtgagcctcgacttctcccccggcaccagcggctcccccatcgtcgacaagaaggggaaggtggtgggcctgtacgggaacggcgtcgtgacccggagcggcacctacgtgtccgccatcgcccagacggagaagtccatcgaggacaacccggagatcgaggacgacatcttccgcaagaagcggctgaccatcatggacctgcaccccggggccggcaagaccaagcgctacctccccgcgatcgtccgggaggccatcaagcgcgggctgcggaccctgatcctcgcccccacgcgcgtggtggccgccgagatggaggaggcgctgcgcggcctgccgatccggtaccagacccccgccatccgcgccgagcacaccgggcgggagatcgtcgacctcatgtgccacgccaccttcacgatgcgcctgctgagccccatccgggtgcccaactacaacctcatcatcatggacgaggcccacttcaccgacccggcgtccatcgccgcccgcggctacatcagcacccgggtggagatgggcgaggccgccgggatcttcatgaccgcgacgccgcccggctcccgcgaccccttcccgcagagcaacgcccccatcatggacgaggagcgggagatccccgagcgctcctggaacagcgggcacgagtgggtcaccgacttcaagggcaagaccgtgtggttcgtgccctccatcaaggccgggaacgacatcgccgcgtgcctgcggaagaacggcaagaaggtcatccagctgagccgcaagaccttcgactccgagtacatcaagacgcggaccaacgactgggacttcgtggtgaccaccgacatcagcgagatgggcgccaacttcaaggccgagcgcgtcatcgacccgcggcgctgcatgaagcccgtgatcctcacggacggggaggagcgggtgatcctggccggccccatgcccgtcacccactccagcgccgcgcagcgccgggggcgcgtgggccgcaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgggagaaggtggacgccatcgacggcgagtaccgcctgcgcggggaggcccgcaagaccttcgtcgacctcatgcggcgcggcgacctgcccgtgtggctggcgtaccgggtcgccgccgaggggatcaactacgccgaccgccggtggtgcttcgacggcgtgaagaacaaccagatcctcgaggagaacgtggaggtcgagatctggacgaaggagggggagcgcaagaagctgaagccccggtggctggacgcccgcatctacagcgacccgctcgcgctgaaggagttcaaggagttcgccgccggccggaagtccctgaccctcaacctgatcaccgagatgggccgcctgcccaccttcatgacgcagaaggccaagaacgcgctcgacaacctggccgtgctgcacaccgccgaggccgggggccgggcctacaaccacgcgctcagcgagctgcccgagaccctggagaccctcctgctgctcacgctgctggccaccgtgaccgggggcatcttcctcttcctgatgtccggcaaggggatcggcaagatgaccctggggatgtgctgcatcatcaccgccagcatcctcctgtggtacgcccagatccagccccactggatcgccgcgtccatcatcctggagttcttcctcatcgtcctgctgatcccggagcccgagaagcagcgcacgccccaggacaaccagctcacctacgtggtgatcgccatcctgaccgtcgtggccgccaccatggccaacgagatgggcttcctggagaagacgaagaaggacttcgggctcggcagcatcgcgacccagcagcccgagagcaacatcctggacatcgacctgcggccggcctccgcctggaccctctacgccgtggccaccacgttcatcacccccatgctgcgccacagcatcgagaactccagcgtcaacgtgtccctgaccgcgatcgccaaccaggccaccgtgctcatgggcctggggaagggctggcccctgagcaagatggacatcggggtccccctcctggccatcggctgctactcccaggtgaacccgatcacgctgaccgcggccctcctgctgctcgtggcccactacgccatcatcgggcccggcctgcaggccaaggcgacccgggaggcccagaagcgcgccgccgccggcatcatgaagaaccccaccgtcgacgggatgacggtgatcgacctggaccccatcccgtacgaccccaagttcgagaagcagctcggccaggtgatgctgctggtcctctgcgtgacccaggtgctgatgatgcggaccacctgggcgctgtgcgaggccctcacgctggccaccgggcccatcagcaccctgtgggagggcaaccccgggcgcttctggaacaccacgatcgccgtctccatggccaacatcttccgcggcagctacctcgcgggcgccgggctgctgttctccatcatgaagaacaccgccaacacccggcgcggcaccgggaacacgggcgagaccctcggcgagaagtggaagaaccggctgaacgccctgggcaagagcgagttccagatctacaagaagtccggcatccaggaggtggaccgcaccctcgcgaaggaggggatcaagcggggcgagaccgaccaccacgccgtgagccgcgggtccgccaagctgcggtggttcgtcgagcgcaacctggtgacgccggagggcaaggtggtcgacctcggctgcgggcggggcgggtggagctactactgcggcgggctgaagaacgtgaaggaggtgaagggcctgaccaagggcgggcccggccacgaggagcccatccccatgtccacctacgggtggaacctcgtccgcctgcagagcggcgtggacgtgttcttcaccccgcccgagaagtgcgacacgctgctctgcgacatcggggagtccagccccaaccccaccgtcgaggccggccggaccctgcgcgtgctgaacctcgtggagaactggctgaacaacaacacccagttctgcatcaaggtcctgaacccgtacatgcccagcgtgatcgagaagatggaggccctgcagcggaagtacggcggggcgctcgtgcgcaaccccctgtcccggaacagcacccacgagatgtactgggtctccaacgccagcggcaacatcgtgtccagcgtgaacatgatctcccgcatgctgatcaaccggttcacgatgcgccacaagaaggccacctacgagccggacgtcgacctcgggagcggcacccggaacatcgggatcgagtccgagacccccaacctggacatcatcggcaagcgcatcgagaagatcaagcaggagcacgagacgagctggcactacgaccaggaccacccctacaagacctgggcctaccacggctcctacgagaccaagcagaccgggagcgcctccagcatggtgaacggcgtggtccgcctgctcacgaagccctgggacgtgatcccgatggtgacccagatggcgatgaccgacaccacgcccttcgggcagcagcgggtcttcaaggagaaggtggacacccgcacccaggagcccaaggagggcaccaagaagctgatgaagatcacggccgagtggctgtggaaggagctcggcaagaagaagacgccccggatgtgcacccgcgaggagttcacccggaaggtccgctccaacgccgccctgggggccatcttcacggacgagaacaagtggaagtccgcgcgggaggccgtggaggactccggcttctgggagctggtggacaaggagcgcaacctccacctggaggggaagtgcgagacctgcgtctacaacatgatgggcaagcgggagaagaagctgggggagttcggcaaggccaagggcagccgcgccatctggtacatgtggctcggggcgcggttcctggagttcgaggccctgggcttcctcaacgaggaccactggttctcccgcgagaacagcctgagcggggtggagggcgaggggctgcacaagctcggctacatcctgcgggacgtgtccaagaaggagggcggggccatgtacgccgacgacaccgccggctgggacacccgcatcacgctggaggacctcaagaacgaggagatggtcaccaaccacatggagggggagcacaagaagctggcggaggccatcttcaagctgacctaccagaacaaggtggtgcgggtccagcgcccgacgccccggggcaccgtgatggacatcatcagccgccgggaccagcgcgggtccggccaggtggtcacctacggcctcaacaccttcaccaacatggaggcccagctgatccggcagatggagggggagggcgtgttcaagagcatccagcagctgacggtgaaggaggagatcgccgtcaagaactggctcatccgcgtggggcgcgagcggctgtcccgcatggccatcagcggcgacgactgcgtggtcaagcccctggacgaccggttcgcgtccgccctcaccgccctgaacgacatgggcaaggtgcgcaaggacatccagcagtgggagcccagccgggggtggaacgactggacccaggtgccgttctgctcccaccacttccacgagctgatcatgaaggacggccgcgtcctcgtggtgccctgccggaaccaggacgagctgatcgggcgcgcccggatcagccagggcgccgggtggtccctgcgcgagaccgcgtgcctcggcaagagctacgcccagatgtggtccctgatgtacttccaccggcgcgacctgcggctcgccgccaacgccatctgcagcgcggtcccctcccactggatccccacgagccgcaccacctggtccatccacgccacccacgagtggatgaccacggaggacatgctgaccgtgtggaaccgggtgtggatccaggagaacccgtggatggaggacaagacccccgtcgagagctgggaggagatcccctacctgggcaagcgcgaggaccagtggtgcgggagcctcatcggcctgacctcccgggccacgtgggccaagaacatccagaccgcgatcaaccaggtgcgcagcctgatcgggaacgaggagtacaccgactacatgccctccatgaagcggttccgccgcgaggaggaggaggccggcgtgctctggtga

SEQ ID NO: 9096 - RNA, 9876 nt, synthetic construct
  misc_feature 1..9876: note = derived and/or modified CDS sequence (opt1) from DENV-2__FJ850072__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatggacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcgccatcatggcggccatcctggcctacaccatcgggaccacccacttccagcgggccctcatcttcatcctgctgaccgcggtggcccccagcatgaccatgcgctgcatcggcatcagcaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgccaccctccgcaagtactgcatcgaggcgaagctgaccaacacgaccaccgagtcccggtgcccgacccagggcgagcccagcctgaacgaggagcaggacaagcgcttcatctgcaagcactccatggtggaccggggctgggggaacggctgcggcctcttcggcaagggcgggatcgtgacgtgcgccatgttcacgtgcaagaagaacatggagggcaaggtcgtgctgcccgagaacctggagtacaccatcgtgatcacgccccacagcggggaggagcacgccgtcggcaacgacacggggaagcacggcgaggagatcaagatcaccccgcagtccagcatcaccgaggccgagctcaccgggtacggcaccgtgacgatggagtgcagcccccggaccggcctggacttcaacgagatggtgctgctccagatggaggagaaggcctggctggtccaccggcagtggttcctggacctccccctgccctggctgccgggggcggacacccagggcagcaactggatccagaaggagaccctcgtgacgttcaagaacccccacgccaagaagcaggacgtggtcgtgctggggtcccaggagggcgccatgcacaccgccctgaccggggccaccgagatccagatgagcagcggcaacctcctgttcacgggccacctgaagtgccgcctccggatggacaagctgcagctgaaggggatgtcctacagcatgtgcaccggcaagttcaagatcgtcaaggagatcgcggagacccagcacgggaccatcgtgatccgcgtgcagtacgagggcgacggctccccctgcaagatccccttcgagatcatggacctcgagaagcggcacgccctggggcgcctgatcacggtcaacccgatcgtgaccgagaaggacagccccgtgaacatcgaggccgagccgcccttcggcgactcctacatcatcatcggggtcgagccgggccagctcaagctgaactggttcaagaaggggagctccatcggccagatgttcgagaccaccatgcgcggcgccaagcggatggccatcctgggggacacggcgtgggacttcggcagcctcgggggcgtgttcacctccatcgggaaggccctgcaccaggtgttcggcgccatctacggcgccgcgttcagcggggtctcctggaccatgaagatcctgatcggcgtgatcatcacctggatcgggatgaacagccgctccacgagcctgtccgtgagcctcgtcctggtgggcgtggtcaccctgtacctcggggccatggtgcaggccgactccggctgcgtggtcagctggaagaacaaggagctgaagtgcggctccgggatcttcatcaccgacaacgtgcacacctggacggagcagtacaagttccagcccgagagccccagcaagctggcctccgccatccagaaggcgcacgaggagggcatctgcgggatccggagcgtgacccgcctcgagaacctgatgtggaagcagatcacccccgagctgaaccacatcctctccgagaacgaggtcaagctgaccatcatgacgggcgacatcaaggggatcatgcaggccggcaagcggagcctgcgcccgcagcccaccgagctcaagtactcctggaagacctggggcaaggccaagatgctgagcaccgagtcccacaaccagacgttcctgatcgacgggcccgagaccgccgagtgcccgaacaccaaccgggcctggaacagcctcgaggtggaggactacggcttcggggtgttcaccacgaacatctggctgaagctgcgcgagaagcaggacgtcttctgcgactccaagctcatgagcgcggccatcaaggacaaccgggccgtgcacgccgacatgggctactggatcgagtccgccctgaacgacacctggaagatggagaaggcgagcttcatcgaggtgaagtcctgccactggcccaagagccacaccctgtggtccaacggcgtcctcgagagcgagatgatcatccccaagaacttcgccgggcccgtgtcccagcacaactaccgcccgggctaccacacccagaccgccgggccctggcacctgggcaagctggagatggacttcgacttctgcgaggggacgaccgtggtcgtgaccgaggactgcggcaaccggggccccagcctccgcaccacgaccgccagcgggaagctgatcaccgagtggtgctgccggtcctgcaccctgcccccgctccgctaccggggcgaggacgggtgctggtacggcatggagatccgccccctgaaggagaaggaggagaacctggtgaacagcctcgtcacggcggggcacggccagatcgacaacttctccctgggcgtgctggggatggccctcttcctggaggagatgctgcggacccgcgtgggcaccaagcacgccatcctcctggtcgccgtgagcttcgtgaccctgatcacggggaacatgtccttccgggacctcggccgcgtcatggtgatggtgggggtcgccatgaccgacgacatcggcatgggcgtgacctacctggcgctgctcgccgccttcaaggtgcgccccaccttcgccgccgggctgctgctccggaagctgacgagcaaggagctgatgatggcgaccatcggcatcaccctcctgtcccagagcaccatccccgagacgatcctggagctcaccgacgccctggccctggggatgatggtcctcaagatcgtgcgcaacatggagaagtaccagctggccgtgaccatcatgaccatctcctgcgtcccgaacgccatgatcctgctcaacgcgtggaaggtgagctgcacgatcctggccgtggtctccgtgagccccctgctcctgacctccagccagcagaagaccgactggatccccctggccctcaccatcaagggcctgaaccccacggccatcttcctgaccaccctctcccggaccagcaagaagcgctcctggccgctgaacgaggcggtcatggccgtgggcatggtgagcatcctggcctccagcctcctgaagaacgacatccccatgacggggcccctggtcgccggcgggctcctgaccgtgtgctacgtgctgaccggccggagcgccgacctcgagctggagcgcgcgaccgacgtcaagtgggaggaccaggccgagatctccgggagctcccccatcctgagcatcacgatctccgaggacggcagcatgtccatcaagaacgaggaggaggagcagaccctcaccatcctgatccggaccggcctgctcgtgatcagcggggtgttcccggtctccatccccatcaccgccgccgcctggtacctgtgggaggtgaagaagcagcgcgcgggcgtgctgtgggacgtccccagcccgccgcccgtggagaaggccgagctcgaggacggggcctaccggatcaagcagcgcggcatcctggggtactcccagatcggcgccggcgtgtacaaggaggggacgttccacaccatgtggcacgtcacccggggcgccgtgctgatgcaccgcgggaagcggatcgagcccagctgggcggacgtgaagaaggacctcatctcctacggcgggggctggaagctggagggcgagtggaaggagggggaggaggtccaggtgctggccctcgagcccggcaagaacccccgcgccgtgcagaccaagcccgggctgttcaagacgaacaccggcaccatcggggccgtcagcctggacttctcccccggcaccagcggctcccccatcgtggaccggaaggggaaggtggtcggcctctacgggaacggcgtggtgacgcgcagcggcgcctacgtctccgcgatcgcccagaccgagaagtccatcgaggacaaccccgagatcgaggacgacatcttccggaagaagcgcctgaccatcatggacctgcaccccggggccggcaagaccaagcggtacctgcccgccatcgtgcgcgaggcgatcaagcgggggctccgcacgctgatcctggccccgacccgcgtggtcgccgccgagatggaggaggccctccggggcctgcccatccgctaccagacccccgcgatccgggccgagcacaccgggcgcgagatcgtggacctgatgtgccacgccacgttcaccatgcggctcctgagccccgtgcgcgtcccgaactacaacctgatcatcatggacgaggcccacttcaccgaccccgcctccatcgcggcccggggctacatcagcacccgcgtggagatgggcgaggccgccgggatcttcatgacggccacgccgcccggctcccgggacccgttcccccagagcaacgcgcccatcatggacgaggagcgcgagatccccgagcggtcctggaacagcgggcacgagtgggtgaccgacttcaagggcaagaccgtctggttcgtgccgtccatcaaggccgggaacgacatcgccgcctgcctccgcaagaacggcaagaaggtgatccagctgagccggaagacgttcgactccgagtacgtcaagacccgcgcgaacgactgggacttcgtggtgaccaccgacatcagcgagatgggcgccaacttccgggccgagcgcgtcatcgacccccggcgctgcatgaagcccgtgatcctgacggacggggaggagcgggtgatcctcgccggccccatgccggtcacccactccagcgccgcgcagcgccgcgggcgggtgggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgccatcgacggcgagtaccgcctgcgcggggaggcccgcaagaccttcgtcgacctgatgcggcgcggcgacctccccgtgtggctggcgtaccgggtggccgccgaggggatcaactacgccgaccgccggtggtgcttcgacggcatcaagaacaaccagatcctggaggagaacgtcgaggtggagatctggacgaaggagggggagcgcaagaagctcaagccgcggtggctggacgcccgcatctacagcgaccccctggcgctcaaggagttcaaggagttcgccgccggccggaagtccctgaccctgaacctcatcaccgagatgggccgcctgcccaccttcatgacgcagaaggcccggaacgcgctggacaacctcgccgtcctgcacaccgccgaggccgggggccgcgcctacaaccacgcgctgagcgagctccccgagaccctggagaccctgctcctgctgacgctcctggccaccgtgaccgggggcatcttcctgttcctcatgtccggcaaggggatcggcaagatgaccctggggatgtgctgcatcatcaccgccagcatcctgctctggtacgcccagatccagccgcactggatcgccgcgtccatcatcctggagttcttcctgatcgtgctcctgatccccgagcccgagaagcagcggacgccccaggacaaccagctgacctacgtcgtgatcgccatcctcaccgtggtcgccgccaccatggccaacgagatgggcttcctggagaagacgaagaaggacctggggctcggcagcatcaccacccaggagagcgagtccaacatcctggacatcgacctgcgcccggcgagcgcctggaccctctacgccgtggccacgaccttcatcacccccatgctgcggcactccatcgagaacagctccgtgaacgtcagcctgaccgccatcgcgaaccaggccacggtgctcatgggcctggggaagggctggcccctgtccaagatggacatcggggtgcccctcctggccatcggctgctacagccaggtcaacccgatcaccctgaccgccgcgctcctgtccctggtggcccactacgccatcatcgggcccggcctccaggccaaggccacccgcgaggcgcagaagcgcgccgccgccggcatcatgaagaaccccacggtggacgggatcaccgtcatcgacctggagcccatcccgtacgaccccaagttcgagaagcagctgggccaggtgatgctcctgatcctgtgcgtgacccaggtcctcatgatgcggaccacgtgggccctgtgcgaggcgctgaccctcgccaccgggcccatcagcaccctgtgggagggcaaccccgggcgcttctggaacacgaccatcgccgtgtccatggccaacatcttccggggcagctacctggccggcgcggggctcctgttctccatcatgaagaacaccaccaacacgcgccggggcaccgggaacatcggcgagaccctgggcgagaagtggaagtcccgcctcaacgccctggggaagtccgagttccagatctacaagcggagcggcatccaggaggtggaccgcaccctggccaaggaggggatcaagcggggcgagacggaccaccacgccgtctcccgcgggagcgcgaagctccggtggttcgtggagcgcaacatggtgaccccggagggcaaggtcgtggacctgggctgcgggcggggcgggtggtcctactactgcggcgggctgaagaacgtgcgcgaggtcaagggcctcaccaagggcgggcccggccacgaggagcccatccccatgagcacctacgggtggaacctggtgcggctgcagagcggcgtggacgtcttcttcacgccgcccgagaagtgcgacaccctcctgtgcgacatcggggagtccagccccaaccccaccatcgaggccggccgcaccctgcgggtgctcaacctggtggagaactggctgaacaacaacacccagttctgcatcaaggtcctcaacccgtacatgccctccgtgatcgagaagatggagacgctgcagcgcaagtacggcggggccctggtgcggaaccccctgagccgcaactccacccacgagatgtactgggtcagcaacgccaccggcaacatcgtgtccagcgtgaacatgatctcccgcatgctcatcaaccggttcaccatgaagcacaagaaggccacgtacgagccggacgtcgacctggggagcggcacccgcaacatcgggatcgagtccgagatccccaacctggacatcatcggcaagcggatcgagaagatcaagcaggagcacgagaccagctggcactacgaccaggaccacccctacaagacctgggcgtaccacggctcctacgagacgaagcagaccgggagcgcctccagcatggtgaacggcgtggtccgcctcctgaccaagccctgggacgtggtgccgatggtcacccagatggccatgacggacaccacccccttcgggcagcagcgggtgttcaaggagaaggtggacacccgcacgcaggagcccaaggagggcaccaagaagctgatgcggatcaccgccgagtggctctggaaggagctgggcaagaagaagacgccccgcatgtgcacgcgggaggagttcacccgcaaggtccggtccaacgccgcgctgggggccatcttcaccgacgagaacaagtggaagtccgcccgcgaggccgtggaggactcccggttctgggagctcgtggaccgcgagcggaacctgcacctggagggcaagtgcgagacctgcgtctacaacatgatggggaagcgcgagaagaagctcggcgagttcgggaaggccaagggcagccgggcgatctggtacatgtggctgggcgcccgcttcctggagttcgaggccctcgggttcctgaacgaggaccactggttcagccggggcaactccctgagcggggtggagggcgaggggctccaccgcctgggctacatcctgcgggacgtctccaagaaggagggcggggccatgtacgcggacgacacggccggctgggacacccgcatcaccctcgaggacctgaagaacgaggagatggtgaccaaccacatgaagggggagcacaagaagctggccgaggccgtgttcaagctcacgtaccagaacaaggtcgtgcgcgtgcagcggccgacgccccgcggcaccgtcatggacatcatcagccggcgcgaccagcgggggtccggccaggtgggcacctacgggctgaacacgttcaccaacatggaggcccagctgatccgccagatggagggcgaggggatcttcaagagcatccagcacctcaccgtgaccgaggagatcgcggtccagaactggctggcccgggtgggccgcgagcggctgtcccgcatggccatcagcggcgacgactgcgtggtcaagcccctcgacgaccggttcgcctccgccctgacggcgctgaacgacatggggaaggtgcgcaaggacatccagcagtgggagcccagccggggctggaacgactggacccaggtgccgttctgctcccaccacttccacgagctcgtcatgaaggacgggcgcatgctggtggtgccctgccggaaccaggacgagctgatcggccgcgcccggatcagccagggggccggctggtccctcaaggagaccgcctgcctgggcaagagctacgcccagatgtggaccctgatgtacttccaccgccgggacctccgcctggcggccaacgccatctgctccgccgtccccagccactgggtgcccacctcccgcacgacctggagcatccacgccaagcacgagtggatgaccaccgaggacatgctggcggtgtggaaccgggtctggatccaggagaacccgtggatggaggacaagacgcccgtggagagctgggaggaggtgccctacctcgggaagcgcgaggaccagtggtgcggctccctgatcgggctgaccagccgggccacctgggccaagaacatccagaccgccatcaaccaggtccgctccctcatcggcaacgaggagtacacggactacatgcccagcatgaagcggttccgccgggaggaggaggaggcgggggtgctgtggtga

SEQ ID NO: 9097 - RNA, 9876 nt, synthetic construct
  misc_feature 1..9876: note = derived and/or modified CDS sequence (opt1) from DENV-2__JN819419__SS-prME
  source 1..9876: mol_type = other RNA
accgccggcgtgatcgtcatgctgatccccaccgccatggccttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcgtggaggccaagctgacgaacaccaccaccgagtcccggtgcccgacgcagggcgagcccagcctgaacgaggagcaggacaagcgcttcatctgcaagcactccatggtcgaccggggctgggggaacggctgcgggctgttcggcaagggcgggatcgtgacctgcgcgatgttcacgtgcaagaagaacatggagggcaaggtggtccagcccgagaacctggagtacaccatcgtgatcacgccccacagcggggaggagcacgccgtgggcaacgacaccgggaagcacggcaaggagatcaagatcaccccgcagtccagcatcaccgaggccgagctgaccgggtacggcacggtcaccatggagtgcagcccccgcaccggcctcgacttcaacgagatggtgctgctgcagatggaggacaaggcctggctcgtgcaccggcagtggttcctggacctgcccctcccctggctgccgggggccgacacccagggcagcaactggatccagaaggagacgctggtcaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtcatccgcgtgcagtacgagggcgacggctccccctgcaagatccccttcgagatcatggacctggagaagcggcacgtgctcgggcgcctgatcaccgtcaacccgatcgtgaccgagaaggacagccccgtgaacatcgaggcggagccgcccttcggcgactcctacatcatcatcggggtcgagccgggccagctgaagctcaactggttcaagaaggggagctccatcggccagatgttcgagaccacgatgcgcggcgccaagcggatggccatcctgggggacaccgcctgggacttcggcagcctcggcggggtgttcacctccatcgggaaggccctccaccaggtgttcggggcgatctacggcgccgccttcagcggggtctcctggaccatgaagatcctgatcggcgtgatcatcacgtggatcgggatgaacagccgctccaccagcctgtccgtgagcctggtcctcgtgggcgtggtcaccctgtacctgggggccatggtgcaggcggactccggctgcgtggtcagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtgacccgcctggagaacctcatgtggaagcagatcacccccgagctgaaccacatcctgtccgagaacgaggtcaagctcacgatcatgaccggcgacatcaaggggatcatgcaggccggcaagcggagcctgcgcccgcagcccaccgagctgaagtactcctggaagacctggggcaaggcgaagatgctcagcacggagtcccacaaccagaccttcctgatcgacgggcccgagaccgccgagtgcccgaacaccaaccgggcctggaacagcctggaggtggaggactacggcttcggggtgttcacgaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacccagacggcggggccctggcacctcggcaagctggagatggacttcgacttctgcgaggggaccaccgtggtcgtgaccgaggactgcggcaaccggggccccagcctgcgcacgaccaccgccagcgggaagctcatcaccgagtggtgctgccggtcctgcacgctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcgtgggcaccaagcacgcgatcctgctcgtcgccgtgagcttcgtgacgctgatcaccgggaacatgtccttccgggacctgggccgcgtcatggtgatggtgggggccaccatgaccgacgacatcggcatgggcgtcacgtacctcgccctgctggccgcgttcaaggtgcgccccaccttcgccgccgggctcctgctgcggaagctcaccagcaaggagctgatgatggccaccatcggcgtggccctgctctcccagagcacgatccccgagaccatcctggagctgaccgacgcgctcgccctggggatgatggccctgaagatcgtcaagaacatggagaagtaccagctcgccgtgaccatcatggccatctcctgcgtgccgaacgcggtcatcctgcagaacgcctggaaggtgagctgcacgatcctggccgccgtctccgtgagccccctcctgctgacctccagccagcagaaggcggactggatccccctcgccctgaccatcaagggcctgaaccccaccgccatcttcctcacgaccctgtcccgcaccagcaagaagcggtcctggccgctgaacgaggccatcatggccgtgggcatggtcagcatcctcgcgtccagcctgctgaagaacgacatccccatgaccgggcccctcgtggccggcgggctgctgacggtgtgctacgtcctcaccggccgcagcgccgacctggagctggagcgggccgccgacgtgaagtgggaggaccaggcggagatctccgggagctcccccatcctcagcatcaccatctccgaggacggcagcatgtccatcaagaacgaggaggaggagcagaccctgacgatcctgatccgcaccggcctcctggtgatcagcggggtcttcccggtgtccatccccatcaccgccgccgcctggtacctgtgggaggtgaagaagcagcgggccggcgtcctctgggacgtgcccagcccgccgcccgtggggaaggcggagctggaggacggcgcctaccgcatcaagcagcgggggatcctgggctactcccagatcggcgccggggtctacaaggagggcaccttccacaccatgtggcacgtgacgcgcggggccgtgctcatgcaccggggcaagcgcatcgagcccagctgggccgacgtcaagaaggacctggtgtcctacgggggcggctggaagctggagggggagtggaaggagggcgaggaggtgcaggtcctcgcgctggagcccgggaagaacccccgggccgtgcagaccaagcccggcatcttcaagaccaacaccgggaacatcggcgccgtgagcctggacttctcccccggcacgagcgggtcccccatcgtcgaccgcaagggcaaggtggtggggctctacggcaacggcgtcgtgacccggagcggggcctacgtgtccgcgatcgcccagaccgagaagtccatcgaggacaaccccgagatcgaggacgacatcttccgcaagaagcggctgaccatcatggacctgcaccccggcgccgggaagacgaagcgctacctccccgccatcgtccgggaggccatcaagcgcggcctgcggaccctgatcctggcgccgacccgcgtggtggccgccgagatggaggaggccctccgcgggctgcccatccggtaccagacccccgccatccgcgcggagcacacgggccgggagatcgtcgacctgatgtgccacgccaccttcaccatgcgcctcctgagccccgtgcgggtgccgaactacaacctgatcatcatggacgaggcccacttcaccgaccccgcctccatcgccgcgcgcggctacatcagcacgcgggtcgagatgggggaggccgccggcatcttcatgaccgccacgccgcccgggtcccgcgacccgttcccccagagcaacgcgcccatcatggacgaggagcgggagatccccgagcgctcctggaacagcggccacgagtgggtgaccgacttcaaggggaagacggtgtggttcgtcccgtccatcaaggccggcaacgacatcgccgcctgcctccggaagaacggcaagaaggtgatccagctgagccgcaagaccttcgactccgagtacgtgaagacccgggccaacgactgggacttcgtcgtgaccacggacatcagcgagatgggggcgaacttcaaggccgagcgcgtgatcgacccccggcgctgcatgaagcccgtcatcctgaccgacggcgaggagcgggtgatcctcgccgggcccatgccggtgacccactccagcgccgcccagcgccggggccgcatcgggcgcaaccccaagaacgagaacgaccagtacatctacatgggcgagcccctggagaacgacgaggactgcgcgcactggaaggaggccaagatgctgctcgacaacatcaacacccccgagggcatcatcccgtccatgttcgagcccgagcgggagaaggtcgacgccatcgacggggagtaccgcctgcggggcgaggcccgcaagacgttcgtggacctgatgcggcgcggggacctccccgtgtggctggcctacaaggtcgcggccgagggcatcaactacgccgaccggcgctggtgcttcgacgggatcaagaacaaccagatcctggaggagaacgtggaggtcgagatctggaccaaggagggcgagcggaagaagctcaagccgcgctggctggacgcccggatctacagcgaccccctggcgctcaaggagttcaaggagttcgccgccggccgcaagtccctgaccctgaacctcatcaccgagatggggcggctgcccacgttcatgacccagaaggcccgcaacgccctggacaacctcgcggtgctgcacaccgccgaggccggcgggaaggcctacaaccacgccctgagcgagctccccgagaccctggagacgctgctcctgctgaccctcctggcgaccgtgaccggcggcatcttcctgttcctcatgtccgggaagggcatcgggaagatgacgctgggcatgtgctgcatcatcaccgccagcatcctgctctggtacgcccagatccagccgcactggatcgccgcctccatcatcctggagttcttcctgatcgtcctcctgatccccgagcccgagaagcagcggacgccccaggacaaccagctgacctacgtggtgatcgcgatcctcaccgtcgtggccgccacgatggccaacgagatggggttcctggagaagaccaagaaggacctgggcctcggcagcatcaccacccaggagagcgagtccaacatcctggacatcgacctgcgcccggccagcgcgtggacgctctacgccgtggccaccaccttcgtcacccccatgctgcggcactccatcgagaacagctccgtgaacgtgagcctgacggccatcgcgaaccaggccaccgtcctcatggggctgggcaaggggtggcccctgtccaagatggacatcggcgcgcccctcctggccatcgggtgctacagccaggtgaacccgatcaccctgaccgccgcgctcctgctgctcgtggcccactacgccatcatcggccccggcctgcaggccaaggccacgcgcgaggcgcagaagcgggccgccgccgggatcatgaagaaccccaccgtcgacggcatcaccgtgatcgacctggagcccatcccgtacgaccccaagttcgagaagcagctcggccaggtgatgctgctgatcctctgcgtcacccaggtgctgatgatgcgcacgacctgggccctgtgcgaggcgctcaccctggccaccggccccatctccacgctgtgggaggggaaccccggccggttctggaacaccaccatcgccgtgagcatggccaacatcttccgcggctcctacctcgcgggggccggcctgctgttcagcatcatgaagaacaccacgaacacccgccgggggaccggcaacatcggcgagaccctcggggagaagtggaagtcccgcctgaacgccctgggcaagagcgagttccagatctacaagaagtccgggatccaggaggtcgaccggacgctcgccaaggagggcatcaagcgcggggagaccgaccaccacgccgtgagccggggctccgcgaagctgcgctggttcgtggagcggaacatggtcaccccggagggcaaggtggtggacctggggtgcggccgcgggggctggagctactactgcgggggcctcaagaacgtccgggaggtgaagggcctgaccaagggcgggcccgggcacgaggagcccatccccatgtccacgtacggctggaacctggtgcgcctccagagcggggtcgacgtgttcttcaccccgcccgagaagtgcgacaccctgctgtgcgacatcggcgagagctcccccaaccccaccatcgaggccggccggacgctccgcgtgctgaacctggtcgagaactggctcaacaacaacacccagttctgcatcaaggtgctgaacccgtacatgcccagcgtgatcgagaagatggagaccctgcagcggaagtacgggggcgccctcgtccgcaaccccctgtcccggaacagcacccacgagatgtactgggtgtccaacgccaccgggaacatcgtgagctccgtcaacatgatcagccgcatgctgatcaaccggttcacgatgaagcacaagaaggccacctacgagccggacgtggacctgggctccgggacccgcaacatcggcatcgagagcgagatccccaacctcgacatcatcggcaagcggatcgagaagatcaagcaggagcacgagacctcctggcactacgaccaggaccacccctacaagacgtgggcgtaccacgggagctacgagaccaagcagaccggctccgccagctccatggtgaacggggtcgtgcgcctgctgaccaagccctgggacgtggtcccgatggtgacgcagatggccatgaccgacaccacccccttcggccagcagcgcgtgttcaaggagaaggtcgacacgcggacccaggagcccaaggagggcaccaagaagctcatgaagatcaccgccgagtggctgtggaaggagctggggaagaagaagatcccccgcatgtgcacgcgggaggagttcacccgcaaggtgcggagcaacgccgcgctcggcgccatcttcaccgacgagaacaagtggaagtccgcccgcgaggccgtggaggacgggcggttctgggagctggtcgaccgcgagcggaacctgcacctcgagggcaagtgcgagacctgcgtgtacaacatgatggggaagcgcgagaagaagctgggcgagttcggcaaggcgaaggggagccgggccatctggtacatgtggctgggcgcccgcttcctcgagttcgaggccctggggttcctgaacgaggaccactggttctcccggggcaacagcctcagcggggtcgagggcgagggcctgcaccgcctggggtacatcctccgggacgtgtccaagaaggagggcggggccatgtacgcggacgacacggccggctgggacacccgcatcaccctggaggacctgaagaacgaggagatggtgaccaaccacatgaagggggagcacaagaagctcgccgaggccatcttcaagctgacgtaccagaacaaggtcgtgcgggtgcagcgcccgacgccccggggcaccgtcatggacatcatcagccgccgggaccagcgcggctccggccaggtgggcacctacgggctgaacacgttcaccaacatggaggcccagctcatccgccagatggagggcgagggcatcttcaagagcatccagcacctgaccgtgaccgaggagatcgcggtccagaactggctggcccgggtggggcgcgagcggctcacgcgcatggccatctccggcgacgactgcgtggtcaagcccatcgacgaccggttcgccaacgccctgaccgcgctgaacgacatggggaaggtgcgcaaggacatccagcagtgggagcccagccggggctggaacgactggacccaggtgccgttctgctcccaccacttccacgagctcgtcatgaaggacgggcgcgtgctggtggtcccctgccggaaccaggacgagctgatcggccgcgcccggatcagccagggcgccgggtggtccctcaaggagaccgcctgcctgggcaagagctacgcccagatgtggacgctgatgtacttccaccgccgggacctccgcctggcggccaacgccatctgctccgccgtgcccagccactgggtgcccacctcccggaccacctggagcatccacgcgaagcacgagtggatgaccacggaggacatgctggccgtctggaaccgcgtgtggatccaggagaacccgtggatggaggacaagacccccgtggagtcctgggaggaggtcccctacctcgggaagcgggaggaccagtggtgcggcagcctgatcgggctgacctcccgcgccacctgggccaagaacatccagacggccatcaaccaggtgcggagcctcatcggcaacgaggagtacaccgactacatgcccagcatgaagcgcttccgccgggaggaggaggaggcgggcgtgctgtggtga

SEQ ID NO: 9098 - RNA, 9876 nt, synthetic construct
  misc_feature 1..9876: note = derived and/or modified CDS sequence (opt1) from DENV-2__FJ850074__SS-prME
  source 1..9876: mol_type = other RNA
accgccggcgtgatcgtcatgctgatccccaccgtgatggccttccacctcaccacccgcaacggggagccccacatgatcgtgggccggcaggagaaggggaagtccctgctgttcaagaccgaggacggcgtcaacatgtgcaccctcatggcgatcgacctgggggagctgtgcgaggacaccatcacctacaagtgccccctcctgcgccagaacgagcccgaggacatcgactgctggtgcaactccacctccacctgggtgacctacgggacctgcaccaccacgggcgagcaccggcgcgagaagcggtccgtggccctggtcccccacgtggggatgggcctcgagacccgcaccgagacctggatgagctccgagggggcctggaagcacgtgcagcggatcgagacgtggatcctgcgccaccccggcttcaccatgatggccgccatcctggcgtacaccatcgggaccacgcacttccagcgggccctcatcttcatcctgctgaccgccgtcgcccccagcatgaccatgcgctgcatcggcatctccaaccgggacttcgtggagggcgtgagcgggggctcctgggtcgacatcgtgctcgagcacgggagctgcgtgaccacgatggcgaagaacaagcccaccctggacttcgagctgatcaagaccgaggccaagcagcccgccaccctccgcaagtactgcgtcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgccatgttcacgtgcaagaagaacatggagggcaaggtcgtgcagcccgagaacctggagtacaccatcgtgatcacgccccacagcggggaggagcacgcggtcggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgccaagaagcaggacgtcgtggtgctcgggtcccaggagggcgcgatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctggagaagcggcacgtcctcgggcgcctgatcaccgtgaacccgatcgtgaccgagaaggacagccccgtcaacatcgaggccgagccgcccttcggcgactcctacatcatcatcggggtggagccgggccagctgaagctcaactggttcaagaaggggagctccatcggccagatgttcgagaccacgatgcgcggcgcgaagcggatggccatcctgggggacaccgcctgggacttcggcagcctcggcggggtgttcacctccatcgggaaggccctccaccaggtcttcggggccatctacggcgcggccttcagcggggtgtcctggaccatgaagatcctgatcggcgtgatcatcacgtggatcgggatgaacagccgctccaccagcctgtccgtcagcctggtgctcgtgggcgtcgtgaccctgtacctgggggccatggtgcaggccgactccggctgcgtcgtgagctggaagaacaaggagctcaagtgcggctccgggatcttcatcaccgacaacgtgcacacgtggaccgagcagtacaagttccagcccgagagccccagcaagctggcgtccgccatccagaaggcccacgaggagggcatctgcgggatccggagcgtcacccgcctggagaacctcatgtggaagcagatcacccccgagctgaaccacatcctgtccgagaacgaggtgaagctcacgatcatgaccggcgacatcaaggggatcatgcaggccggcaagcggagcctgcgcccgcagcccaccgagctgaagtactcctggaagacctggggcaaggccaagatgctccccacggagagccacaaccagaccttcctgatcgacgggccggagaccgcggagtgccccaacaccaaccgggcctggaactccctggaggtggaggactacggcttcggggtcttcacgaccaacatctggctcaagctgcgcgagaagcaggacgtgttctgcgacagcaagctgatgtccgccgccatcaaggacaaccgggccgtgcacgcggacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagaacttcgccgggccggtgagccagcacaactaccgccccggctaccacacccagacggccgggccctggcacctcggcaagctggagatggacttcgacttctgcgaggggaccaccgtcgtggtgaccgaggactgcggcaaccggggcccctccctgcgcacgaccaccgcgagcgggaagctcatcaccgagtggtgctgccggagctgcacgctgccgcccctgcgctaccggggcgaggacgggtgctggtacggcatggagatccgccccctcaaggagaaggaggagaacctggtcaactccctggtgaccgccgggcacggccagatcgacaacttcagcctcggcgtgctggggatggccctgttcctcgaggagatgctgcggacccgcgtcggcaccaagcacgccatcctgctcgtggcggtgtccttcgtcacgctgatcaccgggaacatgagcttccgggacctgggccgcgtgatggtgatggtcggggccaccatgaccgacgacatcggcatgggcgtgacgtacctcgccctgctggccgccttcaaggtgcgccccaccttcgcggccgggctcctgctgcggaagctcacctccaaggagctgatgatggccaccatcggcgtcgccctgctcagccagtccacgatcccggagaccatcctggagctgaccgacgccctcgcgctggggatgatggccctgaagatcgtgaagaacatggagaagtaccagctcgccgtgaccatcatggccatcagctgcgtccccaacgccgtgatcctgcagaacgcgtggaaggtctcctgcacgatcctggccgccgtgagcgtgagccccctcctgctgaccagctcccagcagaaggccgactggatccccctcgcgctgaccatcaagggcctgaacccgaccgccatcttcctcacgaccctgagccgcacctccaagaagcggagctggcccctgaacgaggccatcatggccgtcggcatggtgtccatcctcgccagctccctgctgaagaacgacatccccatgaccgggcccctcgtggcgggcgggctgctgacggtctgctacgtgctcaccggccgcagcgccgacctggagctggagcgggccgccgacgtgaagtgggaggaccaggccgagatcagcgggtccagcccgatcctctccatcaccatcagcgaggacggctccatgagcatcaagaacgaggaggaggagcagaccctgacgatcctgatccgcaccggcctcctggtcatctccggggtgttccccgtgagcatccccatcaccgcggccgcctggtacctgtgggaggtcaagaagcagcgggccggcgtgctctgggacgtgccctccccgccgcccgtcgggaaggccgagctggaggacggcgcgtaccgcatcaagcagcgggggatcctgggctacagccagatcggcgccggggtgtacaaggagggcaccttccacaccatgtggcacgtgacgcgcggggccgtcctcatgcaccggggcaagcgcatcgagccgtcctgggccgacgtgaagaaggacctggtgagctacgggggcggctggaagctggagggggagtggaaggagggcgaggaggtccaggtgctcgccctggagcccgggaagaacccccgggcggtgcagaccaagcccggcatcttcaagaccaacaccgggacgatcggcgccgtctccctggacttcagcccgggcacctccgggagccccatcgtggaccgcaagggcaaggtggtcgggctctacggcaacggcgtggtgacccggtccggggcctacgtcagcgccatcgcgcagaccgagaagtccatcgaggacaaccccgagatcgaggacgacatcttccgcaagaagcggctgacgatcatggacctgcaccccggcgccgggaagaccaagcgctacctcccggccatcgtgcgggaggccatcaagcgcggcctgcggaccctgatcctggcccccacccgcgtggtcgcggccgagatggaggaggccctccgcgggctgcccatccggtaccagacgcccgccatccgcgccgagcacaccggccgggagatcgtggacctgatgtgccacgcgaccttcaccatgcgcctcctgagcccggtgcgggtccccaactacaacctgatcatcatggacgaggcccacttcacggaccccgccagcatcgccgcccgcggctacatctccacccgggtggagatgggggaggcggccggcatcttcatgaccgccacgccgcccgggagccgcgaccccttcccccagtccaacgcccccatcatggacgaggagcgggagatccccgagcgcagctggaactccggccacgagtgggtgacggacttcaaggggaagaccgtctggttcgtgcccagcatcaaggcgggcaacgacatcgccgcctgcctccggaagaacggcaagaaggtgatccagctgtcccgcaagaccttcgacagcgagtacgtcaagacccggtccaacgactgggacttcgtggtgacgaccgacatcagcgagatgggggccaacttcaaggccgagcgcgtcatcgacccccggcgctgcatgaagcccgtgatcctgaccgacggcgaggagcgggtgatcctcgcggggccgatgcccgtcacccactccagcgccgcccagcgccggggccgcatcgggcgcaaccccaagaacgagaacgaccagtacatctacatgggcgagcccctggagaacgacgaggactgcgcccactggaaggaggccaagatgctgctcgacaacatcaacacgccggagggcatcatcccctccatgttcgagcccgagcgggagaaggtggacgcgatcgacggggagtaccgcctgcggggcgaggcccgcaagaccttcgtggacctgatgcggcgcggggacctcccggtctggctggcctacaaggtggccgccgagggcatcaactacgcggaccggcgctggtgcttcgacgggatcaagaacaaccagatcctggaggagaacgtcgaggtggagatctggaccaaggagggcgagcggaagaagctcaagccccgctggctggacgcccggatctacagcgaccccctggccctcaaggagttcaaggagttcgccgcgggccgcaagtccctgaccctgaacctcatcacggagatggggcggctgcccaccttcatgacccagaaggcccgcaacgccctggacaacctcgccgtgctgcacaccgccgaggcgggcgggaaggcctacaaccacgccctgagcgagctcccggagacgctggagaccctgctcctgctgaccctcctggccaccgtcacgggcggcatcttcctgttcctcatgtccgggaagggcatcgggaagatgaccctgggcatgtgctgcatcatcaccgccagcatcctgctctggtacgcgcagatccagccccactggatcgccgcctccatcatcctggagttcttcctgatcgtgctcctgatccccgagcccgagaagcagcggaccccgcaggacaaccagctgacctacgtggtcatcgccatcctcacggtggtggccgcgaccatggccaacgagatggggttcctggagaagaccaagaaggacctgggcctcggcagcatcaccacgcaggagagcgagtccaacatcctggacatcgacctgcgccccgccagcgcctggaccctctacgccgtcgcgaccaccttcgtgacgcccatgctgcggcactccatcgagaacagctccgtgaacgtcagcctgaccgccatcgccaaccaggccaccgtgctcatggggctgggcaaggggtggcccctgtccaagatggacatcggcgtgccgctcctggcgatcgggtgctacagccaggtcaaccccatcaccctgacggccgccctcctgctgctcgtggcccactacgccatcatcggccccggcctgcaggcgaaggccacccgcgaggcccagaagcgggccgccgcggggatcatgaagaaccccaccgtggacggcatcaccgtcatcgacctggagccgatcccctacgaccccaagttcgagaagcagctcggccaggtgatgctgctgatcctctgcgtgacgcaggtcctgatgatgcgcaccacctgggccctgtgcgaggccctcaccctggccacgggccccatctccaccctgtgggaggggaacccgggccggttctggaacaccaccatcgccgtgagcatggcgaacatcttccgcggctcctacctcgccggggccggcctgctgttcagcatcatgaagaacacgaccaacacccgccgggggaccggcaacatcggcgagacgctcggggagaagtggaagtcccgcctgaacgccctgggcaagagcgagttccagatctacaagaagtccgggatccaggaggtggaccggaccctcgcgaaggagggcatcaagcgcggggagaccgaccaccacgccgtcagccggggctccgccaagctgcgctggttcgtggagcggaacatggtgacccccgagggcaaggtcgtggacctggggtgcggccgcgggggctggagctactactgcgggggcctcaagaacgtgcgggaggtcaagggcctgacgaagggcggccccgggcacgaggagcccatcccgatgtccacctacggctggaacctggtgcgcctccagagcggggtggacgtcttcttcacgccgcccgagaagtgcgacaccctgctgtgcgacatcggcgagagctcccccaacccgacgatcgaggccggccggaccctccgcgtgctgaacctggtggagaactggctcaacaacaacacccagttctgcatcaaggtcctgaacccctacatgcccagcgtgatcgagaagatggagaccctgcagcggaagtacgggggcgccctcgtgcgcaacccgctgtcccggaacagcacccacgagatgtactgggtctccaacgcgacggggaacatcgtgagctccgtgaacatgatcagccgcatgctgatcaaccggttcaccatgaagcacaagaaggccacctacgagcccgacgtcgacctgggctccgggacccgcaacatcggcatcgagagcgagatccccaacctcgacatcatcggcaagcggatcgagaagatcaagcaggagcacgagacgtcctggcactacgaccaggaccacccctacaagacctgggcctaccacgggagctacgagaccaagcagaccggctccgccagctccatggtgaacggggtggtccgcctgctgacgaagccgtgggacgtggtgcccatggtcacccagatggccatgaccgacaccacgcccttcggccagcagcgcgtgttcaaggagaaggtggacacccggacccaggagcccaaggagggcaccaagaagctcatgaagatcacggcggagtggctgtggaaggagctggggaagaagaagaccccgcgcatgtgcacccgggaggagttcacccgcaaggtccggagcaacgccgccctcggcgccatcttcacggacgagaacaagtggaagtccgcccgcgaggcggtggaggacgggcggttctgggagctggtcgaccgcgagcggaacctgcacctcgagggcaagtgcgagacctgcgtgtacaacatgatggggaagcgcgagaagaagctgggcgagttcggcaaggccaaggggagccgggccatctggtacatgtggctgggcgcccgcttcctcgagttcgaggcgctggggttcctgaacgaggaccactggttctcccggggcaacagcctcagcggggtggagggcgagggcctgcaccgcctggggtacatcctccgggacgtctccaagaaggagggcggggccatgtacgccgacgacaccgccggctgggacacccgcatcacgctggaggacctgaagaacgaggagatggtgaccaaccacatgaagggggagcacaagaagctcgccgaggcgatcttcaagctgacctaccagaacaaggtggtccgggtgcagcgccccacgccccggggcacggtgatggacatcatcagccgccgggaccagcgcggctccgggcaggtcggcacctacgggctgaacaccttcaccaacatggaggcccagctcatccgccagatggagggcgagggcatcttcaagagcatccagcacctgacggtgaccgaggagatcgccgtgcagaactggctggcccgggtcgggcgcgagcggctcacccgcatggccatctccggcgacgactgcgtggtgaagcccatcgacgaccggttcgcgaacgccctgaccgccctgaacgacatggggaaggtccgcaaggacatccagcagtgggagccgagccggggctggaacgactggacccaggtgcccttctgctcccaccacttccacgagctcgtgatgaaggacgggcgcgtcctggtggtgccctgccggaaccaggacgagctgatcggccgcgcccggatcagccagggcgccgggtggtccctcaaggagaccgcgtgcctgggcaagagctacgcccagatgtggaccctgatgtacttccaccgccgggacctccgcctggccgccaacgccatctgctccgcggtccccagccactgggtgccgacctcccggaccacgtggagcatccacgccaagcacgagtggatgaccaccgaggacatgctggccgtgtggaaccgcgtctggatccaggagaacccctggatggaggacaagacccccgtggagtcctgggaggaggtgccctacctcgggaagcgggaggaccagtggtgcggcagcctgatcgggctgacgtcccgcgccacctgggcgaagaacatccagaccgccatcaaccaggtccggagcctcatcggcaacgaggagtacaccgactacatgccgagcatgaagcgcttccgccgggaggaggaggaggccggcgtgctgtggtga

SEQ ID NO: 9099 - RNA, 9876 nt, synthetic construct
  misc_feature 1..9876: note = derived and/or modified CDS sequence (opt1) from DENV-2__FJ850076__SS-prME
  source 1..9876: mol_type = other RNA
accgccggcgccatcgtgatgctgatccccaccgtcatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaactccacctccacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccaccccggcttcaccatgatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcgtggaggccaagctgacgaacaccaccaccgagtcccggtgcccgacgcagggcgagcccagcctgaacgaggagcaggacaagcgcttcatctgcaagcactccatggtcgaccggggctgggggaacggctgcgggctgttcggcaagggcgggatcgtgacctgcgcgatgttcacgtgcaagaagaacatggagggcaaggtggtccagcccgagaacctggagtacaccatcgtgatcacgccccacagcggggaggagcacgccgtgggcaacgacaccgggaagcacggcaaggagatcaagatcaccccgcagtccagcatcaccgaggccgagctgaccgggtacggcacggtcaccatggagtgcagcccccgcaccggcctcgacttcaacgagatggtgctgctgcagatggaggacaaggcctggctcgtgcaccggcagtggttcctggacctgcccctcccctggctgccgggggccgacacccagggcagcaactggatccagaaggagacgctggtcaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtcatccgcgtgcagtacgagggcgacggctccccctgcaagatccccttcgagatcatggacctggagaagcggcacgtgctcgggcgcctgatcaccgtcaacccgatcgtgaccgagaaggacagccccgtgaacatcgaggcggagccgcccttcggcgactcctacatcatcatcggggtcgagccgggccagctgaagctcaactggttcaagaaggggagctccatcggccagatgttcgagaccacgatgcgcggcgccaagcggatggccatcctgggggacaccgcctgggacttcggcagcctcggcggggtgttcacctccatcgggaaggccctccaccaggtgttcggggcgatctacggcgccgccttcagcggggtctcctggaccatgaagatcctgatcggcgtgatcatcacgtggatcgggatgaacagccgctccaccagcctgtccgtgagcctggtcctcgtgggcgtggtcaccctgtacctgggggccatggtgcaggcggactccggctgcgtggtcagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtgacccgcctggagaacctcatgtggaagcagatcacccccgagctgaaccacatcctgtccgagaacgaggtcaagctcacgatcatgaccggcgacatcaaggggatcatgcaggccggcaagcggagcctgcgcccgcagcccaccgagctgaagtactcctggaagacctggggcaaggcgaagatgctccccacggagagccacaaccagaccttcctgatcgacgggccggagaccgccgagtgccccaacaccaaccgggcctggaactccctggaggtggaggactacggcttcggggtgttcacgaccaacatctggctcaagctgcgcgagaagcaggacgtcttctgcgacagcaagctgatgtccgccgccatcaaggacaaccgggcggtgcacgccgacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagaacttcgccgggccggtgagccagcacaactaccgccccggctaccacacccagacggcggggccctggcacctcggcaagctggagatggacttcgacttctgcgaggggaccaccgtggtcgtgaccgaggactgcggcaaccggggcccctccctgcgcacgaccaccgccagcgggaagctcatcaccgagtggtgctgccggagctgcacgctgccgcccctgcgctaccggggcgaggacgggtgctggtacggcatggagatccgccccctcaaggagaaggaggagaacctggtgaactccctggtcaccgccgggcacggccagatcgacaacttcagcctcggcgtgctggggatggccctgttcctcgaggagatgctgcggacccgcgtgggcaccaagcacgcgatcctgctcgtcgccgtgtccttcgtgacgctgatcaccgggaacatgagcttccgggacctgggccgcgtcatggtgatggtgggggccaccatgaccgacgacatcggcatgggcgtcacgtacctcgccctgctggccgcgttcaaggtgcgccccaccttcgccgccgggctcctgctgcggaagctcacctccaaggagctgatgatggccaccatcggcgtggccctgctcagccagtccacgatcccggagaccatcctggagctgaccgacgcgctcgccctggggatgatggccctgaagatcgtcaagaacatggagaagtaccagctcgccgtgaccatcatggccatcagctgcgtgcccaacgcggtcatcctgcagaacgcctggaaggtgtcctgcacgatcctggccgccgtcagcgtgagccccctcctgctgaccagctcccagcagaaggcggactggatccccctcgccctgaccatcaagggcctgaacccgaccgccatcttcctcacgaccctgagccgcacctccaagaagcggagctggcccctgaacgaggccatcatggccgtgggcatggtctccatcctcgcgagctccctgctgaagaacgacgtgcccatgaccgggcccctcgtggccggcgggctgctgacggtctgctacgtgctcaccggccgcagcgccgacctggagctggagcgggccgccgacgtgaagtgggaggaccaggcggagatcagcgggtccagcccgatcctctccatcaccatcagcgaggacggctccatgagcatcaagaacgaggaggaggagcagaccctgacgatcctgatccgcaccggcctcctggtcatctccggggtgttccccgtgagcatccccatcaccgccgccgcctggtacctgtgggaggtcaagaagcagcgggccggcgtgctctgggacgtgccctccccgccgcccgtcgggaaggcggagctggaggacggcgcctaccgcatcaagcagcgggggatcctgggctacagccagatcggcgccggggtgtacaaggagggcaccttccacaccatgtggcacgtgacgcgcggggccgtcctcatgcaccggggcaagcgcatcgagccgtcctgggccgacgtgaagaaggacctggtgagctacgggggcggctggaagctggagggggagtggaaggagggcgaggaggtccaggtgctcgcgctggagcccgggaagaacccccgggccgtgcagaccaagcccggcatcttcaagaccaacaccgggacgatcggcgccgtctccctggacttcagcccgggcacctccgggagccccatcgtggaccgcaagggcaaggtggtcgggctctacggcaacggcgtggtgacccggtccggggcctacgtcagcgcgatcgcccagaccgagaagtccatcgaggacaaccccgagatcgaggacgacatcttccgcaagaagcggctgacgatcatggacctgcaccccggcgccgggaagaccaagcgctacctcccggccatcgtgcgggaggccatcaagcgcggcctgcggaccctgatcctggcgcccacccgcgtggtcgccgccgagatggaggaggccctccgcgggctgcccatccggtaccagacgcccgccatccgcgcggagcacaccggccgggagatcgtggacctgatgtgccacgccaccttcaccatgcgcctcctgagcccggtgcgggtccccaactacaacctgatcatcatggacgaggcccacttcacggaccccgccagcatcgccgcgcgcggctacatctccacccgggtggagatgggggaggccgccggcatcttcatgaccgccacgccgcccgggagccgcgaccccttcccccagtccaacgcgcccatcatggacgaggagcgggagatccccgagcgcagctggaactccggccacgagtgggtgacggacttcaaggggaagaccgtctggttcgtgcccagcatcaaggccggcaacgacatcgccgcctgcctccggaagaacggcaagaaggtgatccagctgtcccgcaagaccttcgacagcgagtacgtcaagacccggtccaacgactgggacttcgtggtgacgaccgacatcagcgagatgggggccaacttcaaggcggagcgcgtcatcgacccccggcgctgcatgaagcccgtgatcctgaccgacggcgaggagcgggtgatcctcgccgggccgatgcccgtcacccactccagcgccgcccagcgccggggccgcatcgggcgcaaccccaagaacgagaacgaccagtacatctacatgggcgagcccctggagaacgacgaggactgcgcccactggaaggaggcgaagatgctgctcgacaacatcaacacgccggagggcatcatcccctccatgttcgagcccgagcgggagaaggtggacgccatcgacggggagtaccgcctgcggggcgaggcccgcaagaccttcgtggacctgatgcggcgcggggacctcccggtctggctggcctacaaggtggccgcggagggcatcaactacgccgaccggcgctggtgcttcgacgggatcaagaacaaccagatcctggaggagaacgtcgaggtggagatctggaccaaggagggcgagcggaagaagctcaagccccgctggctggacgcccggatctacagcgaccccctggccctcaaggagttcaaggagttcgcggccggccgcaagtccctgaccctgaacctcatcacggagatggggcggctgcccaccttcatgacccagaaggcccgcaacgccctggacaacctcgccgtgctgcacaccgcggaggccggcgggaaggcctacaaccacgccctgagcgagctcccggagacgctggagaccctgctcctgctgaccctcctggccaccgtcacgggcggcatcttcctgttcctcatgtccgggaagggcatcgggaagatgaccctgggcatgtgctgcatcatcaccgcgagcatcctgctctggtacgcccagatccagccccactggatcgccgcctccatcatcctggagttcttcctgatcgtgctcctgatccccgagcccgagaagcagcggaccccgcaggacaaccagctgacctacgtggtcatcgccatcctcacggtggtggcggccaccatggccaacgagatggggttcctggagaagaccaagaaggacctgggcctcggcagcatcaccacgcaggagagcgagtccaacatcctggacatcgacctgcgccccgccagcgcctggaccctctacgcggtcgccaccaccttcgtgacgcccatgctgcggcactccatcgagaacagctccgtgaacgtcagcctgaccgccatcgccaaccaggcgaccgtgctcatggggctgggcaaggggtggcccctgtccaagatggacatcggcgtgccgctcctggccatcgggtgctacagccaggtcaaccccatcaccctgacggccgccctcctgctgctcgtggcccactacgcgatcatcggccccggcctgcaggccaaggccacccgcgaggcccagaagcgggccgcggccgggatcatgaagaaccccaccgtggacggcatcaccgtcatcgacctggagccgatcccctacgaccccaagttcgagaagcagctcggccaggtgatgctgctgatcctctgcgtgacgcaggtcctgatgatgcgcaccacctgggccctgtgcgaggccctcaccctggccacgggccccatctccaccctgtgggaggggaacccgggccggttctggaacaccaccatcgcggtgagcatggccaacatcttccgcggctcctacctcgccggggccggcctgctgttcagcatcatgaagaacacgaccaacacccgccgggggaccggcaacatcggcgagacgctcggggagaagtggaagtcccgcctgaacgcgctgggcaagagcgagttccagatctacaagaagtccgggatccaggaggtggaccggaccctcgccaaggagggcatcaagcgcggggagaccgaccaccacgccgtcagccggggctccgccaagctgcgctggttcgtggagcggaacatggtgacccccgagggcaaggtcgtggacctggggtgcggccgcgggggctggagctactactgcgggggcctcaagaacgtgcgggaggtcaagggcctgacgaagggcggccccgggcacgaggagcccatcccgatgtccacctacggctggaacctggtgcgcctccagagcggggtggacgtcttcttcacgccgcccgagaagtgcgacaccctgctgtgcgacatcggcgagagctcccccaacccgacgatcgaggccggccggaccctccgcgtgctgaacctggtggagaactggctcaacaacaacacccagttctgcatcaaggtcctgaacccctacatgcccagcgtgatcgagaagatggagaccctgcagcggaagtacgggggcgcgctcgtgcgcaacccgctgtcccggaacagcacccacgagatgtactgggtctccaacgccacggggaacatcgtgagctccgtgaacatgatcagccgcatgctgatcaaccggttcaccatgaagcacaagaaggccacctacgagcccgacgtcgacctgggctccgggacccgcaacatcggcatcgagagcgagatccccaacctcgacatcatcggcaagcggatcgagaagatcaagcaggagcacgagacgtcctggcactacgaccaggaccacccctacaagacctgggcctaccacgggagctacgagaccaagcagaccggctccgccagctccatggtgaacggggtggtccgcctgctgacgaagccgtgggacgtggtgcccatggtcacccagatggcgatgaccgacaccacgcccttcggccagcagcgcgtgttcaaggagaaggtggacacccggacccaggagcccaaggagggcaccaagaagctcatgaagatcacggccgagtggctgtggaaggagctggggaagaagaagaccccgcgcatgtgcacccgggaggagttcacccgcaaggtccggagcaacgccgccctcggcgccatcttcacggacgagaacaagtggaagtccgcgcgcgaggccgtggaggacgggcggttctgggagctggtcgaccgcgagcggaacctgcacctcgagggcaagtgcgagacctgcgtgtacaacatgatggggaagcgcgagaagaagctgggcgagttcggcaaggccaaggggagccgggccatctggtacatgtggctgggcgcgcgcttcctcgagttcgaggccctggggttcctgaacgaggaccactggttctcccggggcaacagcctcagcggggtggagggcgagggcctgcaccgcctggggtacatcctccgggacgtctccaagaaggagggcggggccatgtacgccgacgacaccgccggctgggacacccgcatcacgctggaggacctgaagaacgaggagatggtgaccaaccacatgaagggggagcacaagaagctcgcggaggccatcttcaagctgacctaccagaacaaggtggtccgggtgcagcgccccacgccccggggcacggtgatggacatcatcagccgccgggaccagcgcggctccgggcaggtcggcacctacgggctgaacaccttcaccaacatggaggcccagctcatccgccagatggagggcgagggcatcttcaagagcatccagcacctgacggtgaccgaggagatcgccgtgcagaactggctggcccgggtcgggcgcgagcggctcacccgcatggcgatctccggcgacgactgcgtggtgaagcccatcgacgaccggttcgccaacgccctgaccgccctgaacgacatggggaaggtccgcaaggacatccagcagtgggagccgagccggggctggaacgactggacccaggtgcccttctgctcccaccacttccacgagctcgtgatgaaggacgggcgcgtcctggtggtgccctgccggaaccaggacgagctgatcggccgcgcccggatcagccagggcgcggggtggtccctcaaggagaccgcctgcctgggcaagagctacgcccagatgtggaccctgatgtacttccaccgccgggacctccgcctggccgccaacgcgatctgctccgccgtccccagccactgggtgccgacctcccggaccacgtggagcatccacgccaagcacgagtggatgaccaccgaggacatgctggccgtgtggaaccgcgtctggatccaggagaacccctggatggaggacaagacccccgtggagtcctgggaggaggtgccctacctcgggaagcgggaggaccagtggtgcggcagcctgatcgggctgacgtcccgcgcgacctgggccaagaacatccagaccgccatcaaccaggtccggagcctcatcggcaacgaggagtacaccgactacatgccgagcatgaagcgcttccgccgggaggaggaggaggccggcgtgctgtggtga

SEQ ID NO: 9100 - RNA, 9876 nt, synthetic construct
  misc_feature 1..9876: note = derived and/or modified CDS sequence (opt1) from DENV-2__GQ868640__SS-prME
  source 1..9876: mol_type = other RNA
accgccggcgccatcgtgatgctgatccccaccgtcatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaactccacctccacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccaccccggcttcaccatgatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcgtggaggccaagctgacgaacaccaccaccgagtcccggtgcccgacgcagggcgagcccagcctgaacgaggagcaggacaagcgcttcatctgcaagcactccatggtcgaccggggctgggggaacggctgcgggctgttcggcaagggcgggatcgtgacctgcgcgatgttcacgtgcaagaagaacatggagggcaaggtggtccagcccgagaacctggagtacaccatcgtgatcacgccccacagcggggaggagcacgccgtgggcaacgacaccgggaagcacggcaaggagatcaagatcaccccgcagtccagcatcaccgaggccgagctgaccgggtacggcacggtcaccatggagtgcagcccccgcaccggcctcgacttcaacgagatggtgctgctgcagatggaggacaaggcctggctcgtgcaccggcagtggttcctggacctgcccctcccctggctgccgggggccgacacccagggcagcaactggatccagaaggagacgctggtcaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtcatccgcgtgcagtacgagggcgacggctccccctgcaagatccccttcgagatcatggacctggagaagcggcacgtgctcgggcgcctgatcaccgtcaacccgatcgtgaccgagaaggacagccccgtgaacatcgaggcggagccgcccttcggcgactcctacatcatcatcggggtcgagccgggccagctgaagctcaactggttcaagaaggggagctccatcggccagatgttcgagaccacgatgcgcggcgccaagcggatggccatcctgggggacaccgcctgggacttcggcagcctcggcggggtgttcacctccatcgggaaggccctccaccaggtgttcggggcgatctacggcgccgccttcagcggggtctcctggaccatgaagatcctgatcggcgtgatcatcacgtggatcgggatgaacagccgctccaccagcctgtccgtgagcctggtcctcgtgggcgtggtcaccctgtacctgggggccatggtgcaggcggactccggctgcgtggtcagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtgacccgcctggagaacctcatgtggaagcagatcacccccgagctgaaccacatcctgtccgagaacgaggtcaagctcacgatcatgaccggcgacatcaaggggatcatgcaggccggcaagcggagcctgcgcccgcagcccaccgagctgaagtactcctggaagacctggggcaaggcgaagatgctccccacggagagccacaaccagaccttcctgatcgacgggccggagaccgccgagtgccccaacaccaaccgggcctggaactccctggaggtggaggactacggcttcggggtgttcacgaccaacatctggctcaagctgcgcgagaagcaggacgtcttctgcgacagcaagctgatgtccgccgccatcaaggacaaccgggcggtgcacgccgacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagaacttcgccgggccggtgagccagcacaactaccgccccggctaccacacccagacggcggggccctggcacctcggcaagctggagatggacttcgacttctgcgaggggaccaccgtggtcgtgaccgaggactgcggcaaccggggcccctccctgcgcacgaccaccgccagcgggaagctcatcaccgagtggtgctgccggagctgcacgctgccgcccctgcgctaccggggcgaggacgggtgctggtacggcatggagatccgccccctcaaggagaaggaggagaacctggtgaactccctggtcaccgccgggcacggccagatcgacaacttcagcctcggcgtgctggggatggccctgttcctcgaggagatgctgcggacccgcgtgggcaccaagcacgcgatcctgctcgtcgccgtgtccttcgtgacgctgatcaccgggaacatgagcttccgggacctgggccgcgtcatggtgatggtgggggccaccatcaccgacgacatcggcatgggcgtcacgtacctcgccctgctggccgcgttcaaggtgcgccccaccttcgccgccgggctcctgctgcggaagctcacctccaaggagctgatgatggccaccatcggcgtggccctgctcagccagtccacgatcccggagaccatcctggagctgaccgacgcgctcgccctggggatgatggccctgaagatcgtcaagaacatggagaagtaccagctcgccgtgaccatcatggccatcagctgcgtgcccaacgcggtcatcctgcagaacgcctggaaggtgtcctgcacgatcctggccgccgtcagcgtgagccccctcctgctgaccagctcccagcagaaggcggactggatccccctcgccctgaccatcaagggcctgaacccgaccgccatcttcctcacgaccctgagccgcacctccaagaagcggagctggcccctgaacgaggccatcatggccgtgggcatggtctccatcctcgcgagctccctgctgaagaacgacgtgcccatgaccgggcccctcgtggccggcgggctgctgacggtctgctacgtgctcaccggccgcagcgccgacctggagctggagcgggccgccgacgtgaagtgggaggaccaggcggagatcagcgggtccagcccgatcctctccatcaccatcagcgaggacggctccatgagcatcaagaacgaggaggaggagcagaccctgacgatcctgatccgcaccggcctcctggtcatctccggggtgttccccgtgagcatccccatcaccgccgccgcctggtacctgtgggaggtcaagaagcagcgggccggcgtgctctgggacgtgccctccccgccgcccgtcgggaaggcggagctggaggacggcgcctaccgcatcaagcagcgggggatcctgggctacagccagatcggcgccggggtgtacaaggagggcaccttccacaccatgtggcacgtgacgcgcggggccgtcctcatgcaccggggcaagcgcatcgagccgtcctgggccgacgtgaagaaggacctggtgagctacgggggcggctggaagctggagggggagtggaaggagggcgaggaggtccaggtgctcgcgctggagcccgggaagaacccccgggccgtgcagaccaagcccggcatcttcaagaccaacaccgggacgatcggcgccgtctccctggacttcagcccgggcacctccgggagccccatcgtggaccgcaagggcaaggtggtcgggctctacggcaacggcgtggtgacccggtccggggcctacgtcagcgcgatcgcccagaccgagaagtccatcgaggacaaccccgagatcgaggacgacatcttccgcaagaagcggctgacgatcatggacctgcaccccggcgccgggaagaccaagcgctacctcccggccatcgtgcgggaggccatcaagcgcggcctgcggaccctgatcctggcgcccacccgcgtggtcgccgccgagatggaggaggccctccgcgggctgcccatccggtaccagacgcccgccatccgcgcggagcacaccggccgggagatcgtggacctgatgtgccacgccaccttcaccatgcgcctcctgagcccggtgcgggtccccaactacaacctgatcatcatggacgaggcccacttcacggaccccgccagcatcgccgcgcgcggctacatctccacccgggtggagatgggggaggccgccggcatcttcatgaccgccacgccgcccgggagccgcgaccccttcccccagtccaacgcgcccatcatggacgaggagcgggagatccccgagcgcagctggaactccggccacgagtgggtgacggacttcaaggggaagaccgtctggttcgtgcccagcatcaaggccggcaacgacatcgccgcctgcctccggaagaacggcaagaaggtgatccagctgtcccgcaagaccttcgacagcgagtacgtcaagacccggtccaacgactgggacttcgtggtgacgaccgacatcagcgagatgggggccaacttcaaggcggagcgcgtcatcgacccccggcgctgcatgaagcccgtgatcctgaccgacggcgaggagcgggtgatcctcgccgggccgatgcccgtcacccactccagcgccgcccagcgccggggccgcatcgggcgcaaccccaagaacgagaacgaccagtacatctacatgggcgagcccctggagaacgacgaggactgcgcccactggaaggaggcgaagatgctgctcgacaacatcaacacgccggagggcatcatcccctccatgttcgagcccgagcgggagaaggtggacgccatcgacggggagtaccgcctgcggggcgaggcccgcaagaccttcgtggacctgatgcggcgcggggacctcccggtctggctggcctacaaggtggccgcggagggcatcaactacgccgaccggcgctggtgcttcgacgggatcaagaacaaccagatcctggaggagaacgtcgaggtggagatctggaccaaggagggcgagcggaagaagctcaagccccgctggctggacgcccggatctacagcgaccccctggccctcaaggagttcaaggagttcgcggccggccgcaagtccctgaccctgaacctcatcacggagatggggcggctgcccaccttcatgacccagaaggcccgcaacgccctggacaacctcgccgtgctgcacaccgcggaggccggcgggaaggcctacaaccacgccctgagcgagctcccggagacgctggagaccctgctcctgctgaccctcctggccaccgtcacgggcggcatcttcctgttcctcatgtccgggaagggcatcgggaagatgaccctgggcatgtgctgcatcatcaccgcgagcatcctgctctggtacgcccagatccagccccactggatcgccgcctccatcatcctggagttcttcctgatcgtgctcctgatccccgagcccgagaagcagcggaccccgcaggacaaccagctgacctacgtggtcatcgccatcctcacggtggtggcggccaccatggccaacgagatggggttcctggagaagaccaagaaggacctgggcctcggcagcatcaccacgcaggagagcgagtccaacatcctggacatcgacctgcgccccgccagcgcctggaccctctacgcggtcgccaccaccttcgtgacgcccatgctgcggcactccatcgagaacagctccgtgaacgtcagcctgaccgccatcgccaaccaggcgaccgtgctcatggggctgggcaaggggtggcccctgtccaagatggacatcggcgtgccgctcctggccatcgggtgctacagccaggtcaaccccatcaccctgacggccgccctcctgctgctcgtggcccactacgcgatcatcggccccggcctgcaggccaaggccacccgcgaggcccagaagcgggccgcggccgggatcatgaagaaccccaccgtggacggcatcaccgtcatcgacctggagccgatcccctacgaccccaagttcgagaagcagctcggccaggtgatgctgctgatcctctgcgtgacgcaggtcctgatgatgcgcaccacctgggccctgtgcgaggccctcaccctggccacgggccccatctccaccctgtgggaggggaacccgggccggttctggaacaccaccatcgcggtgagcatggccaacatcttccgcggctcctacctcgccggggccggcctgctgttcagcatcatgaagaacacgaccaacacccgccgggggaccggcaacatcggcgagacgctcggggagaagtggaagtcccgcctgaacgcgctgggcaagagcgagttccagatctacaagaagtccgggatccaggaggtggaccggaccctcgccaaggagggcatcaagcgcggggagaccgaccaccacgccgtcagccggggctccgccaagctgcgctggttcgtggagcggaacatggtgacccccgagggcaaggtcgtggacctggggtgcggccgcgggggctggagctactactgcgggggcctcaagaacgtgcgggaggtcaagggcctgacgaagggcggccccgggcacgaggagcccatcccgatgtccacctacggctggaacctggtgcgcctccagagcggggtggacgtcttcttcacgccgcccgagaagtgcgacaccctgctgtgcgacatcggcgagagctcccccaacccgacgatcgaggccggccggaccctccgcgtgctgaacctggtggagaactggctcaacaacaacacccagttctgcatcaaggtcctgaacccctacatgcccagcgtgatcgagaagatggagaccctgcagcggaagtacgggggcgcgctcgtgcgcaacccgctgtcccggaacagcacccacgagatgtactgggtctccaacgccacggggaacatcgtgagctccgtgaacatgatcagccgcatgctgatcaaccggttcaccatgaagcacaagaaggccacctacgagcccgacgtcgacctgggctccgggacccgcaacatcggcatcgagagcgagatccccaacctcgacatcatcggcaagcggatcgagaagatcaagcaggagcacgagacgtcctggcactacgaccaggaccacccctacaagacctgggcctaccacgggagctacgagaccaagcagaccggctccgccagctccatggtgaacggggtggtccgcctgctgacgaagccgtgggacgtggtgcccatggtcacccagatggcgatgaccgacaccacgcccttcggccagcagcgcgtgttcaaggagaaggtggacacccggacccaggagcccaaggagggcaccaagaagctcatgaagatcacggccgagtggctgtggaaggagctggggaagaagaagaccccgcgcatgtgcacccgggaggagttcacccgcaaggtccggagcaacgccgccctcggcgccatcttcacggacgagaacaagtggaagtccgcgcgcgaggccgtggaggacgggcggttctgggagctggtcgaccgcgagcggaacctgcacctcgagggcaagtgcgagacctgcgtgtacaacatgatggggaagcgcgagaagaagctgggcgagttcggcaaggccaaggggagccgggccatctggtacatgtggctgggcgcgcgcttcctcgagttcgaggccctggggttcctgaacgaggaccactggttctcccggggcaacagcctcagcggggtggagggcgagggcctgcaccgcctggggtacatcctccgggacgtctccaagaaggagggcggggccatgtacgccgacgacaccgccggctgggacacccgcatcacgctggaggacctgaagaacgaggagatggtgaccaaccacatgaagggggagcacaagaagctcgcggaggccatcttcaagctgacctaccagaacaaggtggtccgggtgcagcgccccacgccccggggcacggtgatggacatcatcagccgccgggaccagcgcggctccgggcaggtcggcacctacgggctgaacaccttcaccaacatggaggcccagctcatccgccagatggagggcgagggcatcttcaagagcatccagcacctgacggtgaccgaggagatcgccgtgcagaactggctggcccgggtcgggcgcgagcggctcacccgcatggcgatctccggcgacgactgcgtggtgaagcccatcgacgaccggttcgccaacgccctgaccgccctgaacgacatggggaaggtccgcaaggacatccagcagtgggagccgagccggggctggaacgactggacccaggtgcccttctgctcccaccacttccacgagctcgtgatgaaggacgggcgcgtcctggtggtgccctgccggaaccaggacgagctgatcggccgcgcccggatcagccagggcgcggggtggtccctcaaggagaccgcctgcctgggcaagagctacgcccagatgtggaccctgatgtacttccaccgccgggacctccgcctggccgccaacgcgatctgctccgccgtccccagccactgggtgccgacctcccggaccacgtggagcatccacgccaagcacgagtggatgaccaccgaggacatgctggccgtgtggaaccgcgtctggatccaggagaacccctggatggaggacaagacccccgtggagtcctgggaggaggtgccctacctcgggaagcgggaggaccagtggtgcggcagcctgatcgggctgacgtcccgcgcgacctgggccaagaacatccagaccgccatcaaccaggtccggagcctcatcggcaacgaggagtacaccgactacatgccgagcatgaagcgcttccgccgggaggaggaggaggccggcgtgctgtggtga

SEQ ID NO: 9101 - RNA, 9876 nt, synthetic construct
  misc_feature 1..9876: note = derived and/or modified CDS sequence (opt1) from DENV-2__FJ850078__SS-prME
  source 1..9876: mol_type = other RNA
accgccggcgtgatcgtcatgctgatccccaccgtgatggccttccacctcaccacccgcaacggggagccccacatgatcgtgggccggcaggagaaggggaagtccctgctgttcaagaccgaggacggcgtcaacatgtgcaccctcatggcgatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtggccctggtcccccacgtggggatgggcctcgagacccgcaccgagacctggatgagcagcgagggggcctggaagcacgtgcagcggatcgagacctggatcctgcgccaccccggcttcaccatgatggccgccatcctggcgtacaccatcgggaccacgcacttccagcgggccctcatcttcatcctgctgaccgccgtcgcccccagcatgaccatgcgctgcatcggcatcagcaaccgggacttcgtggagggcgtgagcgggggcagctgggtcgacatcgtgctcgagcacgggagctgcgtgaccacgatggcgaagaacaagcccaccctggacttcgagctgatcaagaccgaggccaagcagcccgccaccctccgcaagtactgcgtcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgccatgttcacgtgcaagaagaacatggagggcaaggtcgtgcagcccgagaacctggagtacaccatcgtgatcacgccccacagcggggaggagcacgcggtcggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgccaagaagcaggacgtcgtggtgctcgggtcccaggagggcgcgatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctggagaagcggcacgtcctcgggcgcctgatcaccgtgaacccgatcgtgaccgagaaggacagccccgtcaacatcgaggccgagccgcccttcggcgactcctacatcatcgtgggggtggagccgggccagctgaagctcaactggttcaagaaggggagctccatcggccagatgttcgagaccacgatgcgcggcgcgaagcggatggccatcctgggggacaccgcctgggacttcggcagcctcgggggcgtcttcacctccatcgggaaggccctccaccaggtgttcggcgccatctacggcgcggccttcaacggggtgagctggaccatgaagatcctgatcggcgtcatcatcacgtggatcgggatgaactcccgcagcacctccctgagcgtgtccctggtgctcgtcggcgtggtgaccctgtacctgggggccatggtccaggccgacagcggctgcgtggtgtcctggaagaacaaggagctcaagtgcggcagcgggatcttcatcaccgacaacgtccacacgtggaccgagcagtacaagttccagcccgagtcccccagcaagctggcgagcgccatccagaaggcccacgaggagggcatctgcgggatccggtccgtgacccgcctggagaacctcatgtggaagcagatcacccccgagctgaaccacatcctgagcgagaacgaggtgaagctcacgatcatgaccggcgacatcaaggggatcatgcaggccggcaagcggtccctgcgcccgcagcccaccgagctgaagtacagctggaagacctggggcaaggccaagatgctccccacggagtcccacaaccagaccttcctgatcgacgggccggagaccgcggagtgccccaacgccaaccgggcctggaacagcctggaggtcgaggactacggcttcggggtgttcaccacgaacatctggctcaagctgcgcgagaagcaggacgtgttctgcgactccaagctgatgagcgccgccatcaaggacaaccgggcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggccggtctcccagcacaactaccgccccggctaccacacccagaccgcggggccctggcacctcggcaagctggagatggacttcgacttctgcgaggggacgaccgtggtggtcaccgaggactgcggcaaccggggccccagcctgcgcaccacgaccgcctccgggaagctcatcaccgagtggtgctgccggagctgcaccctgccgcccctgcgctaccggggcgaggacgggtgctggtacggcatggagatccgccccctcaaggagaaggaggagaacctggtgaacagcctggtgacggccgggcacggccagatcgacaacttctccctcggcgtcctggggatggccctgttcctcgaggagatgctgcggacccgcgtgggcaccaagcacgcgatcctgctcgtggccgtcagcttcgtgaccctgatcacggggaacatgtccttccgggacctgggccgcgtgatggtcatggtgggggccaccatgaccgacgacatcggcatgggcgtgacctacctcgccctgctggccgcgttcaaggtccgccccacgttcgccgccgggctcctgctgcggaagctcaccagcaaggagctgatgatggccaccatcggcgtggccctgctctcccagagcaccatcccggagacgatcctggagctgaccgacgcgctcgccctggggatgatggccctgaagatcgtgaagaacatggagaagtaccagctcgccgtcaccatcatggccatctcctgcgtgcccaacgcggtcatcctgcagaacgcctggaaggtgagctgcaccatcctggccgccgtgtccgtcagccccctcctgctgacgtccagccagcagaaggcggactggatccccctcgccctgaccatcaagggcctgaacccgaccgccatcttcctcaccacgctgtcccgcaccagcaagaagcggtcctggcccctgaacgaggccgtgatggccgtgggcatggtcagcatcctcgcgtccagcctgctgaagaacgacatccccatgaccgggcccctcgtggccggcgggctgctgaccgtgtgctacgtcctcacgggccgctccgccgacctggagctggagcgggccgccgacgtgaagtgggaggaccaggcggagatcagcgggagctccccgatcctcagcatcaccatctccgaggacggcagcatgtccatcaagaacgaggaggaggagcagaccctgaccatcctgatccgcacgggcctcctggtgatcagcggggtcttccccgtgtccatccccatcaccgccgccgcctggtacctgtgggaggtgaagaagcagcgggccggcgtcctctgggacgtgcccagcccgccgcccgtggagaaggcggagctggaggacggggcctaccgcatcaagcagcggggcatcctggggtactcccagatcggcgccggcgtctacaaggaggggaccttccacaccatgtggcacgtgacccgcggcgccgtgctcatgcaccgggggaagcgcatcgagccgagctgggccgacgtcaagaaggacctggtgtcctacggcgggggctggaagctggagggcgagtggaaggagggggaggaggtgcaggtcctcgcgctggagcccggcaagaacccccgggccgtgcagacgaagcccgggatcttcaagaccaacaccggcaccatcggggccgtgagcctggacttctccccgggcacgagcggctcccccatcgtcgaccgcaaggggaaggtggtgggcctctacgggaacggcgtcgtgacccggagcggcgcctacgtgtccgcgatcgcccagaccgagaagtccatcgaggacaaccccgagatcgaggacgacatcttccgcaagaagcggctgaccatcatggacctgcaccccggggccggcaagacgaagcgctacctcccggccatcgtccgggaggccatcaagcgcgggctgcggaccctgatcctggcgcccacccgcgtggtggccgccgagatggaggaggccctccgcggcctgcccatccggtaccagacccccgccatccgcgcggagcacacggggcgggagatcgtcgacctgatgtgccacgccaccttcaccatgcgcctcctgtccccggtgcgggtgcccaactacaacctgatcatcatggacgaggcccacttcaccgaccccgccagcatcgccgcgcgcggctacatcagcacgcgggtcgagatgggcgaggccgccgggatcttcatgaccgccacgccgcccggctcccgcgaccccttcccccagagcaacgcgcccatcatggacgaggagcgggagatccccgagcgctcctggaacagcgggcacgagtgggtgaccgacttcaagggcaagacggtgtggttcgtcccctccatcaaggccgggaacgacatcgccgcctgcctccggaagaacggcaagaaggtgatccagctgagccgcaagaccttcgactccgagtacgtgaagacccggagcaacgactgggacttcgtcgtgaccacggacatctccgagatgggcgccaacttcaaggcggagcgcgtgatcgacccccggcgctgcatgaagcccgtcatcctgaccgacggggaggagcgggtgatcctcgccggcccgatgcccgtgacccacagctccgccgcccagcgccgggggcgcatcggccgcaaccccaagaacgagaacgaccagtacatctacatgggggagcccctggagaacgacgaggactgcgcccactggaaggaggcgaagatgctgctcgacaacatcaacaccccggagggcatcatccccagcatgttcgagcccgagcgggagaaggtcgacgccatcgacggcgagtaccgcctgcgcggggaggcccgcaagacgttcgtggacctgatgcggcgcggcgacctcccggtctggctggcctacaaggtggccgcggaggggatcaactacgccgaccggcgctggtgcttcgacggcatcaagaacaaccagatcctggaggagaacgtggaggtcgagatctggaccaaggagggggagcggaagaagctcaagccccgctggctggacgcccggatctactccgaccccctggccctcaaggagttcaaggagttcgcggccggccgcaagagcctgaccctgaacctcatcaccgagatgggccggctgcccacgttcatgacccagaaggcccgcaacgccctggacaacctcgccgtgctgcacaccgcggaggccgggggcaaggcctacaaccacgccctgtccgagctcccggagaccctggagacgctgctcctgctgaccctcctggccaccgtgaccgggggcatcttcctgttcctcatgagcggcaaggggatcggcaagatgacgctggggatgtgctgcatcatcaccgcgtccatcctgctctggtacgcccagatccagccccactggatcgccgccagcatcatcctggagttcttcctgatcgtcctcctgatccccgagcccgagaagcagcggaccccgcaggacaaccagctgacctacgtggtgatcgccatcctcaccgtcgtggcggccacgatggccaacgagatgggcttcctggagaagaccaagaaggacctggggctcggctccatcaccacccaggagagcgagagcaacatcctggacatcgacctgcgccccgcctccgcctggacgctctacgcggtggccaccaccttcgtcacccccatgctgcggcacagcatcgagaactccagcgtgaacgtgtccctgacggccatcgccaaccaggcgaccgtcctcatgggcctggggaagggctggcccctgagcaagatggacatcggggtgccgctcctggccatcggctgctactcccaggtgaaccccatcaccctgaccgccgccctcctgctgctcgtcgcccactacgcgatcatcgggcccggcctgcaggccaaggccacgcgcgaggcccagaagcgggccgcggccggcatcatgaagaaccccaccgtggacgggatcaccgtgatcgacctggagccgatcccctacgaccccaagttcgagaagcagctcggccaggtcatgctgctgatcctctgcgtgacccaggtgctgatgatgcgcacgacctgggccctgtgcgaggccctcaccctggccaccgggcccatcagcacgctgtgggagggcaacccggggcggttctggaacaccaccatcgcggtctccatggccaacatcttccgcggcagctacctcgccggcgccgggctgctgttctccatcatgaagaacaccacgaacacccgccggggcaccgggaacatcggcgagaccctcggcgagaagtggaagtcccgcctgaacgcgctggggaagtccgagttccagatctacaagaagtccggcatccaggaggtggaccggacgctcgccaaggaggggatcaagcgcggcgagaccgaccaccacgccgtgtcccgggggagcgccaagctgcgctggttcgtcgagcggaacatggtgacccccgagggcaaggtggtcgacctgggctgcgggcgcggcgggtggtcctactactgcggcgggctcaagaacgtgcgggaggtgaagggcctgacccgcggcgggcccggccacgaggagcccatcccgatgagcacgtacgggtggaacctggtccggctccagtccggcgtggacgtgttcttcacgccgcccgagaagtgcgacaccctgctgtgcgacatcggggagagcagccccaacccgaccatcgaggccggccgcacgctccgggtcctgaacctggtggagaactggctcaacaacaacacccagttctgcatcaaggtgctgaacccctacatgccctccgtcatcgagaagatggagaccctgcagcgcaagtacggcggggcgctcgtgcggaacccgctgagccgcaactccacccacgagatgtactgggtgagcaacgccaccggcaacatcgtctccagcgtgaacatgatctcccggatgctgatcaaccgcttcacgatgaagcacaagaaggccacctacgagcccgacgtggacctggggagcggcacccggaacatcgggatcgagtccgagatccccaacctcgacatcatcggcaagcgcatcgagaagatcaagcaggagcacgagaccagctggcactacgaccaggaccacccctacaagacgtgggcctaccacggctcctacgagaccaagcagaccgggagcgcctccagcatggtcaacggcgtggtgcgcctgctgaccaagccgtgggacgtcgtgcccatggtgacgcagatggcgatgaccgacaccacccccttcgggcagcagcgggtcttcaaggagaaggtggacacgcgcacccaggagcccaaggagggcaccaagaagctcatgaagatcaccgccgagtggctgtggaaggagctgggcaagaagaagacgccgcggatgtgcacccgcgaggagttcacccggaaggtccgctccaacgccgccctcggggccatcttcaccgacgagaacaagtggaagtccgcgcgggaggccgtggaggacggccgcttctgggagctggtggaccgggagcgcaacctgcacctcgaggggaagtgcgagacgtgcgtctacaacatgatgggcaagcgggagaagaagctgggggagttcggcaaggccaagggctcccgcgccatctggtacatgtggctgggggcgcggttcctcgagttcgaggccctgggcttcctgaacgaggaccactggttcagccgcgggaactccctcagcggcgtggagggggagggcctgcaccggctgggctacatcctccgcgacgtgagcaagaaggagggcggcgccatgtacgccgacgacaccgccgggtgggacacccggatcaccctggaggacctgaagaacgaggagatggtcacgaaccacatgaagggcgagcacaagaagctcgcggaggccatcttcaagctgacctaccagaacaaggtggtgcgcgtccagcggcccacgccccgcgggaccgtgatggacatcatctcccggcgcgaccagcgcggcagcggccaggtggggacgtacggcctgaacaccttcaccaacatggaggcccagctcatccggcagatggagggggagggcatcttcaagtccatccagcacctgaccgtcacggaggagatcgccgtgcagaactggctggcccgcgtgggccgggagcgcctcacccggatggcgatcagcggggacgactgcgtcgtgaagcccatcgacgaccgcttcgccaacgccctgaccgccctgaacgacatgggcaaggtgcggaaggacatccagcagtgggagccgtcccgcgggtggaacgactggacccaggtccccttctgcagccaccacttccacgagctcgtgatgaaggacggccgggtgctggtcgtgccctgccgcaaccaggacgagctgatcgggcgggcccgcatctcccagggcgcgggctggagcctcaaggagacggcctgcctggggaagtcctacgcccagatgtggaccctgatgtacttccaccggcgcgacctccggctggccgccaacgcgatctgcagcgccgtgccctcccactgggtcccgaccagccgcaccacctggtccatccacgccaagcacgagtggatgacgaccgaggacatgctggccgtgtggaaccgggtgtggatccaggagaacccctggatggaggacaagacccccgtcgagagctgggaggaggtgccctacctcggcaagcgcgaggaccagtggtgcgggtccctgatcggcctgaccagccgggcgacgtgggccaagaacatccagaccgccatcaaccaggtgcgctccctcatcgggaacgaggagtacaccgactacatgccgagcatgaagcgcttccggcgcgaggaggaggaggccggcgtcctgtggtga

SEQ ID NO: 9102 - RNA, 9876 nt, synthetic construct
  misc_feature 1..9876: note = derived and/or modified CDS sequence (opt1) from DENV-2__FJ850082__SS-prME
  source 1..9876: mol_type = other RNA
accgtgggcgtgatcgtgatgctgatccccaccgccatggccttccacctcaccacccgcaacggggagccccacatgatcgtgggccggcaggagaaggggaagtccctgctgttcaagaccgagaacggcgtcaacatgtgcaccctcatggcgatcgacctgggggagctgtgcgaggacaccatcacctacaagtgccccctcctgcgccagaacgagcccgaggacatcgactgctggtgcaactccaccagcacctgggtgacctacgggacctgcaccaccacgggcgagcaccggcgcgagaagcggtccgtggccctggtcccccacgtggggatgggcctcgagacccgcaccgagacctggatgagctccgagggggcctggaagcacgtgcagcggatcgagacgtggatcctgcgccacccgggcttcaccatcatggccgccatcctggcgtacaccatcgggaccacgcacttccagcgggccctcatcttcatcctgctgaccgccgtcgcccccagcatgaccatgcgctgcatcggcatctccaaccgggacttcgtggagggcgtgagcgggggctcctgggtcgacatcgtgctcgagcacgggagctgcgtgaccacgatggcgaagaacaagcccaccctggacttcgagctgatcaagaccgaggccaagcagcccgccaccctccgcaagtactgcgtcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgccatgttcacgtgcaagaagaacatggagggcaaggtcgtgcagcccgagaacctggagtacaccatcgtgatcacgccccacagcggggaggagcacgcggtcggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgccaagaagcaggacgtcgtggtgctcgggtcccaggagggcgcgatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctggagaagcggcacgtcctcgggcgcctgatcaccgtgaacccgatcgtgaccgagaaggacagccccgtcaacatcgaggccgagccgcccttcggcgactcctacatcatcatcggggtggagccgggccagctgaagctcaactggttcaagaaggggagctccatcggccagatgttcgagaccacgatgcgcggcgcgaagcggatggccatcctgggggacaccgcctgggacttcggcagcctcggcggggtgttcacctccatcgggaaggccctccaccaggtcttcggggccatctacggcgcggccttcagcggggtgtcctggaccatgaagatcctgatcggcgtgatcatcacgtggatcgggatgaacagccgctccaccagcctgtccgtcagcctggtgctcgtgggcgtcgtgaccctgtacctgggggccatggtgcaggccgactccggctgcgtcgtgagctggaagaacaaggagctcaagtgcggctccgggatcttcatcaccgacaacgtgcacacgtggaccgagcagtacaagttccagcccgagagccccagcaagctggcgtccgccatccagaaggcccacgaggagggcatctgcgggatccggagcgtcacccgcctggagaacctcatgtggaagcagatcacccccgagctgaaccacatcctgtccgagaacgaggtgaagctcacgatcatgaccggcgacatcaaggggatcatgcaggccggcaagcggagcctgcgcccgcagcccaccgagctgaagtactcctggaagacctggggcaaggccaagatgctcagcacggagtcccacaaccagaccttcctgatcgacgggcccgagaccgcggagtgcccgaacaccaaccgggcctggaacagcctggaggtggaggactacggcttcggggtcttcacgaccaacatctggctcaagctgcgcgagaagcaggacgtgttctgcgactccaagctgatgagcgccgccgtgaaggacaaccgggccgtccacgcggacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccgcccgggctaccacacccagacggccgggccctggcacctcggcaagctggagatggacttcgacttctgcgaggggaccaccgtggtggtcaccgaggactgcggcaaccggggccccagcctgcgcacgaccaccgcgagcgggaagctcatcaccgagtggtgctgccggtcctgcacgctgcccccgctgcgctaccggggcgaggacgggtgctggtacggcatggagatccgccccctcaaggagaaggaggagaacctggtgaacagcctggtgaccgccgggcacggccagatcgacaacttctccctcggcgtcctggggatggccctgttcctcgaggagatgctgcggacccgcgtgggcaccaagcacgccatcctgctcgtggcggtcagcttcgtgacgctgatcaccgggaacatgtccttccgggacctgggccgcgtgatggtcatggtgggggccaccatgaccgacgacatcggcatgggcgtgacgtacctcgccctgctggccgccttcaaggtccgccccaccttcgcggccgggctcctgctgcggaagctcaccagcaaggagctgatgatggccaccatcggcgtggccctgctctcccagagcacgatccccgagaccatcctggagctgaccgacgccctcgcgctggggatgatggccctgaagatcgtgaagaacatggagaagtaccagctcgccgtcaccatcatggccatctcctgcgtgccgaacgccgtcatcctgcagaacgcgtggaaggtgagctgcacgatcctggccgccgtgtccgtcagccccctcctgctgacctccagccagcagaaggccgactggatccccctcgcgctgaccatcaagggcctgaaccccaccgccatcttcctcacgaccctgtcccgcaccagcaagaagcggtcctggccgctgaacgaggccatcatggccgtgggcatggtgagcatcctcgcctccagcctgctgaagaacgacatccccatgaccgggcccctcgtcgcgggcgggctgctgacggtgtgctacgtgctcaccggccgcagcgccgacctggagctggagcgggccgccgacgtcaagtgggaggaccaggccgagatctccgggagctcccccatcctcagcatcaccatctccgaggacggcagcatgtccatcaagaacgaggaggaggagcagaccctgacgatcctgatccgcaccggcctcctggtgatcagcggggtgttcccggtctccatccccatcaccgcggccgcctggtacctgtgggaggtgaagaagcagcgggccggcgtgctctgggacgtccccagcccgccgcccgtggggaaggccgagctggaggagggcgcgtaccgcatcaagcagcgggggatcctgggctactcccagatcggcgccggggtgtacaaggagggcaccttccacaccatgtggcacgtcacgcgcggggccgtgctcatgcaccggggcaagcgcatcgagcccagctgggccgacgtgaagaaggacctggtctcctacgggggcggctggaagctggagggggagtggaaggagggcgaggaggtccaggtgctcgccctggagcccgggaagaacccccgggcggtccagaccaagcccggcatcttcaagaccaacaccgggacgatcggcgccgtgagcctggacttctcccccggcaccagcgggtcccccatcgtggaccgcaagggcaaggtcgtggggctctacggcaacggcgtggtcacccggagcggggcctacgtgtccgccatcgcgcagaccgacaagagcatcgaggacaaccccgagatcgaggacgacatcttccgcaagaagcggctgacgatcatggacctgcaccccggcgccgggaagaccaagcgctacctccccgccatcgtgcgggaggccatcaagcgcggcctgcggaccctgatcctggccccgacccgcgtcgtggcggccgagatggaggaggccctccgcgggctgcccatccggtaccagacgcccgccatccgcgccgagcacaccggccgggagatcgtggacctgatgtgccacgcgaccttcaccatgcgcctcctgagccccgtccgggtgccgaactacaacctgatcatcatggacgaggcccacttcacggaccccgcctccatcgccgcccgcggctacatcagcacccgggtggagatgggggaggcggccggcatcttcatgaccgccacgccgcccgggtcccgcgacccgttcccccagagcaacgcccccatcatggacgaggagcgggagatccccgagcgctcctggaacagcggccacgagtgggtcacggacttcaaggggaagaccgtgtggttcgtgccgtccatcaaggcgggcaacgacatcgccgcctgcctccggaagaacggcaagaaggtcatccagctgagccgcaagaccttcgactccgagtacgtgaagacccgggccaacgactgggacttcgtggtcacgaccgacatcagcgagatgggggccaacttcaaggcggagcgcgtgatcgacccccggcgctgcatgaagcccgtgatcctgaccgacggcgaggagcgggtcatcctcgccgggcccatgccggtgacccactccagcgccgcccagcgccggggccgcatcgggcgcaaccccaagaacgagaacgaccagtacatctacatgggcgagcccctggagaacgacgaggactgcgcccactggaaggaggcgaagatgctgctcgacaacatcaacacgcccgagggcatcatcccgtccatgttcgagcccgagcgggagaaggtggacgccatcgacggggagtaccgcctgcggggcgaggcccgcaagaccttcgtcgacctgatgcggcgcggggacctccccgtgtggctggcctacaaggtcgccgcggagggcatcaactacgccgaccggcgctggtgcttcgacgggatcaagaacaaccagatcctggaggagaacgtggaggtggagatctggaccaaggagggcgagcggaagaagctcaagccgcgctggctggacgcccggatctacagcgaccccctggccctcaaggagttcaaggagttcgcggccggccgcaagtccctgaccctgaacctcatcacggagatggggcggctgcccaccttcatgacccagaaggcccgcaacgccctggacaacctcgccgtcctgcacaccgcggaggccggcgggaaggcctacaaccacgccctgagcgagctccccgagacgctggagaccctgctcctgctgaccctcctggccaccgtgacgggcggcatcttcctgttcctcatgtccgggaagggcatcgggaagatgaccctgggcatgtgctgcatcatcaccgcgagcatcctgctctggtacgcccagatccagccgcactggatcgccgcctccatcatcctggagttcttcctgatcgtgctcctgatccccgagcccgagaagcagcggacgccccaggacaaccagctgacctacgtcgtgatcgccatcctcacggtggtcgcggccaccatggccaacgagatggggttcctggagaagaccaagaaggacctgggcctcggcagcatcaccacgcaggagagcgagtccaacatcctggacatcgacctgcgcccggccagcgcctggaccctctacgcggtggccaccaccttcgtgacgcccatgctgcggcactccatcgagaacagctccgtcaacgtgagcctgaccgccatcgccaaccaggcgaccgtgctcatggggctgggcaaggggtggcccctgtccaagatggacatcggcgtccccctcctggccatcgggtgctacagccaggtgaacccgatcaccctgacggccgccctcctgctgctcgtggcccactacgcgatcatcggccccggcctgcaggccaaggccacccgcgaggcccagaagcgggccgcggccgggatcatgaagaaccccaccgtcgacggcatcaccgtgatcgacctggagcccatcccgtacgaccccaagttcgagaagcagctcggccaggtgatgctgctgatcctctgcgtcacccaggtgctgatgatgcgcaccacctgggccctgtgcgaggccctcaccctggccacgggccccatctccaccctgtgggaggggaaccccggccggttctggaacaccaccatcgcggtgagcatggccaacatcttccgcggctcctacctcgccggggccggcctgctgttcagcatcatgaagaacacgaccaacacccgccgggggaccggcaacatcggcgagacgctcggggagaagtggaagtcccgcctgaacgcgctgggcaagagcgagttccagatctacaagaagtccgggatccaggaggtcgaccggaccctcgccaaggagggcatcaagcgcggggagaccgaccaccacgccgtgagccggggctccgccaagctgcgctggttcgtggagcggaacatggtcaccccggagggcaaggtggtggacctggggtgcggccgcgggggctggagctactactgcgggggcctcaagaacgtccgggaggtgaagggcctgacgaagggcgggcccgggcacgaggagcccatccccatgtccacctacggctggaacctggtgcgcctccagagcggggtcgacgtgttcttcaccccgcccgagaagtgcgacaccctgctgtgcgacatcggcgagagctcccccaaccccacgatcgaggccggccggaccctccgcgtgctgaacctggtcgagaactggctcaacaacaacacccagttctgcatcaaggtgctgaacccgtacatgcccagcgtgatcgagaagatggagaccctgcagcggaagtacgggggcgcgctcgtccgcaaccccctgtcccggaacagcacccacgagatgtactgggtgtccaacgccacggggaacatcgtgagctccgtcaacatgatcagccgcatgctgatcaaccggttcaccatgaagcacaagaaggccacctacgagccggacgtggacctgggctccgggacccgcaacatcggcatcgagagcgaggtgcccaacctcgacatcatcggcaagcggatcgagaagatcaagcaggagcacgagacgtcctggcactacgaccaggaccacccctacaagacctgggcctaccacgggagctacgagaccaagcagaccggctccgccagctccatggtcaacggggtggtgcgcctgctgacgaagccctgggacgtcgtgccgatggtgacccagatggcgatgaccgacaccacgcccttcggccagcagcgcgtcttcaaggagaaggtggacacccggacccaggagcccaaggagggcaccaagaagctcatgaagatcacggccgagtggctgtggaaggagctggggaagaagaagatcccccgcatgtgcacccgggaggagttcacccgcaaggtccggagcaacgccgccctcggcgccatcttcaccgacgagaacaagtggaagtccgcgcgcgaggccgtggaggacgggcggttctgggagctggtggaccgcgagcggaacctgcacctcgagggcaagtgcgagacgtgcgtctacaacatgatggggaagcgcgagaagaagctgggcgagttcggcaaggccaaggggagccgggccatctggtacatgtggctgggcgcgcgcttcctcgagttcgaggccctggggttcctgaacgaggaccactggttctcccggggcaacagcctcagcggggtggagggcgagggcctgcaccgcctggggtacatcctccgggacgtgtccaagaaggagggcggggccatgtacgccgacgacaccgccggctgggacacccgcatcaccctggaggacctgaagaacgaggagatgatcacgaaccacatgaagggggagcacaagaagctcgcggaggccatcttcaagctgacctaccagaacaaggtcgtgcgggtgcagcgcccgacgccccggggcaccgtcatggacatcatcagccgccgggaccagcgcggctccggccaggtgggcacgtacgggctgaacaccttcaccaacatggaggcccagctcatccgccagatggagggcgagggcatcttcaagagcatccagcacctgaccgtgacggaggagatcgccgtccagaactggctggcccgggtggggcgcgagcggctcacccgcatggcgatctccggcgacgactgcgtggtcaagcccatcgacgaccggttcgccaacgccctgaccgccctgaacgacatggggaaggtgcgcaaggacatccagcagtgggagcccagccggggctggaacgactggacccaggtgccgttctgctcccaccacttccacgagctcgtcatgaaggacgggcgcgtgctggtggtcccctgccggaaccaggacgagctgatcggccgcgcccggatcagccagggcgcggggtggtccctcaaggagacggcctgcctgggcaagagctacgcccagatgtggaccctgatgtacttccaccgccgggacctccgcctggccgccaacgcgatctgctccgccgtgcccagccactgggtgcccacctcccggaccacctggagcatccacgccaagcacgagtggatgacgaccgaggacatgctggccgtctggaaccgcgtgtggatccaggagaacccgtggatggaggacaagacccccgtggagtcctgggaggaggtcccctacctcgggaagcgggaggaccagtggtgcggcagcctgatcgggctgacctcccgcgcgacgtgggccaagaacatccagaccgccatcaaccaggtgcggagcctcatcggcaacgagggctacaccgactacatgcccagcatgaagcgcttccgccgggaggaggaggaggccggggtgctgtggtga

SEQ ID NO: 9103 - RNA, 9876 nt, synthetic construct
  misc_feature 1..9876: note = derived and/or modified CDS sequence (opt1) from DENV-2__FJ850085__SS-prME
  source 1..9876: mol_type = other RNA
accgtgggcgtgatcgtgatgctgatccccaccgccatggccttccacctcaccacccgcaacggggagccccacatgatcgtgggccggcaggagaaggggaagtccctgctgttcaagaccgagaacggcgtcaacatgtgcaccctcatggcgatcgacctgggggagctgtgcgaggacaccatcacctacaagtgccccctcctgcgccagaacgagcccgaggacatcgactgctggtgcaactccaccagcacctgggtgacctacgggacctgcaccaccacgggcgagcaccggcgcgagaagcggtccgtggccctggtcccccacgtggggatgggcctcgagacccgcaccgagacctggatgagctccgagggggcctggaagcacgtgcagcggatcgagacctggatcctgcgccacccgggcttcaccatcatggccgccatcctggcgtacaccatcgggaccacgcacttccagcgggccctcatcttcatcctgctgaccgccgtcgcccccagcatgaccatgcgctgcatcggcatctccaaccgggacttcgtggagggcgtgagcgggggctcctgggtcgacatcgtgctcgagcacgggagctgcgtgaccacgatggcgaagaacaagcccaccctggacttcgagctgatcaagaccgaggccaagcagcccgccaccctccgcaagtactgcgtcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgccatgttcacgtgcaagaagaacatggagggcaaggtcgtgcagcccgagaacctggagtacaccatcgtgatcacgccccacagcggggaggagcacgcggtcggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgccaagaagcaggacgtcgtggtgctcgggtcccaggagggcgcgatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctggagaagcggcacgtcctcgggcgcctgatcaccgtgaacccgatcgtggccgagaaggacagccccgtcaacatcgaggcggagccgcccttcggcgactcctacatcatcatcggggtggagccgggccagctgaagctcaactggttcaagaaggggagctccatcggccagatgttcgagaccaccatgcgcggcgccaagcggatggccatcctgggggacacggcctgggacttcggcagcctcggcggggtgttcacctccatcgggaaggccctccaccaggtcttcggggcgatctacggcgccgccttcagcggggtgtcctggaccatgaagatcctgatcggcgtgatcatcacctggatcgggatgaacagccgctccacgagcctgtccgtcagcctggtgctcgtgggcgtcgtgaccctgtacctgggggccatggtgcaggcggactccggctgcgtcgtgagctggaagaacaaggagctcaagtgcggctccgggatcttcatcaccgacaacgtgcacacctggacggagcagtacaagttccagcccgagagccccagcaagctggcctccgccatccagaaggcccacgaggagggcatctgcgggatccggagcgtcacccgcctggagaacctcatgtggaagcagatcacccccgagctgaaccacatcctgtccgagaacgaggtgaagctcaccatcatgacgggcgacatcaaggggatcatgcaggccggcaagcggagcctgcgcccgcagcccaccgagctgaagtactcctggaagacctggggcaaggcgaagatgctcagcaccgagtcccacaaccagacgttcctgatcgacgggcccgagaccgccgagtgcccgaacaccaaccgggcctggaacagcctggaggtggaggactacggcttcggggtcttcaccacgaacatctggctcaagctgcgcgagaagcaggacgtgttctgcgactccaagctgatgagcgccgccgtgaaggacaaccgggcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccgcccgggctaccacacccagaccgcggggccctggcacctcggcaagctggagatggacttcgacttctgcgaggggacgaccgtggtggtcaccgaggactgcggcaaccggggccccagcctgcgcaccacgaccgccagcgggaagctcatcaccgagtggtgctgccggtcctgcaccctgcccccgctgcgctaccggggcgaggacgggtgctggtacggcatggagatccgccccctcaaggagaaggaggagaacctggtgaacagcctggtgacggccgggcacggccagatcgacaacttctccctcggcgtcctggggatggccctgttcctcgaggagatgctgcggacccgcgtgggcaccaagcacgcgatcctgctcgtggccgtcagcttcgtgaccctgatcacggggaacatgtccttccgggacctgggccgcgtgatggtcatggtgggggccaccatgaccgacgacatcggcatgggcgtgacctacctcgccctgctggccgcgttcaaggtccgccccacgttcgccgccgggctcctgctgcggaagctcaccagcaaggagctgatgatggccaccatcggcgtggccctgctctcccagagcaccatccccgagacgatcctggagctgaccgacgcgctcgccctggggatgatggccctgaagatcgtgaagaacatggagaagtaccagctcgccgtcaccatcatggccatctcctgcgtgccgaacgcggtcatcctgcagaacgcctggaaggtgagctgcaccatcctggccgccgtgtccgtcagccccctcctgctgacgtccagccagcagaaggcggactggatccccctcgccctgaccatcaagggcctgaaccccaccgccatcttcctcaccacgctgtcccgcaccagcaagaagcggtcctggccgctgaacgaggccatcatggccgtgggcatggtgagcatcctcgcgtccagcctgctgaagaacgacatccccatgaccgggcccctcgtcgccggcgggctgctgaccgtgtgctacgtgctcacgggccgcagcgccgacctggagctggagcgggccgccgacgtcaagtgggaggaccaggcggagatctccgggagctcccccatcctcagcatcaccatctccgaggacggcagcatgtccatcaagaacgaggaggaggagcagaccctgaccatcctgatccgcacgggcctcctggtgatcagcggggtgttcccggtctccatccccatcaccgccgccgcctggtacctgtgggaggtgaagaagcagcgggccggcgtgctctgggacgtccccagcccgccgcccgtggggaaggcggagctggaggagggcgcctaccgcatcaagcagcgggggatcctgggctactcccagatcggcgccggggtgtacaaggagggcaccttccacaccatgtggcacgtcacccgcggggccgtgctcatgcaccggggcaagcgcatcgagcccagctgggccgacgtgaagaaggacctggtctcctacgggggcggctggaagctggagggggagtggaaggagggcgaggaggtccaggtgctcgcgctggagcccgggaagaacccccgggccgtccagacgaagcccggcatcttcaagaccaacaccgggaccatcggcgccgtgagcctggacttctcccccggcacgagcgggtcccccatcgtggaccgcaagggcaaggtcgtggggctctacggcaacggcgtggtcacccggagcggggcctacgtgtccgcgatcgcccagaccgacaagagcatcgaggacaaccccgagatcgaggacgacatcttccgcaagaagcggctgaccatcatggacctgcaccccggcgccgggaagacgaagcgctacctccccgccatcgtgcgggaggccatcaagcgcggcctgcggaccctgatcctggcgccgacccgcgtcgtggccgccgagatggaggaggccctccgcgggctgcccatccggtaccagacccccgccatccgcgcggagcacacgggccgggagatcgtggacctgatgtgccacgccaccttcaccatgcgcctcctgagccccgtccgggtgccgaactacaacctgatcatcatggacgaggcccacttcaccgaccccgcctccatcgccgcgcgcggctacatcagcacgcgggtggagatgggggaggccgccggcatcttcatgaccgccacgccgcccgggtcccgcgacccgttcccccagagcaacgcgcccatcatggacgaggagcgggagatccccgagcgctcctggaacagcggccacgagtgggtcaccgacttcaaggggaagacggtgtggttcgtgccgtccatcaaggccggcaacgacatcgccgcctgcctccggaagaacggcaagaaggtcatccagctgagccgcaagaccttcgactccgagtacgtgaagacccgggccaacgactgggacttcgtggtcaccacggacatcagcgagatgggggcgaacttcaaggccgagcgcgtgatcgacccccggcgctgcatgaagcccgtgatcctgaccgacggcgaggagcgggtcatcctcgccgggcccatgccggtgacccactccagcgccgcccagcgccggggccgcatcgggcgcaaccccaagaacgagaacgaccagtacatctacatgggcgagcccctggagaacgacgaggactgcgcgcactggaaggaggccaagatgctgctcgacaacatcaacacccccgagggcatcatcccgtccatgttcgagcccgagcgggagaaggtggacgccatcgacggggagtaccgcctgcggggcgaggcccgcaagacgttcgtcgacctgatgcggcgcggggacctccccgtgtggctggcctacaaggtcgcggccgagggcatcaactacgccgaccggcgctggtgcttcgacgggatcaagaacaaccagatcctggaggagaacgtggaggtggagatctggaccaaggagggcgagcggaagaagctcaagccgcgctggctggacgcccggatctacagcgaccccctggcgctcaaggagttcaaggagttcgccgccggccgcaagtccctgaccctgaacctcatcaccgagatggggcggctgcccacgttcatgacccagaaggcccgcaacgccctggacaacctcgcggtcctgcacaccgccgaggccggcgggaaggcctacaaccacgccctgagcgagctccccgagaccctggagacgctgctcctgctgaccctcctggcgaccgtgaccggcggcatcttcctgttcctcatgtccgggaagggcatcgggaagatgacgctgggcatgtgctgcatcatcaccgccagcatcctgctctggtacgcccagatccagccgcactggatcgccgcctccatcatcctggagttcttcctgatcgtgctcctgatccccgagcccgagaagcagcggacgccccaggacaaccagctgacctacgtcgtgatcgcgatcctcaccgtggtcgccgccacgatggccaacgagatggggttcctggagaagaccaagaaggacctgggcctcggcagcatcaccacccaggagagcgagtccaacatcctggacatcgacctgcgcccggccagcgcgtggacgctctacgccgtggccaccaccttcgtgacccccatgctgcggcactccatcgagaacagctccgtcaacgtgagcctgacggccatcgcgaaccaggccaccgtgctcatggggctgggcaaggggtggcccctgtccaagatggacatcggcgtccccctcctggccatcgggtgctacagccaggtgaacccgatcaccctgaccgccgccctcctgctgctcgtggcgcactacgccatcatcggccccggcctgcaggccaaggccacgcgcgaggcccagaagcgggcggccgccgggatcatgaagaaccccaccgtcgacggcatcaccgtgatcgacctggagcccatcccgtacgaccccaagttcgagaagcagctcggccaggtgatgctgctgatcctctgcgtcacccaggtgctgatgatgcgcacgacctgggccctgtgcgaggccctcaccctggcgaccggccccatctccacgctgtgggaggggaaccccggccggttctggaacaccaccatcgccgtgagcatggccaacatcttccgcggctcctacctcgccggggcgggcctgctgttcagcatcatgaagaacaccacgaacacccgccgggggaccggcaacatcggcgagaccctcggggagaagtggaagtcccgcctgaacgccctgggcaagagcgagttccagatctacaagaagtccgggatccaggaggtcgaccggacgctcgccaaggagggcatcaagcgcggggagaccgaccaccacgccgtgagccggggctccgccaagctgcgctggttcgtggagcggaacatggtcaccccggagggcaaggtggtggacctggggtgcggccgcgggggctggagctactactgcgggggcctcaagaacgtccgggaggtgaagggcctgaccaagggcgggcccgggcacgaggagcccatccccatgtccacgtacggctggaacctggtgcgcctccagagcggggtcgacgtgttcttcaccccgcccgagaagtgcgacaccctgctgtgcgacatcggcgagagctcccccaaccccaccatcgaggcgggccggacgctccgcgtgctgaacctggtcgagaactggctcaacaacaacacccagttctgcatcaaggtgctgaacccgtacatgcccagcgtgatcgagaagatggagaccctgcagcggaagtacgggggcgccctcgtccgcaaccccctgtcccggaacagcacccacgagatgtactgggtgtccaacgccaccgggaacatcgtgagctccgtcaacatgatcagccgcatgctgatcaaccggttcacgatgaagcacaagaaggccacctacgagccggacgtggacctgggctccgggacccgcaacatcggcatcgagagcgaggtgcccaacctcgacatcatcggcaagcggatcgagaagatcaagcaggagcacgagacctcctggcactacgaccaggaccacccctacaagacgtgggcctaccacgggagctacgagaccaagcagaccggctccgcgagctccatggtcaacggggtggtgcgcctgctgaccaagccctgggacgtcgtgccgatggtgacgcagatggccatgaccgacaccacccccttcggccagcagcgcgtcttcaaggagaaggtggacacgcggacccaggagcccaaggagggcaccaagaagctcatgaagatcaccgccgagtggctgtggaaggagctggggaagaagaagatcccccgcatgtgcacgcgggaggagttcacccgcaaggtccggagcaacgccgccctcggcgcgatcttcaccgacgagaacaagtggaagtccgcccgcgaggccgtggaggacgggcggttctgggagctggtggaccgcgagcggaacctgcacctcgagggcaagtgcgagacctgcgtctacaacatgatggggaagcgcgagaagaagctgggcgagttcggcaaggccaaggggagccgggcgatctggtacatgtggctgggcgcccgcttcctcgagttcgaggccctggggttcctgaacgaggaccactggttctcccggggcaacagcctcagcggggtggagggcgagggcctgcaccgcctggggtacatcctccgggacgtgtccaagaaggagggcggggccatgtacgccgacgacacggcgggctgggacacccgcatcaccctggaggacctgaagaacgaggagatgatcaccaaccacatgaagggggagcacaagaagctcgccgaggccatcttcaagctgacgtaccagaacaaggtcgtgcgggtgcagcgcccgacgccccggggcaccgtcatggacatcatcagccgccgggaccagcgcggctccggccaggtgggcacctacgggctgaacacgttcaccaacatggaggcccagctcatccgccagatggagggcgagggcatcttcaagagcatccagcacctgaccgtgaccgaggagatcgccgtccagaactggctggcgcgggtggggcgcgagcggctcacgcgcatggccatctccggcgacgactgcgtggtcaagcccatcgacgaccggttcgccaacgccctgaccgccctgaacgacatggggaaggtgcgcaaggacatccagcagtgggagcccagccggggctggaacgactggacccaggtgccgttctgctcccaccacttccacgagctcgtcatgaaggacgggcgcgtgctggtggtcccctgccggaaccaggacgagctgatcggccgcgcgcggatcagccagggcgccgggtggtccctcaaggagaccgcctgcctgggcaagagctacgcccagatgtggacgctgatgtacttccaccgccgggacctccgcctggccgcgaacgccatctgctccgccgtgcccagccactgggtgcccacctcccggaccacctggagcatccacgccaagcacgagtggatgaccacggaggacatgctggcggtctggaaccgcgtgtggatccaggagaacccgtggatggaggacaagacccccgtggagtcctgggaggaggtcccctacctcgggaagcgggaggaccagtggtgcggcagcctgatcgggctgacctcccgcgccacctgggccaagaacatccagacggccatcaaccaggtgcggagcctcatcggcaacgagggctacaccgactacatgcccagcatgaagcgcttccgccgggaggaggaggaggccggggtgctgtggtga

SEQ ID NO: 9104 - RNA, 9876 nt, synthetic construct
  misc_feature 1..9876: note = derived and/or modified CDS sequence (opt1) from DENV-2__FJ850088__SS-prME
  source 1..9876: mol_type = other RNA
accgccggcgtgatcgtgatgctgatccccaccgtgatggccttccacctcaccacccgcaacggggagccccacatgatcgtgggccggcaggagaaggggaagtccctgctgttcaagaccgaggacggcgtcaacatgtgcaccctcatggcgatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtggccctggtcccccacgtggggatgggcctcgagacccgcaccgagacctggatgagcagcgagggggcctggaagcacgtgcagcggatcgagacgtggatcctgcgccaccccggcttcaccatgatggccgccatcctggcgtacaccatcgggaccacgcacttccagcgggccctcatcttcatcctgctgaccgccgtcgcccccagcatgaccatgcgctgcatcggcatcagcaaccgggacttcgtggagggcgtgagcgggggcagctgggtcgacatcgtgctcgagcacgggagctgcgtgaccacgatggcgaagaacaagcccaccctggacttcgagctgatcaagaccgaggccaagcagcccgccaccctccgcaagtactgcgtcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgccatgttcacgtgcaagaagaacatggagggcaaggtcgtgcagcccgagaacctggagtacaccatcgtgatcacgccccacagcggggaggagcacgcggtcggcaacgacaccgggaagcacggcaaggaggtgaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtcaccttcaagaacccccacgccaagaagcaggacgtggtggtcctcgggtcccaggagggcgcgatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctggagaagcggcacgtgctcgggcgcctgatcaccgtgaacccgatcgtcaccgagaaggacagccccgtgaacatcgaggccgagccgcccttcggcgactcctacatcatcgtgggggtcgagccgggccagctgaagctcaactggttcaagaaggggagctccatcggccagatgttcgagaccacgatgcgcggcgcgaagcggatggccatcctgggggacaccgcctgggacttcggcagcctcgggggcgtgttcacctccatcgggaaggccctccaccaggtgttcggcgccatctacggcgcggccttcaacggggtcagctggaccatgaagatcctgatcggcgtgatcatcacgtggatcgggatgaactcccgcagcacctccctgagcgtgtccctggtcctcgtgggcgtggtcaccctgtacctgggggccatggtgcaggccgacagcggctgcgtggtctcctggaagaacaaggagctcaagtgcggcagcgggatcttcatcaccgacaacgtgcacacgtggaccgagcagtacaagttccagcccgagtcccccagcaagctggcgagcgccatccagaaggcccacgaggagggcatctgcgggatccggtccgtgacccgcctggagaacctcatgtggaagcagatcacccccgagctgaaccacatcctgagcgagaacgaggtcaagctcacgatcatgaccggcgacatcaaggggatcatgcaggccggcaagcggtccctgcgcccgcagcccaccgagctgaagtacagctggaagacctggggcaaggccaagatgctccccacggagtcccacaaccagaccttcctgatcgacgggccggagaccgcggagtgccccaacgccaaccgggcctggaacagcctggaggtggaggactacggcttcggggtgttcaccacgaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggccggtgtcccagcacaactaccgccccggctaccacacccagaccgcggggccctggcacctcggcaagctggagatggacttcgacttctgcgaggggacgaccgtggtcgtgaccgaggactgcggcaaccggggccccagcctgcgcaccacgaccgcctccgggaagctcatcaccgagtggtgctgccggagctgcaccctgccgcccctgcgctaccggggcgaggacgggtgctggtacggcatggagatccgccccctcaaggagaaggaggagaacctggtgaacagcctggtcacggccgggcacggccagatcgacaacttctccctcggcgtgctggggatggccctgttcctcgaggagatgctgcggacccgcgtgggcaccaagcacgcgatcctgctcgtcgccgtgagcctggtgaccctgatcacggggaacatgtccttccgggacctcggccgcgtcatggtgatggtgggggccaccatgaccgacgacatcggcatgggcgtcacctacctggccctgctcgccgcgttcaaggtgcgccccacgttcgccgccgggctgctgctccggaagctgaccagcaaggagctgatgatggccaccatcggcgtggccctcctgtcccagagcaccatcccggagacgatcctggagctcaccgacgcgctggccctggggatgatggccctcaaggtcgtgaagaacatggagaagtaccagctggccgtcaccatcatggccatctcctgcgtgcccaacgcggtgatcctgcagaacgcctggaaggtcagctgcaccatcctcgccgccgtgtccgtgagccccctgctgctcacgtccagccagcagaaggcggactggatccccctggccctgaccatcaagggcctcaacccgaccgccatcttcctgaccacgctgtcccgcaccagcaagaagcggtcctggcccctcaacgaggccgtcatggccgtgggcatggtgagcatcctggcgtccagcctgctcaagaacgacatccccatgaccgggcccctggtcgccggcgggctgctcaccgtgtgctacgtgctgacgggccgctccgccgacctggagctcgagcgggccgccgacgtcaagtgggaggaccaggcggagatcagcgggagctccccgatcctgagcatcaccatctccgaggacggcagcatgtccatcaagaacgaggaggaggagcagaccctgaccatcctcatccgcacgggcctgctggtgatcagcggggtgttccccgtctccatccccatcaccgccgccgcctggtacctctgggaggtgaagaagcagcgggccggcgtgctgtgggacgtccccagcccgccgcccgtggagaaggcggagctggaggacggggcctaccgcatcaagcagcggggcatcctcgggtactcccagatcggcgccggcgtgtacaaggaggggaccttccacaccatgtggcacgtcacccgcggcgccgtgctgatgcaccgggggaagcgcatcgagccgagctgggccgacgtgaagaaggacctggtctcctacggcgggggctggaagctcgagggcgagtggaaggagggggaggaggtccaggtgctggcgctggagcccggcaagaacccccgggccgtccagacgaagcccgggatcttcaagaccaacaccggcaccatcggggccgtgagcctcgacttctccccgggcacgagcggctcccccatcgtggaccgcaaggggaaggtcgtgggcctgtacgggaacggcgtggtcacccggagcggcgcctacgtgtccgcgatcgcccagaccgagaagtccatcgaggacaaccccgagatcgaggacgacatcttccgcaagaagcggctgaccatcatggacctccaccccggggccggcaagacgaagcgctacctgccggccatcgtgcgggaggccatcaagcgcgggctgcggaccctgatcctcgcgcccacccgcgtcgtggccgccgagatggaggaggccctgcgcggcctgcccatccggtaccagacccccgccatccgcgcggagcacacggggcgggagatcgtggacctcatgtgccacgccaccttcaccatgcgcctgctgtccccggtccgggtgcccaactacaacctcatcatcatggacgaggcccacttcaccgaccccgccagcatcgccgcgcgcggctacatcagcacgcgggtggagatgggcgaggccgccgggatcttcatgaccgccacgccgcccggctcccgcgaccccttcccccagagcaacgcgcccatcatggacgaggagcgggagatccccgagcgctcctggaacagcgggcacgagtgggtcaccgacttcaagggcaagacggtgtggttcgtgccctccatcaaggccgggaacgacatcgccgcctgcctgcggaagaacggcaagaaggtcatccagctgagccgcaagaccttcgactccgagtacgtgaagacccggagcaacgactgggacttcgtggtcaccacggacatctccgagatgggcgccaacttcaaggcggagcgcgtgatcgacccccggcgctgcatgaagcccgtgatcctcaccgacggggaggagcgggtcatcctggccggcccgatgcccgtgacccacagctccgccgcccagcgccgggggcgcatcggccgcaaccccaagaacgagaacgaccagtacatctacatgggggagcccctggagaacgacgaggactgcgcccactggaaggaggcgaagatgctcctggacaacatcaacaccccggagggcatcatccccagcatgttcgagcccgagcgggagaaggtcgacgccatcgacggcgagtaccgcctgcgcggggaggcccgcaagacgttcgtggacctcatgcggcgcggcgacctgccggtgtggctggcctacaaggtcgccgcggaggggatcaactacgccgaccggcgctggtgcttcgacggcatcaagaacaaccagatcctcgaggagaacgtggaggtggagatctggaccaaggagggggagcggaagaagctgaagccccgctggctggacgcccggatctactccgaccccctcgccctgaaggagttcaaggagttcgcggccggccgcaagagcctgaccctcaacctgatcaccgagatgggccggctgcccacgttcatgacccagaaggcccgcaacgccctcgacaacctggccgtcctgcacaccgcggaggccgggggcaaggcctacaaccacgccctctccgagctgccggagaccctggagacgctcctgctgctcgccctgctggcgaccgtgaccgggggcatcttcctcttcctgatgagcggcaaggggatcggcaagatgaccctggggatgtgctgcatcatcacggcctccatcctcctgtggtacgcccagatccagccccactggatcgccgccagcatcatcctggagttcttcctcatcgtgctgctgatccccgagcccgagaagcagcggaccccgcaggacaaccagctcacctacgtcgtgatcgcgatcctgaccgtggtcgccgccaccatggccaacgagatgggcttcctggagaagacgaagaaggacctcgggctgggctccatcaccacccaggagagcgagagcaacatcctggacatcgacctccgccccgcctccgcgtggaccctgtacgccgtggccacgaccttcgtgacccccatgctgcggcacagcatcgagaactccagcgtcaacgtgtccctcaccgccatcgcgaaccaggccacggtgctgatgggcctggggaagggctggcccctcagcaagatggacatcggggtcccgctgctggccatcggctgctactcccaggtgaaccccatcaccctcaccgccgccctgctgctcctggtggcgcactacgccatcatcgggcccggcctgcaggccaaggccacccgcgaggcccagaagcgggcggccgccggcatcatgaagaaccccacggtcgacgggatcaccgtgatcgacctcgagccgatcccctacgaccccaagttcgagaagcagctgggccaggtgatgctgctcatcctgtgcgtcacccaggtgctgatgatgcgcaccacgtgggccctctgcgaggccctgaccctggcgaccgggcccatcagcaccctctgggagggcaacccggggcggttctggaacacgaccatcgccgtgtccatggccaacatcttccgcggcagctacctggccggcgcggggctcctgttctccgtcatgaagaacaccaccaacacgcgccggggcaccgggaacatcggcgagaccctgggcgagaagtggaagtcccgcctgaacgccctcgggaagtccgagttccagatctacaagaagtccggcatccaggaggtggaccggaccctggccaaggaggggatcaagcgcggcgagacggaccaccacgccgtgtcccgggggagcgccaagctgcgctggttcgtcgagcggaacatggtgacccccgagggcaaggtggtcgacctcggctgcgggcgcggcgggtggtcctactactgcggcgggctgaagaacgtgcgggaggtgaagggcctgacccgcggcgggcccggccacgaggagcccatcccgatgagcacctacgggtggaacctcgtccggctgcagtccggcgtggacgtgttcttcacgccgcccgagaagtgcgacaccctgctctgcgacatcggggagagcagccccaacccgaccatcgaggcgggccgcaccctgcgggtcctgaacctcgtggagaactggctgaacaacaacacgcagttctgcatcaaggtgctgaacccctacatgccctccgtcatcgagaagatggagaccctccagcgcacctacggcggggccctggtgcggaacccgctgagccgcaactccacccacgagatgtactgggtgagcaacgccaccggcaacatcgtctccagcgtgaacatgatctcccggatgctgatcaaccgcttcacgatgaagcacaagaaggccacctacgagcccgacgtggacctcgggagcggcacccggaacatcgggatcgagtccgagatccccaacctggacatcatcggcaagcgcatcgagaagatcaagcaggagcacgagaccagctggcactacgaccaggaccacccctacaagacgtgggcctaccacggctcctacgagaccaagcagaccgggagcgcgtccagcatggtcaacggcgtggtgcgcctgctcaccaagccgtgggacgtcgtgcccatggtcacgcagatggccatgaccgacaccacccccttcgggcagcagcgggtgttcaaggagaaggtggacacgcgcacccaggagcccaaggagggcaccaagaagctgatgaagatcaccgccgagtggctgtggaaggagctcggcaagaagaagacgccgcggatgtgcacccgcgaggagttcacccggaaggtccgctccaacgccgccctgggggcgatcttcaccgacgagaacaagtggaagtccgcccgggaggccgtggaggacggccgcttctgggagctggtggaccgggagcgcaacctccacctggaggggaagtgcgagacgtgcgtctacaacatgatgggcaagcgggagaagaagctgggggagttcggcaaggccaagggctcccgcgcgatctggtacatgtggctcggggcccggttcctggagttcgaggccctgggcttcctcaacgaggaccactggttcagccgcgggaactccctgagcggcgtggagggggagggcctgcaccggctcggctacatcctgcgcgacgtgagccggaaggagggcggcgccatgtacgccgacgacaccgcggggtgggacacccgcatcaccctggaggacctcaagaacgaggagatggtcacgaaccacatgaagggcgagcacaagaagctggccgaggccatcttcaagctgacctaccagaacaaggtggtgcgggtccagcgccccacgccccgggggaccgtgatggacatcatctcccgccgcgaccagcggggcagcggccaggtggggacgtacggcctcaacaccttcaccaacatggaggcccagctgatccgccagatggagggggagggcatcttcaagtccatccagcacctgaccgtcacggaggagatcgccgtgcagaactggctcgcgcgggtgggccgcgagcggctgacccgcatggccatcagcggggacgactgcgtcgtgaagcccatcgacgaccggttcgccaacgccctgaccgccctcaacgacatgggcaaggtgcgcaaggacatccagcagtgggagccgtcccgggggtggaacgactggacccaggtccccttctgcagccaccacttccacgagctggtgatgaaggacggccgcgtgctggtcgtgccctgccggaaccaggacgagctcatcgggcgcgcgcggatctcccagggcgccggctggagcctgaaggagacggcctgcctggggaagtcctacgcccagatgtggaccctcatgtacttccaccgccgggacctgcgcctggccgcgaacgccatctgcagcgccgtgccctcccactgggtcccgaccagccggaccacctggtccatccacgccaagcacgagtggatgacgaccgaggacatgctcgcggtgtggaaccgcgtgtggatccaggagaacccctggatggaggacaagacccccgtcgagagctgggaggaggtgccctacctgggcaagcgggaggaccagtggtgcgggtccctgatcggcctcaccagccgcgccacgtgggccaagaacatccagaccgccatcaaccaggtgcgctccctgatcgggaacgaggagtacaccgactacatgccgagcatgaagcggttccgccgggaggaggaggaggccggcgtcctgtggtga

SEQ ID NO: 9105 - RNA, 9876 nt, synthetic construct
  misc_feature 1..9876: note = derived and/or modified CDS sequence (opt1) from DENV-2__FJ850091__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatggacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcggcggggtcttcacgtccatcgggaaggccctccaccaggtgttcggggcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcatcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacacgctgtggtccaacggcgtgctggagagcgagatgatcatccccaagaacttcgccgggcccgtgtcccagcacaactaccgcccgggctaccacacccagaccgcggggccctggcacctcggcaagctggagatggacttcgacttctgcgaggggaccacggtcgtggtgaccgaggactgcggcaaccggggccccagcctgcgcaccaccacggccagcgggaagctcatcaccgagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacgcgcgtcggcaccaagcacgcgatcctgctcgtggccctgagcttcgtgaccctgatcaccgggaacatgtccttccgggacctcggccgcgtcatggtgatggtgggggccacgatgaccgacgacatcggcatgggcgtcacctacctggccctgctcgccgcgttcaaggtgcgccccaccttcgccgccgggctgctgctccggaagctgacgagcaaggagctgatgatggccaccatcggcatcgccctcctgtcccagagcaccctgcccgagaccatcctcgagctgacggacgcgctggccctcgggatgatggccctgaagatcgtgcgcaacatggagaagtaccagctggccgtcaccatcatggccatctcctgcgtgccgaacgcggtgatcctccagaacgcctggaaggtcagctgcaccatcctggccgccgtgtccgtgagccccctgctcctgacctccagccagcagaaggcggactggatccccctggccctcacgatcaagggcctgaaccccaccgccatcttcctgaccaccctctcccggacgagcaagaagcgctcctggccgctgaacgaggccatcatggccgtcggcatggtgagcatcctggcgtccagcctcctgaagaacgacatccccatgaccgggcccctggtcgccggcgggctcctgaccgtgtgctacgtgctgaccggccgggccgccgacctcgagctggagcgcgccgcggacgtcaagtgggaggaccaggccgagatcagcgggtccagccccatcctgtccatcacgatcagcgaggacggctccatgagcatcaagaacgaggaggaggagcagaccctcaccatcctgatccggaccggcctgctcgtgatctccggggtgttcccggtcagcatccccatcaccgccgccgcctggtacctgtgggaggtgaagaagcagcgcgcgggcgtgctgtgggacgtccccagcccgccgcccgtggggaaggccgagctcgaggacggcgcctaccggatcaagcagcgcgggatcctgggctacagccagatcggcgccggggtgtacaaggagggcacgttccacaccatgtggcacgtcacccgcggggccgtgctgatgcaccgcggcaagcggatcgagccctcctgggcggacgtgaagaaggacctcatcagctacgggggcggctggaagctggagggggagtggaaggagggcgaggaggtccaggtgctggccctcgagcccgggaagaacccccgcgccgtgcagaccaagcccggcatcttcaagacgaacaccgggaccatcggcgccgtctccctggacttcagccccggcacctccgggagccccatcgtggaccggaagggcaaggtggtcgggctgtacggcaacggcgtggtgacgcgctccggggcgtacgtcagcgccatcgcccagaccgagaagtccatcgaggacaaccccgagatcgaggacgacatcttccggaagaagcgcctcaccatcatggacctgcaccccggcgccgggaagaccaagcggtacctgcccgccatcgtgcgcgaggcgatcaagcggggcctgcgcacgctcatcctggccccgacccgcgtggtcgccgccgagatggaggaggccctgcgggggctccccatccgctaccagacccccgcgatccgggccgagcacaccggccgcgagatcgtggacctgatgtgccacgccacgttcaccatgcggctgctcagccccgtgcgcgtcccgaactacaacctgatcatcatggacgaggcccacttcaccgaccccgccagcatcgcggcccggggctacatctccacccgcgtggagatgggggaggccgccggcatcttcatgacggcgacgccgcccgggagccgggacccgttcccccagtccaacgcccccatcatggacgaggagcgcgagatccccgagcggagctggaactccggccacgagtgggtgaccgacttcaaggggaagaccgtctggttcgtgccgagcatcaaggccggcaacgacatcgccgcctgcctgcgcaagaacggcaagaaggtgatccagctctcccggaagacgttcgacagcgagtacgcgaagacccgcgccaacgactgggacttcgtcgtgaccaccgacatctccgagatgggggccaacttcaaggccgagcgggtgatcgacccccgccggtgcatgaagcccgtcatcctgacggacggcgaggagcgcgtgatcctggccgggcccatgccggtgacccacagctccgcggcccagcggcgcggccgcatcgggcggaaccccaagaacgagaacgaccagtacatctacatgggcgagcccctcgagaacgacgaggactgcgcccactggaaggaggccaagatgctgctggacaacatcaacacccccgagggcatcatcccgagcatgttcgagcccgagcgcgagaaggtcgacgccatcgacggggagtaccggctccgcggcgaggcgcggaagaccttcgtggacctgatgcgccgcggggacctgcccgtgtggctcgcctacaaggtcgccgccgagggcatcaactacgcggaccgcaagtggtgcttcgacgggatcaagaacaaccagatcctggaggagaacgtggaggtggagatctggacgaaggagggcgagcggaagaagctgaagccgcgctggctcgacgcccggatctactccgaccccctggccctgaaggagttcaaggagttcgccgccggccgcaagagcctcaccctgaacctgatcaccgagatggggcggctccccaccttcatgacgcagaaggcgcgcaacgccctggacaacctggccgtcctccacaccgccgaggtgggcgggaaggcctacacccacgcgctgtccgagctgcccgagaccctcgagacgctgctgctcctgaccctgctcgccgccgtgaccggcggcatcttcctgttcctgatgagcgggaagggcatcgggaagatgaccctcggcatgtgctgcatcatcaccgcctccatcctgctgtggtacgcccagatccagccgcactggatcgcggccagcatcatcctcgagttcttcctgatcgtcctgctcatccccgagcccgagaagcagcggacgccccaggacaaccagctgacctacgtggtcatcgccatcctgaccgtggtggccgccaccatggcgaacgagatggggttcctcgagaagacgaagaaggacctgggcttcggctccatcaccacccaggagagcgagagcaacatcctggacatcgacctccgcccggcctccgcctggaccctgtacgccgtcgcgacgaccttcgtgacccccatgctgcggcacagcatcgagaactccagcgtgaacgtctccctcaccgccatcgccaaccaggccacggtgctgatggggctgggcaaggggtggcccctcagcaagatggacatcggcgtgcccctgctggccatcgggtgctactcccaggtcaacccgatcaccctcaccgcggccctgctgctcctggtggcccactacgccatcatcggccccggcctgcaggccaaggcgacccgcgaggcccagaagcgggccgccgccgggatcatgaagaaccccacggtggacggcatcaccgtcatcgacctcgagcccatcccgtacgaccccaagttcgagaagcagctggggcaggtcatgctgctcatcctgtgcgtgacccaggtcctgatgatgcgcaccacgtgggcgctctgcgaggccctgaccctggccaccggccccatcagcaccctctgggaggggaaccccggccggttctggaacacgaccatcgccgtgtccatggcgaacatcttccgcggcagctacctggccggggccggcctcctgttctccatcatgaagaacaccaccaacacgcgccgggggaccggcaacgtgggcgagaccctgggggagaagtggaagtcccgcctgaacgccctcggcaagtccgagttccagatctacaagaagtccgggatccaggaggtcgaccggaccctggccaaggagggcatcaagcgcggggagacggaccaccacgcggtgtcccggggcagcgccaagctgcgctggttcgtggagcggaacatggtcaccccggagggcaaggtggtggacctcgggtgcggccgcgggggctggtcctactactgcgggggcctgaagaacgtccgggaggtgaagggcctgaccaagggcgggcccgggcacgaggagcccatccccatgagcacctacggctggaacctcgtgcgcctgcagtccggggtcgacgtgttcttcacgccgcccgagaagtgcgacaccctgctctgcgacatcggcgagagcagccccaaccccaccatcgaggccggccggaccctgcgcgtgctgaacctcgtcgagaactggctgaacaacaacacccagttctgcatcaaggtgctgaacccgtacatgccctccgtgatcgagaagatggagacgctccagcggaagtacgggggcgccctggtccgcaaccccctgagccggaactccacccacgagatgtactgggtgagcaacgccaccgggaacatcgtgtccagcgtcaacatgatctcccgcatgctgatcaaccggttcaccatgaagcacaagaaggcgacgtacgagccggacgtggacctcggcagcgggacccgcaacatcggcatcgagtccgagatccccaacctggacatcatcggcaagcggatcgagaagatcaagcaggagcacgagaccagctggcactacgaccaggaccacccctacaagacctgggcctaccacgggtcctacgagacgaagcagaccggcagcgcctccagcatggtgaacggggtcgtgcgcctgctcaccaagccctgggacgtggtcccgatggtgacccagatggccatgacggacaccacccccttcggccagcagcgcgtgttcaaggagaaggtcgacacccggacgcaggagcccaaggagggcaccaagaagctgatgaagatcaccgccgagtggctgtggaaggagctcgggaaggagaagacgccccggatgtgcacgcgggaggagttcacccgcaaggtgcggtccaacgcggccctgggcgccgtgttcaccgacgagaacaagtggaagtccgcccgcgaggcggtcgaggacgggcggttctgggagctggtggaccgcgagcggaacctccacctggagggcaagtgcgagacctgcgtgtacaacatgatggggaagcgcgagaagaagctgggcgagttcggcaaggccaaggggtcccgggccatctggtacatgtggctcggcgcccgcttcctggagttcgaggccctggggttcctcaacgaggaccactggttcagccggggcaactccctgagcggggtcgagggcgagggcctgcaccgcctcgggtacatcctgcgggaggtgggcaagaaggagggcggcgcgatgtacgccgacgacacggccgggtgggacacccgcatcaccctggaggacctcaagaacgaggagatggtcaccaaccacatgaagggcgagcacaagaagctggccgaggccatcttcaagctgacgtaccagaacaaggtggtgcgggtccagcgcccgacgccccggggcaccgtgatggacatcatcagccgcaaggaccagcgggggtccggccaggtggggacctacggcctcaacacgttcaccaacatggaggcgcagctgatccgccagatggagggcgaggggatcttcaagagcatccagcacctgaccgccaccgaggagatcgccgtccagaactggctcgcccgcgtgggccgggagcgcctgtcccggatggccatcagcggggacgactgcgtggtcaagcccatcgacgaccgcttcgcgtccgccctgacggccctcaacgacatgggcaaggtgcggaaggacatccagcagtgggagcccagccgcgggtggaacgactggacccaggtgccgttctgctcccaccacttccacgagctggtcatgaaggacggccgggtgctggtggtcccctgccgcaaccaggacgagctcatcggccgggcccgcatcagccagggggccggctggtccctgaaggagaccgcgtgcctgggcaagagctacgcccagatgtggaccctcatgtacttccaccggcgcgacctgcggctggccgccaacgcgatctgctccgccgtgcccagccactgggtgcccacctcccgcacgacctggagcatccacgccaagcacgagtggatgaccaccgaggacatgctcgccgtctggaaccgggtgtggatccaggagaacccgtggatggaggacaagacgcccgtggagtcctgggaggaggtcccctacctgggcaagcgcgaggaccagtggtgcgggagcctgatcggcctcacctcccgggccacctgggcgaagaacatccagaccgccatcaaccaggtgcgcagcctgatcggcaacgaggggtacacggactacatgcccagcatgaagcggttccgccgcgaggaggaggaggccggcgtgctgtggtga

SEQ ID NO: 9106 - RNA, 9876 nt, synthetic construct
  misc_feature 1..9876: note = derived and/or modified CDS sequence (opt1) from DENV-2__GQ199890__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtcacctacgggacctgcaccaccatcggcgagcaccggcgcgagaagcggtccgtggccctggtgccccacgtcgggatgggcctcgagacgcgcaccgagacctggatgagcagcgagggggcctggaagcacgtgcagcggatcgagacctggatcctgcgccacccgggcttcacgatcatggccgcgatcctggcctacaccatcgggaccacccacttccagcgggccctcatcttcatcctgctgacggccgtggcgcccagcatgaccatgcgctgcatcggcatcagcaaccgggacttcgtcgagggcgtgagcgggggcagctgggtggacatcgtcctcgagcacgggagctgcgtgaccaccatggccaagaacaagcccacgctggacttcgagctgatcaagaccgaggccaagcagcccgccaccctccgcaagtactgcatcgaggccaagctgaccaacacgaccaccgagtcccggtgcccgacccagggcgagcccagcctgaacgaggagcaggacaagcgcttcatctgcaagcactccatggtggaccggggctgggggaacggctgcgggctgttcggcaagggcgggatcgtcacgtgcgcgatgttcacgtgcaagaagaacatggagggcaagatcgtgcagcccgagaacctggagtacaccatcgtgatcacgccccacagcggggaggagcgcgccgtcggcaacgacacggggaagcacggcaaggagatcaagatcaccccgcagtccagcaccaccgaggccgagctgaccgggtacggcacggtgaccatggagtgcagcccccggaccggcctcgacttcaacgagatggtgctgctgcagatggaggacaaggcctggctcgtccaccgccagtggttcctggacctgcccctcccctggctgccgggggccgacacccagggcagcaactggatccagaaggagacgctggtgaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccggctgcgcatggacaagctccagctgaaggggatgtcctacagcatgtgcaccggcaagttcaagatcgtcaaggagatcgccgagacccagcacgggacgatcgtgatccgggtgcagtacgagggcgacggctccccctgcaagatccccttcgagatcaccgacctggagaagcgccacgtcctcgggcgcctgatcaccgtgaacccgatcgtgaccgagaaggacagccccgtcaacatcgaggcggagccgcccttcggcgactcctacatcatcgtgggggtggagccgggccagctgaagctcaactggttcaagaaggggagctccatcggccagatgttcgagacgaccatgcggggcgccaagcgcatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcatcatcacctggatcgggatgaacagccggtccaccagcctgtccgtgagcctggtgctcgtcggcgtggtgaccctgtacctgggggccatggtccaggcggactccggctgcatcgtgagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccgcagcgtcacccggctggagaacctcatgtggaagcagatcacgcccgagctgaaccacatcctgtccgagaacgaggtgaagctcaccatcatgaccggcgacatcaaggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtggaggactacggcttcggggtcttcaccaccaacatctggctcaagctgcgggagaagcaggacgtgttctgcgactccaagctgatgagcgccgccatcaaggacaaccgcgcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccggccgggctaccacacgcagaccgcggggccctggcacctcggcaagctggagatggacttcgacttctgcgaggggaccaccgtcgtggtgacggaggactgcggcaaccgcggccccagcctgcggaccaccaccgccagcgggaagctcatcacggagtggtgctgccgctcctgcaccctgcccccgctgcggtaccgcggcgaggacgggtgctggtacggcatggagatccggcccctcaaggagaaggaggagaacctggtcaacagcctggtgaccgccgggcacggccagatcgacaacttctccctcggcgtgctggggatggccctgttcctcgaggagatgctgcgcacccgggtcggcacgaagcacgcgatcctgctcgtggccctgagcttcgtgaccctgatcaccgggaacatgtccttccgcgacctcggccgcgtcatggtgatggtgggggccaccatgacggacgacatcggcatgggcgtcacctacctggccctgctcgccgcgttcaaggtgcggcccaccttcgccgccgggctgctgctccgcaagctgaccagcaaggagctgatgatggccacgatcggcatcgccctcctgtcccagagcaccctgcccgagaccatcctcgagctgaccgacgcgctggccctcgggatgatggccctgaagatcgtgcggaacatggagaagtaccagctggccgtcacgatcatggccatctcctgcgtgccgaacgcggtgatcctccagaacgcctggaaggtcagctgcaccatcctggccgccgtgtccgtgagccccctgctcctgacctccagccagcagaaggcggactggatccccctggccctcaccatcaagggcctgaaccccacggccatcttcctgaccaccctctcccgcaccagcaagaagcggtcctggccgctgaacgaggccatcatggccgtcggcatggtgagcatcctggcgtccagcctcctgaagaacgacatccccatgacggggcccctggtcgccggcgggctcctgaccgtgtgctacgtgctgaccggccgcagcgccgacctcgagctggagcgggccgccgacgtcaagtgggaggaccaggcggagatctccgggagctcccccatcctgagcatcaccatctccgaggacggcagcatgtccatcaagaacgaggaggaggagcagacgctcaccatcctgatccgcaccggcctgctcgtgatcagcggggtgttcccggtctccatccccatcaccgccgccgcctggtacctgtgggaggtgaagaagcagcgggccggcgtgctgtgggacgtccccagcccgccgcccgtggggaaggcggagctcgaggacggcgcctaccgcatcaagcagcgggggatcctgggctactcccagatcggcgccggggtgtacaaggagggcaccttccacacgatgtggcacgtcacccgcggggccgtgctgatgcaccggggcaagcgcatcgagcccagctgggccgacgtgaagaaggacctcatctcctacgggggcggctggaagctggagggggagtggaaggagggcgaggaggtccaggtgctggcgctcgagcccgggaagaacccccgggccgtgcagaccaagcccggcatcttcaagaccaacacggggaccatcggcgccgtcagcctggacttctcccccggcaccagcgggtcccccatcgtggaccgcaagggcaaggtggtcgggctgtacggcaacggcgtggtgacccggagcggggcctacgtctccgcgatcgcccagacggagaagtccatcgaggacaaccccgagatcgaggacgacatcttccgcaagaagcggctcaccatcatggacctgcaccccggcgccgggaagaccaagcgctacctgcccgccatcgtgcgggaggccatcaagcgcggcctgcgcaccctcatcctggcgccgacgcgggtggtcgccgccgagatggaggaggccctgcgcgggctccccatccggtaccagacccccgccatccgcgcggagcacaccggccgggagatcgtggacctgatgtgccacgccaccttcacgatgcgcctgctcagccccgtgcgggtcccgaactacaacctgatcatcatggacgaggcccacttcaccgaccccgcctccatcgccgcgcgcggctacatcagcacccgggtggagatgggggaggccgccggcatcttcatgaccgccacgccgcccgggtcccgcgacccgttcccccagagcaacgcgcccatcatggacgaggagcgggagatccccgagcgctcctggaacagcggccacgagtgggtgaccgacttcaaggggaagaccgtctggttcgtgccgtccatcaaggccggcaacgacatcgccgcctgcctgcggaagaacggcaagaaggtgatccagctcagccgcaagaccttcgactccgagtacgtcaagacgcgggccaacgactgggacttcgtggtgaccaccgacatcagcgagatgggggcgaacttcaaggccgagcgcgtcatcgacccccggcgctgcatgaagcccgtgatcctgaccgacggcgaggagcgggtgatcctggccgggcccatgccggtcacgcactccagcgccgcccagcgccgcggccggatcgggcgcaaccccaagaacgagaacgaccagtacatctacatgggcgagcccctcgagaacgacgaggactgcgcgcactggaaggaggccaagatgctgctggacaacatcaacacccccgagggcatcatcccgtccatgttcgagcccgagcgggagaaggtggacgccatcgacggggagtaccgcctccggggcgaggcccgcaagaccttcgtggacctgatgcggcgcggggacctgcccgtctggctcgcctacaaggtggcggccgagggcatcaactacgccgaccggaagtggtgcttcgacgggatcaagaacaaccagatcctggaggagaacgtggaggtcgagatctggaccaaggagggcgagcgcaagaagctgaagccgcggtggctcgacgcccgcatctacagcgaccccctggcgctgaaggagttcaaggagttcgccgccggccggaagtccctcacgctgaacctgatcaccgagatggggcgcctccccaccttcatgacccagaaggcccggaacgccctggacaacctggcggtgctccacacggccgaggtgggcgggaaggcctacacccacgccctgagcgagctgcccgagaccctcgagaccctgctgctcctgacgctgctcgccaccatcaccggcggcatcttcctgttcctgatgtccgggaagggcatcgggaagatgaccctcggcatgtgctgcatcatcaccgcgagcatcctgctgtggtacgcccagatccagccgcactggatcgccgcctccatcatcctcgagttcttcctgatcgtcctgctcatccccgagcccgagaagcagcgcacgccccaggacaaccagctgacctacgtggtcatcgccatcctgaccgtggtggcggccaccatggccaacgagatggggttcctcgagaagacgaagaaggacctgggcttcggcaccatcaccacccaggagagcgagagcaacatcctggacatcgacctccggccggcctccgcctggacgctgtacgcggtcgccaccaccttcgtgacccccatgctgcgccacagcatcgagaactccagcgtgaacgtctccctcacggccatcgccaaccaggcgaccgtgctgatggggctgggcaaggggtggcccctcagcaagatggacatcggcgtgcccctgctggccatcgggtgctactcccaggtcaacccgatcaccctcaccgccgccctgctgctcctggtggcccactacgcgatcatcggccccggcctgcaggccaaggccacgcgggaggcccagaagcgcgccgcggccgggatcatgaagaaccccaccgtggacggcatcaccgtcatcgacctcgagcccatcccgtacgaccccaagttcgagaagcagctgggccaggtgatgctgctcatcctgtgcgtgacccaggtcctgatgatgcggacgacctgggccctctgcgaggccctgaccctggccaccggccccatcagcacgctctgggaggggaaccccggccgcttctggaacaccaccatcgcggtgtccatggccaacatcttccgcggcagctacctggccggggccggcctcctgttctccatcatgaagaacaccacgaacacccggcgcgggaccggcaacgtgggcgagaccctgggggagaagtggaagtcccggctgaacgcgctcggcaagtccgagttccagatctacaagaagtccgggatccaggaggtcgaccgcacgctggccaaggagggcatcaagcgcggggagaccgaccaccacgccgtgtcccgcggcagcgccaagctgcggtggttcgtggagcgcaacatggtcaccccggagggcaaggtggtggacctcgggtgcggccgcggcgggtggtcctactactgcggcgggctgaagaacgtccgcgaggtgaaggggctgaccaagggcgggcccgggcacgaggagcccatccccatgagcacgtacggctggaacctcgtgcggctgcagtccggggtcgacgtgttcttcaccccgcccgagaagtgcgacaccctgctctgcgacatcggcgagagcagccccaaccccaccatcgaggccggccgcaccctgcgggtgctgaacctcgtcgagaactggctgaacaacaacacgcagttctgcatcaaggtgctgaacccgtacatgccctccgtgatcgagaagatggagaccctccagcgcaagtacgggggcgcgctggtccggaaccccctgagccgcaactccacccacgagatgtactgggtgagcaacgccaccgggaacatcgtgtccagcgtcaacatgatctcccggatgctgatcaaccgcttcacgatgaagcacaagaaggccacctacgagccggacgtggacctcggcagcgggacccggaacatcggcatcgagtccgagatccccaacctggacatcatcggcaagcgcatcgagaagatcaagcaggagcacgagaccagctggcactacgaccaggaccacccctacaagacgtgggcctaccacgggtcctacgagaccaagcagaccggcagcgcctccagcatggtgaacggggtcgtgcgcctgctcaccaagccctgggacgtggtcccgatggtgacgcagatggcgatgaccgacaccacccccttcggccagcagcgggtgttcaaggagaaggtcgacacgcgcacccaggagcccaaggagggcaccaagaagctgatgaagatcaccgccgagtggctgtggaaggagctcgggaaggagaagacgccccggatgtgcacccgcgaggagttcacccggaaggtgcgctccaacgccgccctgggcgccatcttcaccgacgagaacaagtggaagtccgcgcgggaggccgtggaggacgggcgcttctgggagctggtcgaccgggagcgcaacctccacctggagggcaagtgcgagacgtgcgtgtacaacatgatggggaagcgggagaagaagctgggcgagttcggcaaggccaaggggtcccgcgccatctggtacatgtggctcggcgcgcggttcctggagttcgaggccctggggttcctcaacgaggaccactggttcagccgcggcaactccctgagcggggtggagggcgagggcctgcaccggctcgggtacatcctgcgcgaggtcggcaagaaggagggcggcgccatgtacgccgacgacaccgccgggtgggacacccggatcaccctggaggacctcaagaacgaggagatggtgacgaaccacatgaagggcgagcacaagaagctggcggaggccatcttcaagctgacctaccagaacaaggtcgtgcgcgtgcagcggccgacgccccggggcaccgtcatggacatcatcagccggaaggaccagcgcgggtccggccaggtggggacgtacggcctcaacaccttcaccaacatggaggcccagctgatccgccagatggagggcgaggggatcttcaagagcatccagcacctgaccgccacggaggagatcgccgtgcagaactggctcgcgcgggtcggccgcgagcggctgtcccgcatggccatcagcggggacgactgcgtggtgaagcccatcgacgaccggttcgcctccgccctgaccgccctcaacgacatgggcaaggtccgcaaggacatccagcagtgggagcccagccgggggtggaacgactggacccaggtgccgttctgctcccaccacttccacgagctggtgatgaaggacggccgcgtcctggtggtgccctgccggaaccaggacgagctcatcggccgcgcgcggatcagccagggggccggctggtccctgaaggagaccgcctgcctgggcaagagctacgcccagatgtggaccctcatgtacttccaccgccgggacctgcgcctggccgcgaacgccatctgctccgccgtccccagccactgggtgcccacgtcccggaccacctggagcatccacgccaagcacgagtggatgaccacggaggacatgctcgcggtgtggaaccgcgtctggatccaggagaacccgtggatggaggacaagacccccgtggagtcctgggaggaggtgccctacctgggcaagcgggaggaccagtggtgcgggagcctgatcggcctcacctcccgcgccacctgggccaagaacatccagacggccatcaaccaggtccggagcctgatcggcaacgaggggtacaccgactacatgcccagcatgaagcgcttccgcaaggaggaggaggaggccggcgtgctgtggtga

SEQ ID NO: 9107 - RNA, 9876 nt, synthetic construct
  misc_feature 1..9876: note = derived and/or modified CDS sequence (opt1) from DENV-2__GQ868549__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcggcggggtcttcacgtccatcgggaaggccctccaccaggtgttcggggcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcatcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacacgctgtggtccaacggcgtgctggagagcgagatgatcatccccaagaacttcgccgggcccgtgtcccagcacaactaccgcccgggctaccacacccagaccgcggggccctggcacctcggcaagctggagatggacttcgacttctgcgaggggaccacggtcgtggtgaccgaggactgcggcaaccggggccccagcctgcgcaccaccacggccagcgggaagctcatcaccgagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacgcgcgtcggcaccaagcacgcgatcctgctcgtggccctgagcttcgtgaccctgatcaccgggaacatgtccttccgggacctcggccgcgtcatggtgatggtgggggccacgatgaccgacgacatcggcatgggcgtcacctacctggccctgctcgccgcgttcaaggtgcgccccaccttcgccgccgggctgctgctccggaagctgacgagcaaggagctgatgatggccaccatcggcatcgccctcctgtcccagagcaccctgcccgagaccatcctcgagctgacggacgcgctggccctcgggatgatggccctgaagatcgtgcgcaacatggagaagtaccagctggccgtcaccatcatggccatctcctgcgtgccgaacgcggtgatcctccagaacgcctggaaggtcagctgcaccatcctggccgccgtgtccgtgagccccctgctcctgacctccagccagcagaaggcggactggatccccctggccctcacgatcaagggcctgaaccccaccgccatcttcctgaccaccctctcccggacgagcaagaagcgctcctggccgctgaacgaggccatcatggccgtcggcatggtgagcatcctggcgtccagcctcctgaagaacgacatccccatgaccgggcccctggtcgccggcgggctcctgaccgtgtgctacgtgctgaccggccggagcgccgacctcgagctggagcgcgccgccgacgtcaagtgggaggaccaggcggagatctccgggagctcccccatcctgagcatcacgatctccgaggacggcagcatgtccatcaagaacgaggaggaggagcagaccctcaccatcctgatccggaccggcctgctcgtgatcagcggggtgttcccggtctccatccccatcaccgccgccgcctggtacctgtgggaggtgaagaagcagcgcgccggcgtgctgtgggacgtccccagcccgccgcccgtggggaaggcggagctcgaggacggcgcctaccggatcaagcagcgcgggatcctgggctactcccagatcggcgccggggtgtacaaggagggcacgttccacaccatgtggcacgtcacccgcggggccgtgctgatgcaccgcggcaagcggatcgagcccagctgggccgacgtgaagaaggacctcatctcctacgggggcggctggaagctggagggggagtggaaggagggcgaggaggtccaggtgctggcgctcgagcccgggaagaacccccgcgccgtgcagaccaagcccggcatcttcaagacgaacaccgggaccatcggcgccgtcagcctggacttctcccccggcaccagcgggtcccccatcgtggaccggaagggcaaggtggtcgggctgtacggcaacggcgtggtgacgcgcagcggggcctacgtctccgcgatcgcccagaccgagaagtccatcgaggacaaccccgagatcgaggacgacatcttccggaagaagcgcctcaccatcatggacctgcaccccggcgccgggaagaccaagcggtacctgcccgccatcgtgcgcgaggccatcaagcggggcctgcgcacgctcatcctggcgccgacccgcgtggtcgccgccgagatggaggaggccctgcgggggctccccatccgctaccagacccccgccatccgggcggagcacaccggccgcgagatcgtggacctgatgtgccacgccacgttcaccatgcggctgctcagccccgtgcgcgtcccgaactacaacctgatcatcatggacgaggcccacttcaccgaccccgcctccatcgccgcgcggggctacatcagcacccgcgtggagatgggggaggccgccggcatcttcatgacggccacgccgcccgggtcccgggacccgttcccccagagcaacgcgcccatcatggacgaggagcgcgagatccccgagcggtcctggaacagcggccacgagtgggtgaccgacttcaaggggaagaccgtctggttcgtgccgtccatcaaggccggcaacgacatcgccgcctgcctgcgcaagaacggcaagaaggtgatccagctcagccggaagacgttcgactccgagtacgtcaagacccgcgccaacgactgggacttcgtggtgaccaccgacatcagcgagatgggggcgaacttcaaggccgagcgggtcatcgacccccgccggtgcatgaagcccgtgatcctgacggacggcgaggagcgcgtgatcctggccgggcccatgccggtcacccactccagcgccgcccagcggcgcggccgcatcgggcggaaccccaagaacgagaacgaccagtacatctacatgggcgagcccctcgagaacgacgaggactgcgcgcactggaaggaggccaagatgctgctggacaacatcaacacccccgagggcatcatcccgtccatgttcgagcccgagcgcgagaaggtggacgccatcgacggggagtaccggctccgcggcgaggcccggaagaccttcgtggacctgatgcgccgcggggacctgcccgtctggctcgcctacaaggtggcggccgagggcatcaactacgccgaccgcaagtggtgcttcgacgggatcaagaacaaccagatcctggaggagaacgtggaggtcgagatctggacgaaggagggcgagcggaagaagctgaagccgcgctggctcgacgcccggatctacagcgaccccctggcgctgaaggagttcaaggagttcgccgccggccgcaagtccctcaccctgaacctgatcaccgagatggggcggctccccaccttcatgacgcagaaggcccgcaacgccctggacaacctggcggtgctccacaccgccgaggtgggcgggaaggcctacacccacgccctgagcgagctgcccgagaccctcgagacgctgctgctcctgaccctgctcgccgcggtcaccggcggcatcttcctgttcctgatgtccgggaagggcatcgggaagatgaccctcggcatgtgctgcatcatcaccgccagcatcctgctgtggtacgcccagatccagccgcactggatcgccgcctccatcatcctcgagttcttcctgatcgtgctgctcatccccgagcccgagaagcagcggacgccccaggacaaccagctgacctacgtcgtgatcgcgatcctgaccgtggtcgccgccaccatggccaacgagatggggttcctcgagaagacgaagaaggacctgggcttcggcagcatcaccacccaggagagcgagtccaacatcctggacatcgacctccgcccggccagcgcgtggaccctgtacgccgtggccacgaccttcgtgacccccatgctgcggcactccatcgagaacagctccgtcaacgtgagcctcaccgccatcgcgaaccaggccacggtgctgatggggctgggcaaggggtggcccctctccaagatggacatcggcgtccccctgctggccatcgggtgctacagccaggtgaacccgatcaccctcaccgccgccctgctgctcctggtggcgcactacgccatcatcggccccggcctgcaggccaaggccacccgcgaggcccagaagcgggcggccgccgggatcatgaagaaccccacggtcgacggcatcaccgtgatcgacctcgagcccatcccgtacgaccccaagttcgagaagcagctggggcaggtcatgctgctcatcctgtgcgtcacccaggtgctgatgatgcgcaccacgtgggccctctgcgaggccctgaccctggcgaccggccccatctccaccctctgggaggggaaccccggccggttctggaacacgaccatcgccgtgagcatggccaacatcttccgcggctcctacctggccggggcgggcctcctgttcagcatcatgaagaacaccaccaacacgcgccgggggaccggcaacgtcggcgagaccctgggggagaagtggaagtcccgcctgaacgccctcggcaagagcgagttccagatctacaagaagtccgggatccaggaggtggaccggaccctggccaaggagggcatcaagcgcggggagacggaccaccacgccgtgagccggggctccgccaagctgcgctggttcgtcgagcggaacatggtgaccccggagggcaaggtggtcgacctcgggtgcggccgcgggggctggagctactactgcgggggcctgaagaacgtgcgggaggtgaagggcctgaccaagggcggccccgggcacgaggagcccatccccatgtccacctacggctggaacctcgtccgcctgcagagcggggtggacgtgttcttcacgccgcccgagaagtgcgacaccctgctctgcgacatcggcgagagctcccccaaccccaccatcgaggcgggccggaccctgcgcgtcctgaacctcgtggagaactggctgaacaacaacacccagttctgcatcaaggtgctgaacccgtacatgcccagcgtcatcgagaagatggagacgctccagcggaagtacgggggcgccctggtgcgcaaccccctgtcccggaacagcacccacgagatgtactgggtgtccaacgccaccgggaacatcgtcagctccgtgaacatgatcagccgcatgctgatcaaccggttcaccatgaagcacaagaaggccacgtacgagccggacgtggacctcggctccgggacccgcaacatcggcatcgagagcgagatccccaacctggacatcatcggcaagcggatcgagaagatcaagcaggagcacgagacctcctggcactacgaccaggaccacccctacaagacctgggcctaccacgggagctacgagacgaagcagaccggctccgcgagctccatggtcaacggggtggtgcgcctgctcaccaagccctgggacgtcgtgccgatggtgacccagatggccatgacggacaccacccccttcggccagcagcgcgtcttcaaggagaaggtggacacccggacgcaggagcccaaggagggcaccaagaagctgatgaagatcaccgccgagtggctgtggaaggagctcgggaaggagaagacgccccggatgtgcacgcgggaggagttcacccgcaaggtgcggagcaacgccgccctgggcgcggtcttcaccgacgagaacaagtggaagtccgcccgcgaggccgtggaggacgggcggttctgggagctggtggaccgcgagcggaacctccacctggagggcaagtgcgagacctgcgtctacaacatgatggggaagcgcgagaagaagctgggcgagttcggcaaggccaaggggagccgggcgatctggtacatgtggctcggcgcccgcttcctggagttcgaggccctggggttcctcaacgaggaccactggttctcccggggcaacagcctgagcggggtggagggcgagggcctgcaccgcctcgggtacatcctgcgggaggtcggcaagaaggagggcggcgccatgtacgccgacgacacggcggggtgggacacccgcatcaccctggaggacctcaagaacgaggagatggtgaccaaccacatgaagggcgagcacaagaagctggccgaggccatcttcaagctgacgtaccagaacaaggtggtccgggtgcagcgcccgacgccccggggcaccgtgatggacatcatctcccgcaaggaccagcgggggagcggccaggtcgggacctacggcctcaacacgttcaccaacatggaggcccagctgatccgccagatggagggcgaggggatcttcaagtccatccagcacctgaccgccaccgaggagatcgcggtgcagaactggctcgcccgcgtgggccgggagcgcctgagccggatggccatctccggggacgactgcgtcgtgaagcccatcgacgaccgcttcgccagcgccctgacggcgctcaacgacatgggcaaggtgcggaaggacatccagcagtgggagccctcccgcgggtggaacgactggacccaggtcccgttctgcagccaccacttccacgagctggtgatgaaggacggccgggtgctggtcgtgccctgccgcaaccaggacgagctcatcggccgggcccgcatctcccagggggccggctggagcctgaaggagaccgcctgcctggggaagtcctacgcccagatgtggaccctcatgtacttccaccggcgcgacctgcggctggcggccaacgccatctgcagcgccgtgccctcccactgggtccccaccagccgcacgacctggtccatccacgcgaagcacgagtggatgaccaccgaggacatgctcgccgtgtggaaccgggtgtggatccaggagaacccgtggatggaggacaagacgcccgtcgagagctgggaggaggtgccctacctgggcaagcgcgaggaccagtggtgcgggtccctgatcggcctcaccagccgggccacctgggccaagaacatccagaccgccatcaaccaggtgcgcagcctgatgggcaacgaggggtacacggactacatgccctccatgaagcggttccgccgcgaggaggaggaggcgggcgtcctgtggtga

SEQ ID NO: 9108 - RNA, 9876 nt, synthetic construct
  misc_feature 1..9876: note = derived and/or modified CDS sequence (opt1) from DENV-2__GQ868551__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcggcggggtcttcacgtccatcgggaaggccctccaccaggtgttcggggcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcatcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggtgaagatgctcagcaccgagtcccacaaccagaccttcctgatcgacgggcccgagacggcggagtgcccgaacaccaaccgggcctggaacagcctggaggtcgaggactacggcttcggggtgttcaccaccaacatctggctcaagctgcgcgagaagcaggacgtgttctgcgactccaagctgatgagcgccgccatcaaggacaaccgggccgtccacgcggacatgggctactggatcgagtccgccctcaacgacacctggaagatggagaaggccagcttcatcgaggtgaagtcctgccactggcccaagagccacacgctgtggtccaacggcgtgctggagagcgagatgatcatccccaagaacttcgccgggcccgtctcccagcacaactaccgcccgggctaccacacccagaccgccgggccctggcacctcggcaagctggagatggacttcgacttctgcgaggggaccacggtggtggtcaccgaggactgcggcaaccggggccccagcctgcgcaccaccacggcgagcgggaagctcatcaccgagtggtgctgccggtcctgcaccctgcccccgctgcgctaccggggcgaggacgggtgctggtacggcatggagatccgccccctcaaggagaaggaggagaacctggtgaacagcctggtgaccgccgggcacggccagatcgacaacttctccctcggcgtcctggggatggccctgttcctcgaggagatgctgcggacgcgcgtgggcaccaagcacgccatcctgctcgtggcgctgagcttcgtcaccctgatcaccgggaacatgtccttccgggacctcggccgcgtgatggtgatggtcggggccacgatgaccgacgacatcggcatgggcgtgacctacctggccctgctcgccgccttcaaggtgcgccccaccttcgcggccgggctgctgctccggaagctgacgagcaaggagctgatgatggccaccatcggcatcgccctcctgtcccagagcaccctgcccgagaccatcctcgagctgacggacgccctggcgctcgggatgatggccctgaagatcgtccgcaacatggagaagtaccagctggccgtgaccatcatggccatctcctgcgtgccgaacgccgtcatcctccagaacgcgtggaaggtgagctgcaccatcctggccgccgtgtccgtcagccccctgctcctgacctccagccagcagaaggccgactggatccccctggcgctcacgatcaagggcctgaaccccaccgccatcttcctgaccaccctctcccggacgagcaagaagcgctcctggccgctgaacgaggccatcatggccgtgggcatggtcagcatcctggcctccagcctcctgaagaacgacatccccatgaccgggcccctggtggcgggcgggctcctgaccgtgtgctacgtcctgaccggccggagcgccgacctcgagctggagcgcgccgccgacgtgaagtgggaggaccaggccgagatctccgggagctcccccatcctgagcatcacgatctccgaggacggcagcatgtccatcaagaacgaggaggaggagcagaccctcaccatcctgatccggaccggcctgctcgtgatcagcggggtcttcccggtgtccatccccatcaccgcggccgcctggtacctgtgggaggtgaagaagcagcgcgccggcgtcctgtgggacgtgcccagcccgccgcccgtggggaaggccgagctcgaggacggcgcgtaccggatcaagcagcgcgggatcctgggctactcccagatcggcgccggggtctacaaggagggcacgttccacaccatgtggcacgtgacccgcggggccgtgctgatgcaccgcggcaagcggatcgagcccagctgggccgacgtcaagaaggacctcatctcctacgggggcggctggaagctggagggggagtggaaggagggcgaggaggtccaggtgctggccctcgagcccgggaagaacccccgcgcggtccagaccaagcccggcatcttcaagacgaacaccgggaccatcggcgccgtgagcctggacttctcccccggcaccagcgggtcccccatcgtggaccggaagggcaaggtcgtggggctgtacggcaacggcgtggtcacgcgcagcggggcctacgtgtccgccatcgcgcagaccgagaagtccatcgaggacaaccccgagatcgaggacgacatcttccggaagaagcgcctcaccatcatggacctgcaccccggcgccgggaagaccaagcggtacctgcccgccatcgtgcgcgaggccatcaagcggggcctgcgcacgctcatcctggccccgacccgcgtcgtggcggccgagatggaggaggccctgcgggggctccccatccgctaccagacccccgccatccgggccgagcacaccggccgcgagatcgtggacctgatgtgccacgcgacgttcaccatgcggctgctcagccccgtccgcgtgccgaactacaacctgatcatcatggacgaggcccacttcaccgaccccgcctccatcgccgcccggggctacatcagcacccgcgtggagatgggggaggcggccggcatcttcatgacggccacgccgcccgggtcccgggacccgttcccccagagcaacgcccccatcatggacgaggagcgcgagatccccgagcggtcctggaacagcggccacgagtgggtcaccgacttcaaggggaagaccgtgtggttcgtgccgtccatcaaggcgggcaacgacatcgccgcctgcctgcgcaagaacggcaagaaggtcatccagctcagccggaagacgttcgactccgagtacgtgaagacccgcgccaacgactgggacttcgtggtcaccaccgacatcagcgagatgggggccaacttcaaggcggagcgggtgatcgacccccgccggtgcatgaagcccgtgatcctgacggacggcgaggagcgcgtcatcctggccgggcccatgccggtgacccactccagcgccgcccagcggcgcggccgcatcgggcggaaccccaagaacgagaacgaccagtacatctacatgggcgagcccctcgagaacgacgaggactgcgcccactggaaggaggcgaagatgctgctggacaacatcaacacccccgagggcatcatcccgtccatgttcgagcccgagcgcgagaaggtggacgccatcgacggggagtaccggctccgcggcgaggcccggaagaccttcgtcgacctgatgcgccgcggggacctgcccgtgtggctcgcctacaaggtggccgcggagggcatcaactacgccgaccgcaagtggtgcttcgacgggatcaagaacaaccagatcctggaggagaacgtcgaggtggagatctggacgaaggagggcgagcggaagaagctgaagccgcgctggctcgacgcccggatctacagcgaccccctggccctgaaggagttcaaggagttcgcggccggccgcaagtccctcaccctgaacctgatcaccgagatggggcggctccccaccttcatgacgcagaaggcccgcaacgccctggacaacctggccgtgctccacaccgcggaggtcggcgggaaggcctacacccacgccctgagcgagctgcccgagaccctcgagacgctgctgctcctgaccctgctcgccgccgtgaccggcggcatcttcctgttcctgatgtccgggaagggcatcgggaagatgaccctcggcatgtgctgcatcatcaccgcgagcatcctgctgtggtacgcccagatccagccgcactggatcgccgcctccatcatcctcgagttcttcctgatcgtcctgctcatccccgagcccgagaagcagcggacgccccaggacaaccagctgacctacgtggtgatcgccatcctgaccgtcgtggcggccaccatggccaacgagatggggttcctcgagaagacgaagaaggacctgggcttcggcagcatcaccacccaggagagcgagtccaacatcctggacatcgacctccgcccggccagcgcctggaccctgtacgcggtggccacgaccttcgtcacccccatgctgcggcactccatcgagaacagctccgtgaacgtgagcctcaccgccatcgccaaccaggcgacggtcctgatggggctgggcaaggggtggcccctctccaagatggacatcggcgtgcccctgctggccatcgggtgctacagccaggtgaacccgatcaccctcaccgccgccctgctgctcctggtcgcccactacgcgatcatcggccccggcctgcaggccaaggccacccgcgaggcccagaagcgggccgcggccgggatcatgaagaaccccacggtggacggcatcaccgtgatcgacctcgagcccatcccgtacgaccccaagttcgagaagcagctggggcaggtcatgctgctcatcctgtgcgtgacccaggtgctgatgatgcgcaccacgtgggccctctgcgaggccctgaccctggccaccggccccatctccaccctctgggaggggaaccccggccggttctggaacacgaccatcgcggtcagcatggccaacatcttccgcggctcctacctggccggggccggcctcctgttcagcatcatgaagaacaccaccaacacgcgccgggggaccggcaacgtgggcgagaccctgggggagaagtggaagtcccgcctgaacgcgctcggcaagagcgagttccagatctacaagaagtccgggatccaggaggtggaccggaccctggccaaggagggcatcaagcgcggggagacggaccaccacgccgtcagccggggctccgccaagctgcgctggttcgtggagcggaacatggtgaccccggagggcaaggtcgtggacctcgggtgcggccgcgggggctggagctactactgcgggggcctgaagaacgtgcgggaggtcaagggcctgaccaagggcggccccgggcacgaggagcccatccccatgtccacctacggctggaacctcgtgcgcctgcagagcggggtggacgtcttcttcacgccgcccgagaagtgcgacaccctgctctgcgacatcggcgagagctcccccaaccccaccatcgaggccggccggaccctgcgcgtgctgaacctcgtggagaactggctgaacaacaacacccagttctgcatcaaggtcctgaacccgtacatgcccagcgtgatcgagaagatggagacgctccagcggaagtacgggggcgcgctggtgcgcaaccccctgtcccggaacagcacccacgagatgtactgggtctccaacgccaccgggaacatcgtgagctccgtgaacatgatcagccgcatgctgatcaaccggttcaccatgaagcacaagaaggccacgtacgagccggacgtcgacctcggctccgggacccgcaacatcggcatcgagagcgagatccccaacctggacatcatcggcaagcggatcgagaagatcaagcaggagcacgagacctcctggcactacgaccaggaccacccctacaagacctgggcctaccacgggagctacgagacgaagcagaccggctccgccagctccatggtgaacggggtggtccgcctgctcaccaagccctgggacgtggtgccgatggtcacccagatggcgatgacggacaccacccccttcggccagcagcgcgtgttcaaggagaaggtggacacccggacgcaggagcccaaggagggcaccaagaagctgatgaagatcaccgccgagtggctgtggaaggagctcgggaaggagaagacgccccggatgtgcacgcgggaggagttcacccgcaaggtccggagcaacgccgccctgggcgccgtgttcaccgacgagaacaagtggaagtccgcgcgcgaggccgtggaggacgggcggttctgggagctggtcgaccgcgagcggaacctccacctggagggcaagtgcgagacctgcgtgtacaacatgatggggaagcgcgagaagaagctgggcgagttcggcaaggccaaggggagccgggccatctggtacatgtggctcggcgcgcgcttcctggagttcgaggccctggggttcctcaacgaggaccactggttctcccggggcaacagcctgagcggggtcgagggcgagggcctgcaccgcctcgggtacatcctgcgggaggtgggcaagaaggagggcggcgccatgtacgccgacgacacggccgggtgggacacccgcatcaccctggaggacctcaagaacgaggagatggtgaccaaccacatgaagggcgagcacaagaagctggcggaggccatcttcaagctgacgtaccagaacaaggtcgtgcgggtgcagcgcccgacgccccggggcaccgtcatggacatcatctcccgcaaggaccagcgggggagcggccaggtggggacctacggcctcaacacgttcaccaacatggaggcccagctgatccgccagatggagggcgaggggatcttcaagtccatccagcacctgaccgccaccgaggagatcgccgtgcagaactggctcgcgcgcgtcggccgggagcgcctgagccggatggccatctccggggacgactgcgtggtgaagcccatcgacgaccgcttcgccagcgccctgacggccctcaacgacatgggcaaggtccggaaggacatccagcagtgggagccctcccgcgggtggaacgactggacccaggtgccgttctgcagccaccacttccacgagctggtgatgaaggacggccgggtcctggtggtgccctgccgcaaccaggacgagctcatcggccgggcgcgcatctcccagggggccggctggagcctgaaggagaccgcctgcctggggaagtcctacgcccagatgtggaccctcatgtacttccaccggcgcgacctgcggctggccgcgaacgccatctgcagcgccgtcccctcccactgggtgcccaccagccgcacgacctggtccatccacgccaagcacgagtggatgaccaccgaggacatgctcgcggtgtggaaccgggtctggatccaggagaacccgtggatggaggacaagacgcccgtggagagctgggaggaggtgccctacctgggcaagcgcgaggaccagtggtgcgggtccctgatcggcctcaccagccgggccacctgggccaagaacatccagaccgccatcaaccaggtccgcagcctgatgggcaacgaggggtacacggactacatgccctccatgaagcggttccgccgcgaggaggaggaggccggcgtgctgtggtga

SEQ ID NO: 9109 - RNA, 9876 nt, synthetic construct
  misc_feature 1..9876: note = derived and/or modified CDS sequence (opt1) from DENV-2__HM181971__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcggcggggtcttcacgtccatcgggaaggccctccaccaggtgttcggggcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcatcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacacgctgtggtccaacggcgtgctggagagcgagatgatcatccccaagaacttcgccgggcccgtgtcccagcacaactaccgcccgggctaccacacccagaccgcggggccctggcacctcggcaagctggagatcgacttcgacttctgcgaggggaccacggtcgtggtgaccgaggactgcggcaaccggggccccagcctgcgcaccaccacggccagcgggaagctcatcaccgagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacgcgcgtcggcaccaagcacgcgatcctgctcgtggccctgagcttcgtgaccctgatcaccgggaacatgtccttccgggacctcggccgcgtcatggtgatggtgggggccacgatgaccgacgacatcggcatgggcgtcacctacctggccctgctcgccgcgttcaaggtgcgccccaccttcgccgccgggctgctgctccggaagctgacgagcaaggagctgatgatggccaccatcggcatcgccctcctgtcccagagcaccctgcccgagaccatcctcgagctgacggacgcgctggccctcgggatgatggccctgaagatcgtgcgcaacatggagaagtaccagctggccgtcaccatcatggccatctcctgcgtgccgaacgcggtgatcctccagaacgcctggaaggtcagctgcaccatcctggccgccgtgtccgtgagccccctgctcctgacctccagccagcagaaggcggactggatccccctggccctcacgatcaagggcctgaaccccaccgccatcttcctgaccaccctctcccggacgagcaagaagcgctcctggccgctgaacgaggccatcatggccgtcggcatggtgagcatcctggcgtccagcctcctgaagaacgacatccccatgaccgggcccctggtcgccggcgggctcctgaccgtgtgctacgtgctgaccggccggagcgccgacctcgagctggagcgcgccgccgacgtcaagtgggaggaccaggcggagatctccgggagctcccccatcctgagcatcacgatctccgaggacggcagcatgtccatcaagaacgaggaggaggagcagaccctcaccatcctgatccggaccggcctgctcgtgatcagcggggtgttcccggtctccatccccatcaccgccgccgcctggtacctgtgggaggtgaagaagcagcgcgccggcgtgctgtgggacgtccccagcccgccgcccgtggggaaggcggagctcgaggacggcgcctaccggatcaagcagcgcgggatcctgggctactcccagatcggcgccggggtgtacaaggagggcacgttccacaccatgtggcacgtcacccgcggggccgtgctgatgcaccgcggcaagcggatcgagcccagctgggccgacgtgaagaaggacctcatctcctacgggggcggctggaagctggagggggagtggaaggagggcgaggaggtccaggtgctggcgctcgagcccgggaagaacccccgcgccgtgcagaccaagcccggcatcttcaagacgaacaccgggaccatcggcgccgtcagcctggacttctcccccggcaccagcgggtcccccatcgtggaccggaagggcaaggtggtcgggctgtacggcaacggcgtggtgacgcgcagcggggcctacgtctccgcgatcgcccagaccgagaagtccatcgaggacaaccccgagatcgaggacgacatcttccggaagaagcgcctcaccatcatggacctgcaccccggcgccgggaagaccaagcggtacctgcccgccatcgtgcgcgaggccatcaagcggggcctgcgcacgctcatcctggcgccgacccgcgtggtcgccgccgagatggaggaggccctgcgggggctccccatccgctaccagacccccgccatccgggcggagcacaccggccgcgagatcgtggacctgatgtgccacgccacgttcaccatgcggctgctcagccccgtgcgcgtcccgaactacaacctgatcatcatggacgaggcccacttcaccgaccccgcctccatcgccgcgcggggctacatcagcacccgcgtggagatgggggaggccgccggcatcttcatgacggccacgccgcccgggtcccgggacccgttcccccagagcaacgcgcccatcatggacgaggagcgcgagatccccgagcggtcctggaacagcggccacgagtgggtgaccgacttcaaggggaagaccgtctggttcgtgccgtccatcaaggccggcaacgacatcgccgcctgcctgcgcaagaacggcaagaaggtgatccagctcagccggaagacgttcgactccgagtacgtcaagacccgcgccaacgactgggacttcgtggtgaccaccgacatcagcgagatgggggcgaacttcaaggccgagcgggtcatcgacccccgccggtgcatgaagcccgtgatcctgacggacggcgaggagcgcgtgatcctggccgggcccatgccggtcacccactccagcgccgcccagcggcgcggccgcatcgggcggaaccccaagaacgagaacgaccagtacatctacatgggcgagcccctcgagaacgacgaggactgcgcgcactggaaggaggccaagatgctgctggacaacatcaacacccccgagggcatcatcccgtccatgttcgagcccgagcgcgagaaggtggacgccatcgacggggagtaccggctccgcggcgaggcccggaagaccttcgtggacctgatgcgccgcggggacctgcccgtctggctcgcctacaaggtggcggccgagggcatcaactacgccgaccgcaagtggtgcttcgacgggatcaagaacaaccagatcctggaggagaacgtggaggtcgagatctggacgaaggagggcgagcggaagaagctgaagccgcgctggctcgacgcccggatctacagcgaccccctggcgctgaaggagttcaaggagttcgccgccggccgcaagtccctcaccctgaacctgatcaccgagatggggcggctccccaccttcatgacgcagaaggcccgcaacgccctggacaacctggcggtgctccacaccgccgaggtgggcgggaaggcctacacccacgccctgagcgagctgcccgagaccctcgagacgctgctgctcctgaccctgctcgccgcggtcaccggcggcatcttcctgttcctgatgtccgggaagggcatcgggaagatgaccctcggcatgtgctgcatcatcaccgccagcatcctgctgtggtacgcccagatccagccgcactggatcgccgcctccatcatcctcgagttcttcctgatcgtgctgctcatccccgagcccgagaagcagcggacgccccaggacaaccagctgacctacgtcgtgatcgcgatcctgaccgtggtcgccgccaccatggccaacgagatggggttcctcgagaagacgaagaaggacctgggcttcggcagcatcaccacccaggagagcgagtccaacatcctggacatcgacctccgcccggccagcgcgtggaccctgtacgccgtggccacgaccttcgtgacccccatgctgcggcactccatcgagaacagctccgtcaacgtgagcctcaccgccatcgcgaaccaggccacggtgctgatggggctgggcaaggggtggcccctctccaagatggacatcggcgtccccctgctggccatcgggtgctacagccaggtgaacccgatcaccctcaccgccgccctgctgctcctggtggcgcactacgccatcatcggccccggcctgcaggccaaggccacccgcgaggcccagaagcgggcggccgccgggatcatgaagaaccccacggtcgacggcatcaccgtgatcgacctcgagcccatcccgtacgaccccaagttcgagaagcagctggggcaggtcatgctgctcatcctgtgcgtcacccaggtgctgatgatgcgcaccacgtgggccctctgcgaggccctgaccctggcgaccggccccatctccaccctctgggaggggaaccccggccggttctggaacacgaccatcgccgtgagcatggccaacatcttccgcggctcctacctggccggggcgggcctcctgttcagcatcatgaagaacaccaccaacacgcgccgggggaccggcaacgtcggcgagaccctgggggagaagtggaagtcccgcctgaacgccctcggcaagagcgagttccagatctacaagaagtccgggatccaggaggtggaccggaccctggccaaggagggcatcaagcgcggggagacggaccaccacgccgtgagccggggctccgccaagctgcgctggttcgtcgagcggaacatggtgaccccggagggcaaggtggtcgacctcgggtgcggccgcgggggctggagctactactgcgggggcctgaagaacgtgcgggaggtgaagggcctgaccaagggcggccccgggcacgaggagcccatccccatgtccacctacggctggaacctcgtccgcctgcagagcggggtggacgtgttcttcacgccgcccgagaagtgcgacaccctgctctgcgacatcggcgagagctcccccaaccccaccatcgaggcgggccggaccctgcgcgtcctgaacctcgtggagaactggctgaacaacaacacccagttctgcatcaaggtgctgaacccgtacatgcccagcgtcatcgagaagatggagacgctccagcggaagtacgggggcgccctggtgcgcaaccccctgtcccggaacagcacccacgagatgtactgggtgtccaacgccaccgggaacatcgtcagctccgtgaacatgatcagccgcatgctgatcaaccggttcaccatgaagcacaagaaggccacgtacgagccggacgtggacctcggctccgggacccgcaacatcggcatcgagagcgagatccccaacctggacatcatcggcaagcggatcgagaagatcaagcaggagcacgagacctcctggcactacgaccaggaccacccctacaagacctgggcctaccacgggagctacgagacgaagcagaccggctccgcgagctccatggtcaacggggtggtgcgcctgctcaccaagccctgggacgtcgtgccgatggtgacccagatggccatgacggacaccacccccttcggccagcagcgcgtcttcaaggagaaggtggacacccggacgcaggagcccaaggagggcaccaagaagctgatgaagatcaccgccgagtggctgtggaaggagctcgggaaggagaagacgccccggatgtgcacgcgggaggagttcacccgcaaggtgcggagcaacgccgccctgggcgcggtcttcaccgacgagaacaagtggaagtccgcccgcgaggccgtggaggacgggcggttctgggagctggtggaccgcgagcggaacctccacctggagggcaagtgcgagacctgcgtctacaacatgatggggaagcgcgagaagaagctgggcgagttcggcaaggccaaggggagccgggcgatctggtacatgtggctcggcgcccgcttcctggagttcgaggccctggggttcctcaacgaggaccactggttctcccggggcaacagcctgagcggggtggagggcgagggcctgcaccgcctcgggtacatcctgcgggaggtcggcaagaaggagggcggcgccatgtacgccgacgacacggcggggtgggacacccgcatcaccctggaggacctcaagaacgaggagatggtgaccaaccacatgaagggcgagcacaagaagctggccgaggccatcttcaagctgacgtaccagaacaaggtggtccgggtgcagcgcccgacgccccggggcaccgtgatggacatcatctcccgcaaggaccagcgggggagcggccaggtcgggacctacggcctcaacacgttcaccaacatggaggcccagctgatccgccagatggagggcgaggggatcttcaagtccatccagcacctgaccgccaccgaggagatcgcggtgcagaactggctcgcccgcgtgggccgggagcgcctgagccggatggccatctccggggacgactgcgtcgtgaagcccatcgacgaccgcttcgccagcgccctgacggcgctcaacgacatgggcaaggtgcggaaggacatccagcagtgggagccctcccgcgggtggaacgactggacccaggtcccgttctgcagccaccacttccacgagctggtgatgaaggacggccgggtgctggtcgtgccctgccgcaaccaggacgagctcatcggccgggcccgcatctcccagggggccggctggagcctgaaggagaccgcctgcctggggaagtcctacgcccagatgtggaccctcatgtacttccaccggcgcgacctgcggctggcggccaacgccatctgcagcgccgtgccctcccactgggtccccaccagccgcacgacctggtccatccacgcgaagcacgagtggatgaccaccgaggacatgctcgccgtgtggaaccgggtgtggatccaggagaacccgtggatggaggacaagacgcccgtcgagagctgggaggaggtgccctacctgggcaagcgcgaggaccagtggtgcgggtccctgatcggcctcaccagccgggccacctgggccaagaacatccagaccgccatcaaccaggtgcgcagcctgatgggcaacgaggggtacacggactacatgccctccatgaagcggttccgccgcgaggaggaggaggcgggcgtcctgtggtga

SEQ ID NO: 9110 - RNA, 9876 nt, synthetic construct
  misc_feature 1..9876: note = derived and/or modified CDS sequence (opt1) from DENV-2__GU131881__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcggcggggtcttcacgtccatcgggaaggccctccaccaggtgttcggggcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcatcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtcttcaccaccaacatctggctcaagctgcgcgagaagcaggacgtgttctgcgactccaagctgatgagcgccgccatcaagaacaaccgggcggtgcacgccgacatgggctactggatcgagtccgccctcaacgacacctggaagatggagaaggccagcttcatcgaggtcaagtcctgccactggcccaagagccacacgctgtggtccaacggcgtgctggagagcgagatgatcatccccaagaacttcgccgggcccgtgtcccagcacaactaccgcccgggctaccacacccagaccgcggggccctggcacctcggcaagctggagatggacttcgacttctgcgaggggaccacggtcgtggtgaccgaggactgcggcaaccggggccccagcctgcgcaccaccacggccagcgggaagctcatcaccgagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacgcgcgtcggcaccaagcacgcgatcctgctcgtggccctgagcttcgtgaccctgatcaccgggaacatgtccttccgggacctcggccgcgtcatggtgatggtgggggccacgatgaccgacgacatcggcatgggcgtcacctacctggccctgctcgccgcgttcaaggtgcgccccaccttcgccgccgggctgctgctccggaagctgacgagcaaggagctgatgatggccaccatcggcatcgccctcctgtcccagagcaccctgcccgagaccatcctcgagctgacggacgcgctggccctcgggatgatggccctgaagatcgtgcgcaacatggagaagtaccagctggccgtcaccatcatggccatctcctgcgtgccgaacgcggtgatcctccagaacgcctggaaggtcagctgcaccatcctggccgccgtgtccgtgagccccctgctcctgacctccagccagcagaaggcggactggatccccctggccctcacgatcaagggcctgaaccccaccgccatcttcctgaccaccctctcccggacgagcaagaagcgctcctggccgctgaacgaggccatcatggccgtcggcatggtgagcatcctggcgtccagcctcctgaagaacgacatccccatgaccgggcccctggtcgccggcgggctcctgaccgtgtgctacgtgctgaccggccggagcgccgacctcgagctggagcgcgccgccgacgtcaagtgggaggaccaggcggagatctccgggagctcccccatcctgagcatcacgatctccgaggacggcagcatgtccatcaagaacgaggaggaggagcagaccctcaccatcctgatccggaccggcctgctcgtgatcagcggggtgttcccggtctccatccccatcaccgccgccgcctggtacctgtgggaggtgaagaagcagcgcgccggcgtgctgtgggacgtccccagcccgccgcccgtggggaaggcggagctcgaggacggcgcctaccggatcaagcagcgcgggatcctgggctactcccagatcggcgccggggtgtacaaggagggcacgttccacaccatgtggcacgtcacccgcggggccgtgctgatgcaccgcggcaagcggatcgagcccagctgggccgacgtgaagaaggacctcatctcctacgggggcggctggaagctggagggggagtggaaggagggcgaggaggtccaggtgctggcgctcgagcccgggaagaacccccgcgccgtgcagaccaagcccggcatcttcaagacgaacaccgggaccatcggcgccgtcagcctggacttctcccccggcaccagcgggtcccccatcgtggaccggaagggcaaggtggtcgggctgtacggcaacggcgtggtgacgcgcagcggggcctacgtctccgcgatcgcccagaccgagaagtccatcgaggacaaccccgagatcgaggacgacatcttccggaagaagcgcctcaccatcatggacctgcaccccggcgccgggaagaccaagcggtacctgcccgccatcgtgcgcgaggccatcaagcggggcctgcgcacgctcatcctggcgccgacccgcgtggtcgccgccgagatggaggaggccctgcgggggctccccatccgctaccagacccccgccatccgggcggagcacaccggccgcgagatcgtggacctgatgtgccacgccacgttcaccatgcggctgctcagccccgtgcgcgtcccgaactacaacctgatcatcatggacgaggcccacttcaccgaccccgcctccatcgccgcgcggggctacatcagcacccgcgtggagatgggggaggccgccggcatcttcatgacggccacgccgcccgggtcccgggacccgttcccccagagcaacgcgcccatcatggacgaggagcgcgagatccccgagcggtcctggaacagcggccacgagtgggtgaccgacttcaaggggaagaccgtctggttcgtgccgtccatcaaggccggcaacgacatcgccgcctgcctgcgcaagaacggcaagaaggtgatccagctcagccggaagacgttcgactccgagtacgtcaagacccgcgccaacgactgggacttcgtggtgaccaccgacatcagcgagatgggggcgaacttcaaggccgagcgggtcatcgacccccgccggtgcatgaagcccgtgatcctgacggacggcgaggagcgcgtgatcctggccgggcccatgccggtcacccactccagcgccgcccagcggcgcggccgcatcgggcggaaccccaagaacgagaacgaccagtacatctacatgggcgagcccctcgagaacgacgaggactgcgcgcactggaaggaggccaagatgctgctggacaacatcaacacccccgagggcatcatcccgtccatgttcgagcccgagcgcgagaaggtggacgccatcgacggggagtaccggctccgcggcgaggcccggaagaccttcgtggacctgatgcgccgcggggacctgcccgtctggctcgcctacaaggtggcggccgagggcatcaactacgccgaccgcaagtggtgcttcgacgggatcaagaacaaccagatcctggaggagaacgtggaggtcgagatctggacgaaggagggcgagcggaagaagctgaagccgcgctggctcgacgcccggatctacagcgaccccctggcgctgaaggagttcaaggagttcgccgccggccgcaagtccctcaccctgaacctgatcaccgagatggggcggctccccaccttcatgacgcagaaggcccgcaacgccctggacaacctggcggtgctccacaccgccgaggtgggcgggaaggcctacacccacgccctgagcgagctgcccgagaccctcgagacgctgctgctcctgaccctgctcgccgcggtcaccggcggcatcttcctgttcctgatgtccgggaagggcatcgggaagatgaccctcggcatgtgctgcatcatcaccgccagcatcctgctgtggtacgcccagatccagccgcactggatcgccgcctccatcatcctcgagttcttcctgatcgtgctgctcatccccgagcccgagaagcagcggacgccccaggacaaccagctgacctacgtcgtgatcgcgatcctgaccgtggtcgccgccaccatggccaacgagatggggttcctcgagaagacgaagaaggacctgggcttcggcagcatcaccacccaggagagcgagtccaacatcctggacatcgacctccgcccggccagcgcgtggaccctgtacgccgtggccacgaccttcgtgacccccatgctgcggcactccatcgagaacagctccgtcaacgtgagcctcaccgccatcgcgaaccaggccacggtgctgatggggctgggcaaggggtggcccctctccaagatggacatcggcgtccccctgctggccatcgggtgctacagccaggtgaacccgatcaccctcaccgccgccctgctgctcctggtggcgcactacgccatcatcggccccggcctgcaggccaaggccacccgcgaggcccagaagcgggcggccgccgggatcatgaagaaccccacggtcgacggcatcaccgtgatcgacctcgagcccatcccgtacgaccccaagttcgagaagcagctggggcaggtcatgctgctcatcctgtgcgtcacccaggtgctgatgatgcgcaccacgtgggccctctgcgaggccctgaccctggcgaccggccccatctccaccctctgggaggggaaccccggccggttctggaacacgaccatcgccgtgagcatggccaacatcttccgcggctcctacctggccggggcgggcctcctgttcagcatcatgaagaacaccaccaacacgcgccgggggaccggcaacgtcggcgagaccctgggggagaagtggaagtcccgcctgaacgccctcggcaagagcgagttccagatctacaagaagtccgggatccaggaggtggaccggaccctggccaaggagggcatcaagcgcggggagacggaccaccacgccgtgagccggggctccgccaagctgcgctggttcgtcgagcggaacatggtgaccccggagggcaaggtggtcgacctcgggtgcggccgcgggggctggagctactactgcgggggcctgaagaacgtgcgggaggtgaagggcctgaccaagggcggccccgggcacgaggagcccatccccatgtccacctacggctggaacctcgtccgcctgcagagcggggtggacgtgttcttcacgccgcccgagaagtgcgacaccctgctctgcgacatcggcgagagctcccccaaccccaccatcgaggcgggccggaccctgcgcgtcctgaacctcgtggagaactggctgaacaacaacacccagttctgcatcaaggtgctgaacccgtacatgcccagcgtcatcgagaagatggagacgctccagcggaagtacgggggcgccctggtgcgcaaccccctgtcccggaacagcacccacgagatgtactgggtgtccaacgccaccgggaacatcgtcagctccgtgaacatgatcagccgcatgctgatcaaccggttcaccatgaagcacaagaaggccacgtacgagccggacgtggacctcggctccgggacccgcaacatcggcatcgagagcgagatccccaacctggacatcatcggcaagcggatcgagaagatcaagcaggagcacgagacctcctggcactacgaccaggaccacccctacaagacctgggcctaccacgggagctacgagacgaagcagaccggctccgcgagctccatggtcaacggggtggtgcgcctgctcaccaagccctgggacgtcgtgccgatggtgacccagatggccatgacggacaccacccccttcggccagcagcgcgtcttcaaggagaaggtggacacccggacgcaggagcccaaggagggcaccaagaagctgatgaagatcaccgccgagtggctgtggaaggagctcgggaaggagaagacgccccggatgtgcacgcgggaggagttcacccgcaaggtgcggagcaacgccgccctgggcgcggtcttcaccgacgagaacaagtggaagtccgcccgcgaggccgtggaggacgggcggttctgggagctggtggaccgcgagcggaacctccacctggagggcaagtgcgagacctgcgtctacaacatgatggggaagcgcgagaagaagctgggcgagttcggcaaggccaaggggagccgggcgatctggtacatgtggctcggcgcccgcttcctggagttcgaggccctggggttcctcaacgaggaccactggttctcccggggcaacagcctgagcggggtggagggcgagggcctgcaccgcctcgggtacatcctgcgggaggtcggcaagaaggagggcggcgccatgtacgccgacgacacggcggggtgggacacccgcatcaccctggaggacctcaagaacgaggagatggtgaccaaccacatgaagggcgagcacaagaagctggccgaggccatcttcaagctgacgtaccagaacaaggtggtccgggtgcagcgcccgacgccccggggcaccgtgatggacatcatctcccgcaaggaccagcgggggagcggccaggtcgggacctacggcctcaacacgttcaccaacatggaggcccagctgatccgccagatggagggcgaggggatcttcaagtccatccagcacctgaccgccaccgaggagatcgcggtgcagaactggctcgcccgcgtgggccgggagcgcctgagccggatggccatctccggggacgactgcgtcgtgaagcccatcgacgaccgcttcgccagcgccctgacggcgctcaacgacatgggcaaggtgcggaaggacatccagcagtgggagccctcccgcgggtggaacgactggacccaggtcccgttctgcagccaccacttccacgagctggtgatgaaggacggccgggtgctggtcgtgccctgccgcaaccaggacgagctcatcggccgggcccgcatctcccagggggccggctggagcctgaaggagaccgcctgcctggggaagtcctacgcccagatgtggaccctcatgtacttccaccggcgcgacctgcggctggcggccaacgccatctgcagcgccgtgccctcccactgggtccccaccagccgcacgacctggtccatccacgcgaagcacgagtggatgaccaccgaggacatgctcgccgtgtggaaccgggtgtggatccaggagaacccgtggatggaggacaagacgcccgtcgagagctgggaggaggtgccctacctgggcaagcgcgaggaccagtggtgcgggtccctgatcggcctcaccagccgggccacctgggccaagaacatccagaccgccatcaaccaggtgcgcagcctgatcggcaacgaggggtacacggactacatgccctccatgaagcggttccgccgcgaggaggaggaggcgggcgtcctgtggtga

SEQ ID NO: 9111 - RNA, 9876 nt, synthetic construct
  misc_feature 1..9876: note = derived and/or modified CDS sequence (opt1) from DENV-2__FJ898461__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcgccaccccggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttccagacgaccgtccgcggcgccaagcggatggccatcctgggggacaccgcctgggacttcggcagcctcgggggcgtgttcacctccatcgggaaggccctccaccaggtgttcggcgcgatctacggcgccgccttcagcggggtctcctggacgatgaagatcctgatcggcgtgatcatcacctggatcgggatgaacagccgctccaccagcctgtccgtgagcctggtcctcgtgggcgtggtcaccctgtacctgggggccatggtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacgcagaccgcggggccctggcacctcggcaagctggagatggacttcgacctgtgcgaggggaccaccgtggtcgtgacggaggactgcggcaaccggggccccagcctccgcaccaccaccgccagcgggaagctgatcacggagtggtgctgccggtcctgcaccctgcccccgctccgctaccggggcgaggacgggtgctggtacggcatggagatccgccccctgaaggagaaggaggagaacctggtgaacagcctcgtcaccgccgggcacggccagatcgacaacttctccctgggcgtgctggggatggccctcttcctggaggagatgctgcggacccgcatcggcacgaagcacgcgatcctcctggtggtcgtgagcttcgtgaccctgatcaccgggaacatgtccttccgggacctcggccgcgtcatggtgatggtgggggccaccatgacggacgacatcggcatgggcgtcacctacctggccctgctcgccgccttcaaggtgcgccccaccttcgcggccgggctgctgctccggaagctgaccagcaaggagctgatgatggccacgatcggcatcgccctcctgtcccagagcaccatccccgagaccatcctggagctcaccgacgccctggcgctggggatgatggtgctcaagatcgtccgcaacatggagaagtaccagctggccgtgacgatcatggccatctcctgcgtgccgaacgccgtcatcctgcagaacgcctggaaggtgagctgcaccatcctcgcggccgtctccgtgagccccctgctgctcacctccagccagcagaaggccgactggatccccctggccctgaccatcaagggcctcaaccccacggcgatcttcctgaccaccctgtcccggaccagcaagaagcgctcctggccgctcaacgaggccatcatggccgtgggcatggtcagcatcctggcctccagcctgctcaagaacgacatccccatgacggggcccctggtggccggcgggctgctcaccgtgtgctacgtcctgaccggccggagcgcggacctggagctcgagcgcgccgccgacgtgaagtgggaggaccaggccgagatctccgggagctcccccatcctgagcatcaccatctccgaggacggcagcatgtccatcaagaacgaggaggaggagcagacgctgaccatcctcatccggaccggcctgctggtgatcagcggggtcttcccggtgtccatccccatcaccgccgcggcctggtacctctgggaggtgaagaagcagcgcgccggcgtcctgtgggacgtgcccagcccgccgcccgtggagaaggccgagctggaggacggggcctaccggatcaagcagcgcggcatcctcgggtactcccagatcggcgcgggcgtctacaaggaggggaccttccacacgatgtggcacgtgacccggggcgccgtgctgatgcaccgcgggaagcggatcgagcccagctgggccgacgtcaagaaggacctgatctcctacggcgggggctggaagctcgagggcgagtggaaggagggggaggaggtccaggtgctggccctggagcccggcaagaacccccgcgccgtccagaccaagcccgggatcttcaagaccaacacgggcaccatcggggcggtgagcctcgacttctcccccggcaccagcggctcccccatcgtggaccggaaggggaaggtcgtgggcctgtacgggaacggcgtggtcacccgcagcggcgcctacgtgtccgccatcgcccagacggagaagtccatcgaggacaaccccgagatcgaggacgacatcttccggaagaagcgcctgaccatcatggacctccaccccggggcgggcaagaccaagcggtacctgcccgccatcgtgcgcgaggccatcaagcgggggctgcgcaccctgatcctcgccccgacgcgcgtcgtggccgcggagatggaggaggccctgcggggcctgcccatccgctaccagacccccgccatcaagaccgagcacaccgggcgggagatcgtggacctcatgtgccacgccacgttcaccatgcgcctgctgagccccgtccgggtgccgaactacaacctcatcatcatggacgaggcccacttcaccgaccccgcgtccatcgccgcccgcggctacatcagcacccgggtggagatgggcgaggccgccgggatcttcatgacggcgacgccgcccggctcccgcgacccgttcccccagagcaacgcccccatcatggacgaggagcgggagatccccgagcgctcctggaacagcgggcacgagtgggtcaccgacttcaagggcaagaccgtgtggttcgtgccgtccatcaaggccgggaacgacatcgccgcgtgcctgcggaagaacggcaagaaggtcatccagctgagccgcaagacgttcgactccgagtacgtgaagacccgggccaacgactgggacttcgtggtcaccaccgacatcagcgagatgggcgccaacttcaaggccgagcgcgtgatcgacccccggcgctgcatgaagcccgtgatcctcacggacggggaggagcgggtcatcctggccggccccatgccggtgacccactccagcgcggcccagcgccgggggcgcatcggccgcaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgggagaaggtggacgccatcgacggcgagtaccgcctgcgcggggaggcgcgcaagaccttcgtcgacctcatgcggcgcggcgacctgcccgtgtggctggcctacaaggtggccgccgaggggatcaactacgccgaccggaagtggtgcttcgacggcatcaagaacaaccagatcctcgaggagaacatggaggtcgagatctggacgaaggagggggagcgcaagaagctgaagccgcggtggctggacgcgcgcatctacagcgaccccctcgccctgaaggagttcaaggagttcgccgccggccggaagtccctgaccctcaacctgatcaccgagatgggccgcctgcccaccttcatgacgcagaaggcgcggaacgccctcgacaacctggccgtgctgcacaccgccgaggccgggggccgcgcgtacaaccacgccctcagcgagctgcccgagaccctggagaccctcctgctgctcacgctgctggccaccgtcaccgggggcatcttcctcttcctgatgtccggcaaggggatcggcaagatgaccctggggatgtgctgcatcatcaccgccagcatcctcctgtggtacgcccagatccagccgcactggatcgcggcctccatcatcctggagttcttcctcatcgtgctgctgatccccgagcccgagaagcagcggacgccccaggacaaccagctcacctacgtggtcatcgccatcctgaccgtggtggccgccaccatggcgaacgagatgggcttcctggagaagacgaagaaggacctcgggctgggcagcatcaccacccaggagccggagagcaacatcctggacatcgacctccgccccgcctccgcctggaccctgtacgccgtcgccacgaccttcgtgacccccatgctgcggcacagcatcgagaactccagcgtgaacgtctccctcaccgcgatcgccaaccaggccacggtgctgatgggcctggggaagggctggcccctcagcaagatggacatcggggtgccgctgctggccatcggctgctactcccaggtcaaccccatcaccctcaccgcggccctgctgctcctggtggcccactacgccatcatcgggcccggcctgcaggccaaggcgacccgcgaggcccagaagcgggccgccgccggcatcatgaagaaccccacggtggacgggatcaccgtcatcgacctcgagccgatcccctacgaccccaagttcgagaagcagctgggccaggtgatgctgctcatcctgtgcgtgacccaggtcctgatgatgcgcaccacgtgggcgctctgcgaggccctgaccctggccaccgggcccatcagcaccctctgggagggcaacccggggcggttctggaacacgaccatcgccgtgtccatggccaacatcttccgcggcagctacctggcgggcgccgggctcctgttctccatcatgaagaacaccaccaacacgcgccggggcaccgggaacatcggcgagaccctgggcgagaagtggaagtcccgcctgaacgccctcgggaagtccgagttccagatctacaagaagtccggcatccaggaggtggaccggaccctggccaaggaggggatcaagcgcggcgagacggaccaccacgcggtctcccgggggagcgccaagctgcgctggttcgtggagcggaacatggtgacccccgagggcaaggtcgtggacctcggctgcgggcgcggcgggtggtcctactactgcggcgggctgaagaacgtgcgggaggtcaagggcctgaccaagggcgggcccggccacgaggagcccatcccgatgagcacctacgggtggaacctcgtgcgcctgcagtccggcgtggacgtcttcttcacgccgcccgagaagtgcgacaccctgctctgcgacatcggggagagcagccccaacccgaccatcgaggccggccggaccctgcgcgtgctgaacctcgtggagaactggctgaacaacaacacccagttctgcatcaaggtcctgaacccctacatgccctccgtgatcgagaagatggagacgctccagcggaagtacggcggggccctggtgcgcaacccgctgagccggaactccacccacgagatgtactgggtcagcaacgccaccggcaacatcgtgtccagcgtgaacatgatctcccgcatgctgatcaaccggttcaccatgaagcacaagaaggcgacgtacgagcccgacgtcgacctcgggagcggcacccgcaacatcgggatcgagtccgagatccccaacctggacatcatcggcaagcggatcgagaagatcaagcaggagcacgagaccagctggcactacgaccaggaccacccctacaagacctgggcctaccacggctcctacgagacgaagcagaccgggagcgcctccagcatggtgaacggcgtggtccgcctgctcaccaagccgtgggacgtggtgcccatggtcacccagatggccatgacggacaccacccccttcgggcagcagcgcgtgttcaaggagaaggtggacacccggacgcaggagcccaaggagggcaccaagaagctgatgaagatcaccgccgagtggctgtggaaggagctcggcaagaagaagaccccgcgcatgtgcacgcgggaggagttcacccgcaaggtccggtccaacgcggccctgggggccatcttcaccgacgagaacaagtggaagtccgcccgcgaggccgtggaggacggccggttctgggagctggtggaccgcgagcggaacctccacctggaggggaagtgcgagacctgcgtctacaacatgatgggcaagcgcgagaagaagctgggggagttcggcaaggcgaagggctcccgggccatctggtacatgtggctcggggcccgcttcctggagttcgaggccctgggcttcctcaacgaggaccactggttcagccgggggaactccctgagcggcgtggagggggagggcctgcaccgcctcggctacatcctgcgggacgtcgggaagaaggagggcggggcgatgtacgccgacgacacggccggctgggacacccgcatcaccctggaggacctcaagaacgaggagatggtgaccaaccacatgaagggggagcacaagaagctggccgaggccatcttcaagctgacgtaccagaacaaggtggtccgggtgcagcgccccacgccccggggcaccgtgatggacatcatcagccgccgggaccagcgcggctccgggcaggtcggcacctacgggctcaacacgttcaccaacatggaggcgcagctgatccgccagatggagggcgagggcatcttcaagagcatccagcacctgaccgccaccgaggagatcgccgtgcagaactggctcgcccggctggggcgcgagcggctgtcccgcatggccatcagcggcgacgactgcgtggtcaagcccatcgacgaccggttcgcgtccgccctcacggccctgaacgacatggggaaggtgcgcaaggacatccagcagtgggagccgagccggggctggaacgactggacccaggtgcccttctgctcccaccacttccacgagctggtcatgaaggacgggcgcgtgctcgtggtcccctgccggaaccaggacgagctgatcggccgcgcccggatcagccagggcgccgggtggtccctgaaggagaccgcgtgcctcggcaagagctacgcccagatgtggaccctgatgtacttccaccgccgggacctgcgcctcgccgccaacgccatctgctccgcggtgcccagccactgggtgccgacctcccggacgacctggagcatccacgccaagcacgagtggatgaccaccgaggacatgctggccgtctggaaccgcgtgtggatccaggagaacccctggatggaggacaagacgcccgtggagtcctgggaggaggtcccctacctggggaagcgggaggaccagtggtgcggcagcctcatcgggctgacctcccgcgccacctgggcgaagaacatccagaccgccatcaaccaggtgcggagcctgatcggcaacgaggagtacacggactacatgccgagcatgaagcgcttccgccgggaggaggaggaggccggcgtgctctggtga

SEQ ID NO: 9112 - RNA, 9876 nt, synthetic construct
  misc_feature 1..9876: note = derived and/or modified CDS sequence (opt1) from DENV-2__FJ024473__SS-prME
  source 1..9876: mol_type = other RNA
accgccggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcacctccaaccgggacttcgtcgagggcgtgagcgggggctcctgggtggacatcgtcctcgagcacgggagctgcgtgaccaccatggccaagaacaagcccaccctggacttcgagctgatcaagaccgaggccaagcagcccgccaccctccgcaagtactgcatcgaggccaagctgaccaacaccaccacggagtcccggtgcccgacccagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacacgatcgtcatcacgccccacagcggggaggagcacgccgtgggcgacgacaccgggaagcacggcaaggagatcaagatcaccccgcagtccagcatcaccgaggccgagctgacggggtacggcaccgtgaccatggagtgcagcccccggaccggcctcgacttcaacgagatggtcctgctgcagatggaggacaaggcctggctcgtgcaccggcagtggttcctggacctgcccctcccctggctgccgggggccgacacgcagggcagcaactggatccagaaggagaccctggtgaccttcaagaacccccacgcgaagaagcaggacgtcgtggtcctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacgcagcacgggaccatcgtgatccgcgtccagtacgagggcgacggctccccctgcaagatccccttcgagatcaccgacctggagaagcggcacgtgctcgggcgcctgatcaccgtgaacccgatcgtcatcgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcgtgatcacctggatcgggatgaacagccgctccaccagcctgtccgtgagcctggtcctcgtgggcgtggtcaccctgtacctgggggccatggtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacaccaaggggatcatgcaggccggcaagcggtacctgcgcccgcagcccacggagctgaagtacagctggaagacctggggcaaggcgaagatgctctccaccgagagccacaaccagaccttcctgatcgacgggcccgagacggccgagtgcccgaacaccaaccgggcctggaactccctggaggtggaggactacggcttcggggtgttcaccaccaacatctggctcaagctgcgcgagaagcaggacgtcttctgcgacagcaagctgatgtccgccgccatcaaggacaaccgggcggtgcacgccgacatgggctactggatcgagagcgccctcaacgacacctggaagatggagaaggcctccttcatcgaggtcaagagctgccactggcccaagtcccacacgctgtggagcaacggcgtgctggagtccgagatgatcatccccaagaacttcgccgggcccgtgagccagcacaactaccgcccgggctaccacacccagaccgcggggccctggcacctcggcaagctggagatggacttcgacttctgcgaggggaccacggtggtcgtgaccgaggactgcggcaaccggggcccctccctgcgcaccaccacggccagcgggaagctcatcaccgagtggtgctgccggagctgcaccctgcccccgctgcgctaccggggcgaggacgggtgctggtacggcatggagatccgccccctcaaggagaaggaggagaacctggtgaactccctggtcaccgccgggcacggccagatcgacaacttcagcctcggcgtgctggggatggccctgttcctcgaggagatgctgcggacgcgcgtgggcaccaagcacgcgatcctgctcgtcgccgtgtccttcgtgaccctgatcaccgggaacatgagcttccgggacctgggccgcgtcatggtgatggtgggggccacgatgaccgacgacatcggcatgggcgtcacctacctcgccctgctggccgcgttcaaggtgcgccccaccttcgccgccgggctcctgctgcggaagctcacgtccaaggagctgatgatggccaccatcggcatcaccctgctcagccagtccaccatccccgagacgatcctggagctgaccgacgccctcgcgctggggatgatggtgctgaagatcgtccgcaacatggagaagtaccagctcgccgtgaccatcatggccatcagctgcgtgccgaacgccgtcatcctgcggaacgcctggaaggtgtcctgcaccatcctggcggccgtcagcgtgagccccctgctgctgacgagctcccagcagaaggccgactggatccccctcgccctgaccatcaagggcctgaaccccaccgcgatcttcctcaccacgctgagccgcacctccaagaagcggagctggccgctgaacgaggccatcatggccgtgggcatggtctccatcctcgccagctccctgctgaagaacgacatccccatgaccgggcccctcgtggccggcgggctgctgaccgtgtgctacgtcctcacgggccgcagcgcggacctggagctggagcgggccgccgacgtgaagtgggaggaccaggccgagatcagcgggtccagccccatcctctccatcaccatcagcgaggacggctccatgagcatcaagaacgaggaggaggagaccaccctgaccatcctgatccgcacgggcctcctggtgatctccggggtcttcccggtgagcatccccatcaccgccgcggcctggtacctgtgggaggtgaagaagcagcgggccggcgtcctctgggacgtgcccagcccgcccctggtggggaaggccgagctggaggacggcgcctaccgcatcaagcagcgggggatcctcggctacagccagatcggcgcgggggtctacaaggagggcaccttccacaccatgtggcacgtgacgcgcggggccgtgctgatgcaccggggcaagcgcatcgagccctcctgggccgacgtcaagaaggacctgatcagctacgggggcggctggaagctcgagggggagtggaaggagggcgaggaggtccaggtgctggccctggagcccgggaagaacccccgggccgtccagaccaagcccggcatcttcaagaccaacaccgggacgatcggcgcggtgtccctcgacttcagccccggcacctccgggagccccatcgtggaccgcaagggcaaggtcgtggggctgtacggcaacggcgtggtcacccggtccggggcctacgtgagcgccatcgcccagaccgagaagtccatcgaggacaacccggagatcgaggacgacatcttccgcaagaagcggctgacgatcatggacctccaccccggcgcggggaagaccaagcgctacctgcccgccatcgtgcgggaggccatcaagcgcggcctgcgcaccctgatcctcgcccccacccgggtcgtggccgcggagatggaggaggccctgcgcgggctgccgatccggtaccagacgcccgccatcaaggccgagcacaccggccgcgagatcgtggacctcatgtgccacgccaccttcaccatgcggctgctgagccccgtccgcgtgcccaactacaacctcatcatcatggacgaggcgcacttcacggacccggccagcatcgccgcccggggctacatctccacccgcgtggagatgggggaggccgcgggcatcttcatgaccgccacgccgcccgggagccgggaccccttcccgcagtccaacgcccccatcatggacgaggagcgcgagatccccgagcggagctggaactccggccacgagtgggtcacggacttcaaggggaagaccgtgtggttcgtgcccagcatcaaggccggcaacgacatcgcggcctgcctgcgcaagaacggcaagaaggtcatccagctgtcccggaagaccttcgacagcgagtacgtgaagacccgcgccaacgactgggacttcgtggtcacgaccgacatctccgagatgggggccaacttcaaggccgagcgggtgatcgacccgcgccggtgcatgaagcccgtgatcctcaccgacggcgaggagcgcgtcatcctggcggggcccatgcccgtgacccacagctccgccgcccagcggcgcggccgcatcgggcggaacccgaagaacgagaacgaccagtacatctacatgggcgagcccctggagaacgacgaggactgcgcccactggaaggaggccaagatgctcctggacaacatcaacacgcccgagggcatcatccccagcatgttcgagccggagcgcgagaaggtggacgcggtcgacggggagtaccggctgcgcggcgaggcccggaagaccttcgtggacctcatgcgccgcggggacctgcccgtgtggctggcctacaaggtcgccgccgagggcatcaactacgcggaccgcaagtggtgcttcgacgggatcaagaacaaccagatcctcgaggagaacgtggaggtcgagatctggaccaaggagggcgagcggaagaagctgaagccccgctggctggacgcccggatctactccgacccgctcgccctgaaggagttcaaggagttcgccgcgggccgcaagagcctgaccctcaacctgatcacggagatggggcggctgcccaccttcatgacccagaaggcccgcaacgccctcgacaacctggccgtgctgcacaccgccgaggcgggcgggcgggcctacaaccacgccctctccgagctgcccgagacgctggagaccctcctgctgctcaccctgctggccaccgtgaccggcggcatcttcctcttcctgatgagcgggaagggcatcgggaagatgacgctgggcatgtgctgcatcatcaccgcctccgtcctcctgtggtacgcgcagatccagccccactggatcgccgccagcatcatcctggagttcttcctcatcgtgctgctgatcccggagcccgagaagcagcgcacgccccaggacaaccagctcacctacgtggtcatcgccatcctgacggtggtggccgcgaccatggccaacgagatggggttcctggagaagaccaagaaggacctcggcctgggctccatcaccacgcaggagagcgagagcaacatcctggacatcgacctccggcccgcctccgcctggaccctgtacgccgtcgcgaccaccttcgtgacgccgatgctgcgccacagcatcgagaactccagcgtgaacgtctccctcaccgccatcgccaaccaggccaccgtgctgatggggctgggcaaggggtggcccctcagcaagatggacatcggcgtgcccctgctggcgatcgggtgctactcccaggtcaaccccatcaccctcacggccgccctgctgctcctggtggcccactacgccatcatcggcccgggcctgcaggcgaaggccacccgggaggcccagaagcgcgccgccgcggggatcatgaagaaccccaccgtggacggcatcaccgtcatcgacctcgagcccatcccctacgacccgaagttcgagaagcagctgggccaggtgatgctgctcatcctgtgcgtgacgcaggtcctgatgatgcggaccacctgggccctctgcgaggccctgaccctggccacgggccccatcagcaccctctgggaggggaaccccggccgcttctggaacaccaccatcgccgtgtccatggcgaacatcttccgcggcagctacctggccggggccggcctcctcttctccatcatgaagaacacgaccaacacccggcgcgggaccggcaacatcggcgagacgctgggggagaagtggaagtcccggctgaacgccctcggcaagtccgagttccagatctacaagaagtccgggatccaggaggtggaccgcaccctggcgaaggagggcatcaagcgcggggagaccgaccaccacgccgtctcccgcggcagcgccaagctgcggtggttcgtggagcgcaacatggtgacccccgagggcaaggtcgtggacctcgggtgcggccgcggcgggtggtcctactactgcggcgggctgaagaacgtgcgcgaggtcaaggggctgacgaagggcgggccggggcacgaggagcccatccccatgagcacctacggctggaacctcgtgcggctgcagtccggggtggacgtcttcttcacgccgcccgagaagtgcgacaccctgctctgcgacatcggcgagagcagccccaaccccaccatcgaggccggccgcacgctgcgggtgctgaacctcgtggagaactggctgaacaacaacacccagttctgcatcaaggtcctgaacccctacatgccctccgtgatcgagaagatggagaccctccagcgcaagtacgggggcgccctggtgcggaaccccctgagccgcaactccacccacgagatgtactgggtcagcaacgcgacggggaacatcgtgtccagcgtgaacatgatctcccggatgctgatcaaccgcttcaccatgaagcacaagaaggccacctacgaggccgacgtcgacctcggcagcgggacccggaacatcggcatcgagtccgagatccccaacctggacatcatcggcaagcgcatcgagaagatcaagcaggagcacgagacgagctggcactacgaccaggaccacccgtacaagacctgggcctaccacgggtcctacgagaccaagcagaccggcagcgcctccagcatggtgaacggggtggtccgcctgctcacgaagccctgggacgtggtgcccatggtcacccagatggcgatgaccgacaccacgcccttcggccagcagcgggtgttcaaggagaaggtggacacccgcacccaggagccgaaggagggcaccaagaagctgatgcggatcacggccgagtggctgtggaaggagctcgggaagaagaagacgccccggatgtgcacccgggaggagttcacccgcaaggtccggtccaacgccgccctgggcgccatcttcacggacgagaacaagtggaagtccgcgcgcgaggccgtggaggacgggcggttctgggagctggtcgaccgcgagcggaacctccacctggagggcaagtgcgagacctgcgtgtacaacatgatggggaagcgcgagaagaagctgggcgagttcggcaaggccaaggggtcccgggccatctggtacatgtggctcggcgcgcgcttcctggagttcgaggccctggggttcctcaacgaggaccactggttcagccggggcaactccctgagcggggtggagggcgagggcctgcaccgcctcgggtacatcctgcgggacgtcggcaagaaggagggcggcgccatgtacgccgacgacaccgccgggtgggacacccgcatcacgctggaggacctcaagaacgaggagatggtgaccaaccacatgaagggcgagcacaagaagctggcggaggccatcttcaagctgacctaccagaacaaggtggtccgggtgcagcgccccacgccccggggcacggtgatggacatcatcagccgccgcgaccagcgggggtccggccaggtcgggacctacggcctcaacaccttcaccaacatggaggcccagctgatccgccagatggagggcgaggggatcttcaagagcatccagcacctgacggccaccgaggagatcgccgcgcagaactggctcgcccgggtgggccgcgagcggctgtcccgcatggccatcagcggggacgactgcgtggtcaagccgatcgacgaccggttcgcctccgccctgaccgcgctcaacgacatgggcaaggtgcgcaaggacatccagcagtgggagcccagccgggggtggaacgactggacccaggtgcccttctgctcccaccacttccacgagctggtcatgaaggacggccgcgtgctggtggtcccctgccggaaccaggacgagctcatcggccgcgcccggatcagccagggggccggctggtccctgaaggagaccgcctgcctgggcaagagctacgcccagatgtggacgctcatgtacttccaccgccgggacctgcgcctggcggccaacgccatctgctccgccgtgccgagccactgggtgcccacctcccggaccacctggagcatccacgcgaagcacgagtggatgacgaccgaggacatgctcgccgtctggaaccgcgtgtggatccaggagaacccctggatggaggacaagacccccgtggagtcctgggaggaggtcccgtacctgggcaagcgggaggaccagtggtgcgggagcctgatcggcctcacctcccgcgccacgtgggccaagaacatccagaccgccatcaaccaggtgcgcagcctgatcggcaacgaggagtacaccgactacatgcccagcatgaagcggttccgccgggaggaggaggaggcgggggtgctgtggtga

SEQ ID NO: 9113 - RNA, 9876 nt, synthetic construct
  misc_feature 1..9876: note = derived and/or modified CDS sequence (opt1) from DENV-2__FJ024474__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgaagcagaacgagcccgaggacatcgactgctggtgcaacagcaccagcacctgggtcacctacgggacctgcaccaccacgggcgagcaccgccgggagaagcgctccgtggccctggtgccccacgtcgggatgggcctcgagacccggaccgagacctggatgagcagcgagggggcctggaagcacgtgcagcgcatcgagacctggatcctgcggcacccgggcttcaccatcatggccgcgatcctggcctacaccatcgggaccacgcacttccagcgcgccctcatcttcatcctgctgaccgccgtggcgcccagcatgaccatgcggtgcatcggcatctccaaccgcgacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccggaagtactgcatcgaggccaagctgacgaacaccaccaccgagtcccgctgcccgacgcagggcgagcccagcctgaacgaggagcaggacaagcggttcatctgcaagcactccatggtggaccgcggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacatcgggaagcacggcaaggagatcaagatcaccccgcagtccagcatcaccgaggccgagctgaccgggtacggcaccgtgacgatggagtgcagcccccggaccggcctcgacttcaacgagatggtcctgctgcagatggaggacaaggcctggctcgtgcaccgccagtggttcctggacctgcccctcccctggctgccgggggccgacacccagggcagcaactggatccagaaggagaccctggtgacgttcaagaacccccacgcgaagaagcaggacgtcgtggtcctcgggtcccaggagggcgccatgcacaccgccctgaccggggccaccgagatccagatgagcagcggcaacctcctgttcacgggccacctgaagtgccggctgcgcatggacaagctccagctgaaggggatgtcctacagcatgtgcaccggcaagttcaagatcgtgaaggagatcgccgagacccagcacgggaccatcgtgatccgggtccagtacgagggcgacggctccccctgcaagatccccttcgagatcacggacctggagaagcgccacgtgctcgggcggctgatcaccgtgaacccgatcgtcatcgagaaggacagccccgtgaacatcgaggcggagccgcccttcggcgactcctacatcatcatcggggtggagccgggccagctgaagctcaactggttcaagaaggggagctccatcggccagatgttcgagaccaccatgcgcggcgccaagcgcatggccatcctgggggacacggcctgggacttcggcagcctcggcggggtcttcacctccatcgggaaggccctccaccaggtgttcggggcgatctacggcgccgccttcagcggggtgtcctggaccatgaagatcctgatcggcgtcgtgatcacctggatcgggatgaacagccggtccacgagcctgtccgtgagcctggtcctcgtgggcgtggtcaccctgtacctgggggccatggtgcaggcggactccggctgcgtggtcagctggaagaacaaggagctcaagtgcggctccgggatcttcatcaccgacaacgtgcacacctggacggagcagtacaagttccagcccgagagccccagcaagctggcctccgccatccagaaggcccacgaggagggcatctgcgggatccgcagcgtgacccggctggagaacctcatgtggaagcagatcacccccgagctgaaccacatcctgtccgagaacgaggtcaagctcaccatcatgacgggcgacaccaaggggatcatgcaggccggcaagcgctacctgcggccgcagcccaccgagctgaagtacagctggaagacctggggcaaggcgaagatgctctccacggagagccacaaccagaccttcctgatcgacgggcccgagaccgccgagtgcccgaacaccaaccgcgcctggaactccctggaggtggaggactacggcttcggggtgttcacgaccaacatctggctcaagctgcgggagaagcaggacgtcttctgcgacagcaagctgatgtccgccgccatcaaggacaaccgcgcggtgcacgccgacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagaacttcgccgggcccgtgagccagcacaactaccggccgggctaccacacccagacggcggggccctggcacctcggcaagctggagatggacttcgacttctgcgaggggaccaccgtggtcgtgaccgaggactgcggcaaccgcggcccctccctgcggacgaccaccgccagcgggaagctcatcaccgagtggtgctgccgcagctgcacgctgcccccgctgcggtaccgcggcgaggacgggtgctggtacggcatggagatccggcccctcaaggagaaggaggagaacctggtgaactccctggtcaccgccgggcacggccagatcgacaacttcagcctcggcgtgctggggatggccctgttcctcgaggagatgctgcgcacccgggtgggcaccaagcacgcgatcctgctcgtcgccgtgtccttcgtgacgctgatcaccgggaacatgagcttccgcgacctgggccgggtcatggtgatggtgggggccaccatgaccgacgacatcggcatgggcgtcacgtacctcgccctgctggccgcgttcaaggtgcgccccaccttcgccgccgggctcctgctgcgcaagctcacctccaaggagctgatgatggccaccatcggcatcacgctgctcagccagtccaccatccccgagaccatcctggagctgaccgacgccctcgcgctggggatgatggtgctgaagatcgtccggaacatggagaagtaccagctcgccgtgacgatcatggccatcagctgcgtgccgaacgccgtcatcctgcgcaacgcctggaaggtgtcctgcaccatcctggcggccgccagcgtcagccccctcctgctgaccagctcccagcagaaggccgactggatccccctcgcgctgaccatcaagggcctgaaccccacggccatcttcctcaccaccctgagccggacctccaagaagcgcagctggccgctgaacgaggccatcatggccgtgggcatggtgtccatcctcgccagctccctgctgaagaacgacatccccatgacggggcccctcgtcgcgggcgggctgctgaccgtgtgctacgtgctcaccggccggagcgccgacctggagctggagcgcgccgccgacgtcaagtgggaggaccaggccgagatcagcgggtccagccccatcctctccatcaccatcagcgaggacggctccatgagcatcaagaacgaggaggaggagcagatcctgacgatcctgatccggaccggcctcctggtgatctccggggtgttcccggtcagcatccccatcaccgcggccgcctggtacctgtgggaggtgaagaagcagcgcgccggcgtgctctgggacgtccccagcccgccgcccgtggggaaggccgagctggaggacggcgcgtaccggatcaagcagcgcgggatcctgggctacagccagatcggcgccggggtgtacaaggagggcaccttccacaccatgtggcacgtcacgcgcggggccgtgctcatgcaccgcggcaagcggatcgagccctcctgggccgacgtgaagaaggacctgatcagctacgggggcggctggaagctggagggggagtggaaggagggcgaggaggtccaggtgctcgccctggagcccgggaagaacccccgcgcggtgcagaccaagcccggcatcttcaagaccaacaccgggacgatcggcgccgtctccctggacttcagccccggcacctccgggagccccatcgtggaccggaagggcaaggtggtcgggctctacggcaacggcgtggtgacccgctccggggcctacgtcagcgccatcgcgcagaccgagaagtccatcgaggacaaccccgagatcgaggacgacatcttccggaagaagcgcctgacgatcatggacctgcaccccggcgccgggaagaccaagcggtacctccccgccatcgtgcgcgaggccatcaagcggggcctgcgcaccctgatcctggccccgacccgcgtggtcgcggccgagatggaggaggccctccgggggctgcccatccgctaccagacgcccgccatcaaggccgagcacaccggccgggagatcgtggacctgatgtgccacgcgaccttcaccatgcgcctcctgagccccgtgcgggtcccgaactacaacctgatcatcatggacgaggcccacttcacggaccccgccagcatcgccgcccgcggctacatctccacccgggtggagatgggggaggcggccggcatcttcatgaccgccacgccgcccgggagccgcgacccgttcccccagtccaacgcccccatcatggacgaggagcgggagatccccgagcgcagctggaactccggccacgagtgggtgacggacttcaaggggaagaccgtctggttcgtgccgagcatcaaggcgggcaacgacatcgccgcctgcctccggaagaacggcaagaaggtgatccagctgtcccgcaagaccttcgacagcgagtacgtcaagacccgggccaacgactgggacttcgtggtgacgaccgacatctccgagatgggggccaacttcaaggcggagcgcgtcatcgacccccggcgctgcatgaagcccgtgatcctgacccacggcgaggagcgggtgatcctcgccgggcccatgccggtcacccacagctccgccgcccagcgccggggccgcatcgggcgcaaccccaagaacgagaacgaccagtacatctacatgggcgagcccctggagaacgacgaggactgcgcccactggaaggaggcgaagatgctgctcgacaacatcaacacgcccgagggcatcatcccgagcatgttcgagcccgagcgggagaaggtggacgccgtggacggggagtaccgcctgcggggcgaggcccgcaagaccttcgtcgacctgatgcggcgcggggacctccccgtgtggctggcctacaaggtggccgcggagggcatcaactacgccgaccggaagtggtgcttcgacgggatcaagaacaaccagatcctggaggagaacgtcgaggtggagatctggaccaaggagggcgagcgcaagaagctcaagccgcggtggctggacgcccgcatctactccgaccccctggccctcaaggagttcaaggagttcgcggccggccggaagtccctgaccctgaacctcatcacggagatggggcgcctgcccaccttcatgacccagaaggcccggaacgccctggacaacctcgccgtcctgcacaccgcggaggccggcgggcgcgcctacaaccacgccctgtccgagctccccgagacgctggagaccctgctcctgctgaccctcctggccaccgtgacgggcggcatcttcctgttcctcatgagcgggaagggcatcgggaagatgaccctgggcatgtgctgcatcatcaccgcgtccgtgctgctctggtacgcccagatccagccgcactggatcgccgccagcatcatcctggagttcttcctgatcgtcctcctgatccccgagcccgagaagcagcggacgccccaggacaaccagctgacctacgtggtgatcgccatcctcacggtcgtggcggccaccatggccaacgagatggggttcctggagaagaccaagaaggacctgggcctcggctccatcaccacgcaggagagcgagagcaacatcctggacatcgacctgcgcccggcctccgcctggaccctctacgcggtggccaccaccttcgtcacgcccatgctgcggcacagcatcgagaactccagcgtgaacgtgtccctgaccgccatcgccaaccaggcgaccgtcctcatggggctgggcaaggggtggcccctgagcaagatggacatcggcgtgcccctcctggccatcgggtgctactcccaggtgaacccgatcaccctgacggccgccctcctgctgctcgtcgcccactacgcgatcatcggccccggcctgcaggccaaggccacccgcgaggcccagaagcgggccgcggccgggatcatgaagaaccccaccgtggacggcatcaccgtgatcgacctggagcccatcccgtacgaccccaagttcgagaagcagctcgggcaggtcatgctgctgatcctctgcgtgacccaggtcctgatgatgcgcaccacctgggccctgtgcgaggccctcaccctggccacgggccccatcagcaccctgtgggaggggaaccccggccggttctggaacaccaccatcgcggtctccatggccaacatcttccgcggcagctacctcgccggggccggcctgctgttctccatcatgaagaacacgaccaacacccgccgggggaccggcaacatcggcgagacgctcggggagaagtggaagtcccgcctgaacgcgctgggcaagtccgagttccagatctacaagaagtccgggatccaggaggtggaccggaccctcgccaaggagggcatcaagcgcggggagaccgaccaccacgccgtgtcccggggcagcgccaagctgcgctggttcgtcgagcggaacatggtgaccccggagggcaaggtggtcgacctggggtgcggccgcgggggctggtcctactactgcgggggcctcaagaacgtgcgggaggtgaagggcctgacgaagggcgggcccgggcacgaggagcccatccccatgagcacctacggctggaacctggtccgcctccagtccggggtggacgtgttcttcaccccgcccgagaagtgcgacaccctgctgtgcgacatcggcgagagcagccccaaccccacgatcgaggccggccggaccctccgcgtcctgaacctggtggagaactggctcaacaacaacacccagttctgcatcaaggtgctgaacccgtacatgccctccgtcatcgagaagatggagaccctgcagcggaagtacgggggcgcgctcgtgcgcaaccccctgagccggaactccacccacgagatgtactgggtgagcaacgccacggggaacatcgtctccagcgtgaacatgatctcccgcatgctgatcaaccggttcaccatgaagcacaagaaggccacctacgagccggacgtggacctgggcagcgggacccgcaacatcggcatcgagtccgagatccccaacctcgacatcatcggcaagcggatcgagaagatcaagcaggagcacgagacgagctggcactacgaccaggaccacccctacaagacctgggcctaccacgggtcctacgagaccaagcagaccggcagcgcctccagcatggtcaacggggtggtgcgcctgctgacgaagccctgggacgtcgtgccgatggtgacccagatggcgatgaccgacaccacgcccttcggccagcagcgcgtcttcaaggagaaggtggacacccggacccaggagcccaaggagggcaccaagaagctcatgcgcatcacggccgagtggctgtggaaggagctggggaagaagaagacgccccggatgtgcacccgcgaggagttcacccggaaggtgcgctccaacgccgccctcggcgccatcttcacggacgagaacaagtggaagtccgcgcgggaggccgtcgaggacgggcgcttctgggagctggtggaccgggagcgcaacctgcacctcgagggcaagtgcgagacctgcgtctacaacatgatggggaagcgggagaagaagctgggcgagttcggcaaggccaaggggtcccgcgccatctggtacatgtggctgggcgcgcggttcctcgagttcgaggccctggggttcctgaacgaggaccactggttcagccgcggcaactccctcagcggggtggagggcgagggcctgcaccggctggggtacatcctccgcgacgtgggcaagaaggagggcggcgccatgtacgccgacgacaccgccgggtgggacacccggatcacgctggaggacctgaagaacgaggagatggtcaccaaccacatgaagggcgagcacaagaagctcgcggaggccatcttcaagctgacctaccagaacaaggtggtgcgcgtccagcggccgacgccccggggcacggtgatggacatcatcagccggcgcgaccagcgcgggtccggccaggtggggacctacggcctgaacaccttcaccaacatggaggcccagctcatccggcagatggagggcgaggggatcttcaagagcatccagcacctgacggccaccgaggagatcgccgcgcagaactggctggcccgcgtcggccgggagcgcctctcccggatggccatcagcggggacgactgcgtggtgaagcccatcgacgaccgcttcgcctccgccctgaccgcgctgaacgacatgggcaaggtccggaaggacatccagcagtgggagcccagccgcgggtggaacgactggacccaggtgccgttctgctcccaccacttccacgagctcgtgatgaaggacggccgggtcctggtggtgccctgccgcaaccaggacgagctgatcggccgggcccgcatcagccagggggccggctggtccctcaaggagacggcctgcctgggcaagagctacgcccagatgtggaccctgatgtacttccaccggcgcgacctccggctggcggccaacgccatctgctccgccgtccccagccactgggtgcccacctcccgcaccacctggagcatccacgcgaagcacgagtggatgacgaccgaggacatgctggccgtgtggaaccgggtctggatccaggagaacccgtggatggaggacaagacccccgtggagtcctgggaggaggtgccctacctcggcaagcgcgaggaccagtggtgcgggagcctgatcggcctgacctcccgggccacgtgggccaagaacatccagaccgccatcaaccaggtccgcagcctcatcggcaacgaggagtacaccgactacatgcccagcatgaagcgcttccggcgcgaggaggaggaggcgggggtgctgtggtga

SEQ ID NO: 9114 - RNA, 9876 nt, synthetic construct
  misc_feature 1..9876: note = derived and/or modified CDS sequence (opt1) from DENV-2__FJ024475__SS-prME
  source 1..9876: mol_type = other RNA
accgccggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccggaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcgacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcatcgagaaggacagccccgtgaacatcgaggcggagccgcccttcggcgactcctacatcatcatcggggtggagccgggccagctgaagctcaactggttcaagaaggggagctccatcggccagatgttcgagaccacgatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggaccatgaagatcctgatcggcgtcgtgatcacgtggatcgggatgaacagccgctccaccagcctgtccgtgagcctggtcctcgtgggcgtggtcaccctgtacctgggggccatggtgcaggcggactccggctgcgtggtcagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtgacccgcctggagaacctcatgtggaagcagatcacccccgagctgaaccacatcctgtccgagaacgaggtcaagctcacgatcatgaccggcgacaccaaggggatcatgcaggccggcaagcggtacctgcgcccgcagcccaccgagctgaagtacagctggaagacgtggggcaaggcgaagatgctctccaccgagagccacaaccagaccttcctgatcgacgggcccgagaccgccgagtgcccgaacacgaaccgggcctggaactccctggaggtggaggactacggcttcggggtgttcaccaccaacatctggctcaagctgcgcgagaagcaggacgtcttctgcgacagcaagctgatgtccgccgccatcaaggacaaccgggcggtgcacgccgacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagaacttcgccgggcccgtgagccagcacaactaccgcccgggctaccacacgcagaccgcggggccctggcacctcggcaagctggagatggacttcgacttctgcgaggggaccaccgtggtcgtgacggaggactgcggcaaccggggcccctccctgcgcaccaccaccgccagcgggaagctcatcacggagtggtgctgccggagctgcaccctgcccccgctgcgctaccggggcgaggacgggtgctggtacggcatggagatccgccccctcaaggagaaggaggagaacctggtgaactccctggtcaccgccgggcacggccagatcgacaacttcagcctcggcgtgctggggatggccctgttcctcgaggagatgctgcggacccgcgtgggcacgaagcacgcgatcctgctcgtcgccgtgtccttcgtgaccctgatcaccgggaacatgagcttccgggacctgggccgcgtcatggtgatggtgggggccaccatgacggacgacatcggcatgggcgtcacctacctcgccctgctggccgcgttcaaggtgcgccccaccttcgccgccgggctcctgctgcggaagctcacctccaaggagctgatgatggccacgatcggcatcaccctgctcagccagtccaccatccccgagaccatcctggagctgacggacgccctcgcgctggggatgatggtgctgaagatcgtccgcaacatggagaagtaccagctcgccgtgaccatcatggccatcagctgcgtgccgaacgccgtcatcctgcggaacgcctggaaggtgtcctgcaccatcctggcggccgtcagcgtgagccccctcctgctgaccagctcccagcagaaggccgactggatccccctcgccctgacgatcaagggcctgaaccccaccgcgatcttcctcaccaccctgagccgcacgtccaagaagcggagctggccgctgaacgaggccatcatggccgtgggcatggtctccatcctcgccagctccctgctgaagaacgacatccccatgaccgggcccctcgtggccggcgggctgctgaccgtgtgctacgtcctcaccggccgcagcgcggacctggagctggagcgggccgccgacgtgaagtgggaggaccaggccgagatcagcgggtccagccccatcctctccatcacgatcagcgaggacggctccatgagcatcaagaacgaggaggaggagaccaccctgaccatcctgatccgcaccggcctcctggtgatctccggggtcttcccggtgagcatccccatcacggccgcggcctggtacctgtgggaggtgaagaagcagcgggccggcgtcctctgggacgtgcccagcccgccgcccgtggggaaggccgagctggaggacggcgcctaccgcatcaagcagcgggggatcctgggctacagccagatcggcgcgggggtctacaaggagggcaccttccacaccatgtggcacgtgacccgcggggccgtgctcatgcaccggggcaagcgcatcgagccctcctgggccgacgtcaagaaggacctgatcagctacgggggcggctggaagctggagggggagtggaaggagggcgaggaggtccaggtgctcgccctggagcccgggaagaacccccgggccgtccagacgaagcccggcatcttcaagaccaacaccgggaccatcggcgcggtgtccctggacttcagccccggcacgtccgggagccccatcgtggaccgcaagggcaaggtcgtggggctctacggcaacggcgtggtcacccggtccggggcctacgtgagcgccatcgcccagaccgagaagtccatcgaggacaaccccgagatcgaggacgacatcttccgcaagaagcggctgaccatcatggacctgcaccccggcgcggggaagacgaagcgctacctccccgccatcgtgcgggaggccatcaagcgcggcctgcgcaccctgatcctggccccgacccgggtcgtggccgcggagatggaggaggccctccgcgggctgcccatccggtaccagacccccgccatcaaggccgagcacacgggccgcgagatcgtggacctgatgtgccacgccaccttcaccatgcggctcctgagccccgtccgcgtgccgaactacaacctgatcatcatggacgaggcgcacttcaccgaccccgccagcatcgccgcccggggctacatctccacgcgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtcaccgacttcaaggggaagacggtgtggttcgtgccgagcatcaaggccggcaacgacatcgcggcctgcctccgcaagaacggcaagaaggtcatccagctgtcccggaagaccttcgacagcgagtacgtgaagacccgcgccaacgactgggacttcgtggtcaccacggacatctccgagatgggggccaacttcaaggccgagcgggtgatcgacccccgccggtgcatgaagcccgtgatcctgaccgacggcgaggagcgcgtcatcctcgcggggcccatgccggtgacccacagctccgccgcccagcggcgcggccgcatcgggcggaaccccaagaacgagaacgaccagtacatctacatgggcgagcccctggagaacgacgaggactgcgcccactggaaggaggccaagatgctgctcgacaacatcaacacccccgagggcatcatcccgagcatgttcgagcccgagcgcgagaaggtggacgcggtcgacggggagtaccggctgcgcggcgaggcccggaagacgttcgtggacctgatgcgccgcggggacctccccgtgtggctggcctacaaggtcgccgccgagggcatcaactacgcggaccgcaagtggtgcttcgacgggatcaagaacaaccagatcctggaggagaacgtggaggtcgagatctggaccaaggagggcgagcggaagaagctcaagccgcgctggctggacgcccggatctactccgaccccctggccctcaaggagttcaaggagttcgccgcgggccgcaagagcctgaccctgaacctcatcaccgagatggggcggctgcccacgttcatgacccagaaggcccgcaacgccctggacaacctcgccgtgctgcacaccgccgaggcgggcgggcgggcctacaaccacgccctgtccgagctccccgagaccctggagacgctgctcctgctgaccctcctggccaccgtgaccggcggcatcttcctgttcctcatgagcgggaagggcatcgggaagatgaccctgggcatgtgctgcatcatcacggcctccgtcctgctctggtacgcgcagatccagccgcactggatcgccgccagcatcatcctggagttcttcctgatcgtgctcctgatccccgagcccgagaagcagcgcacgccccaggacaaccagctgacctacgtggtcatcgccatcctcaccgtggtggccgcgacgatggccaacgagatggggttcctggagaagaccaagaaggacctgggcctcggctccatcaccacccaggagagcgagagcaacatcctggacatcgacctgcggccggcctccgcctggacgctctacgccgtcgcgaccaccttcgtgacccccatgctgcgccacagcatcgagaactccagcgtgaacgtctccctgacggccatcgccaaccaggccaccgtgctcatggggctgggcaaggggtggcccctgagcaagatggacatcggcgtgcccctcctggcgatcgggtgctactcccaggtcaacccgatgaccctgaccgccgccctcctgctgctcgtggcccactacgccatcatcggccccggcctgcaggcgaaggccacgcgggaggcccagaagcgcgccgccgcggggatcatgaagaaccccaccgtggacggcatcaccgtcatcgacctggagcccatcccgtacgaccccaagttcgagaagcagctcggccaggtgatgctgctgatcctctgcgtgacccaggtcctgatgatgcggacgacctgggccctgtgcgaggccctcaccctggccaccggccccatcagcacgctgtgggaggggaaccccggccgcttctggaacaccaccatcgccgtgtccatggcgaacatcttccgcggcagctacctcgccggggccggcctgctgttctccatcatgaagaacaccacgaacacccggcgcgggaccggcaacatcggcgagaccctcggggagaagtggaagtcccggctgaacgccctgggcaagtccgagttccagatctacaagaagtccgggatccaggaggtggaccgcacgctcgcgaaggagggcatcaagcgcggggagaccgaccaccacgccgtctcccgcggcagcgccaagctgcggtggttcgtggagcgcaacatggtgaccccggagggcaaggtcgtggacctggggtgcggccgcggcgggtggtcctactactgcggcgggctcaagaacgtgcgcgaggtcaaggggctgaccaagggcgggcccgggcacgaggagcccatccccatgagcacgtacggctggaacctggtgcggctccagtccggggtggacgtcttcttcaccccgcccgagaagtgcgacaccctgctgtgcgacatcggcgagagcagccccaaccccaccatcgaggccggccgcaccctccgggtgctgaacctggtggagaactggctcaacaacaacacgcagttctgcatcaaggtcctgaacccgtacatgccctccgtgatcgagaagatggagaccctgcagcgcaagtacgggggcgccctcgtgcggaaccccctgagccgcaactccacccacgagatgtactgggtcagcaacgcgaccgggaacatcgtgtccagcgtgaacatgatctcccggatgctgatcaaccgcttcacgatgaagcacaagaaggccacctacgagccggacgtcgacctgggcagcgggacccggaacatcggcatcgagtccgagatccccaacctcgacatcatcggcaagcgcatcgagaagatcaagcaggagcacgagaccagctggcactacgaccaggaccacccctacaagacgtgggcctaccacgggtcctacgagaccaagcagaccggcagcgcctccagcatggtgaacggggtggtccgcctgctgaccaagccctgggacgtggtgccgatggtcacgcagatggccatgaccgacaccacccccttcggccagcagcgggtgttcaaggagaaggtggacacgcgcacccaggagcccaaggagggcaccaagaagctcatgcggatcaccgcggagtggctgtggaaggagctggggaagaagaagacgccccgcatgtgcacccgggaggagttcacccgcaaggtccggtccaacgccgccctcggcgccatcttcaccgacgagaacaagtggaagtccgcccgcgaggcggtggaggacgggcggttctgggagctggtcgaccgcgagcggaacctgcacctcgagggcaagtgcgagacgtgcgtgtacaacatgatggggaagcgcgagaagaagctgggcgagttcggcaaggccaaggggtcccgggccatctggtacatgtggctgggcgcccgcttcctcgagttcgaggcgctggggttcctgaacgaggaccactggttcagccggggcaactccctcagcggggtggagggcgagggcctgcaccgcctggggtacatcctccgggacgtcggcaagaaggagggcggcgccatgtacgccgacgacaccgccgggtgggacacccgcatcaccctggaggacctgaagaacgaggagatggtgacgaaccacatgaagggcgagcacaagaagctcgccgaggcgatcttcaagctgacctaccagaacaaggtggtccgggtgcagcgcccgacgccccggggcaccgtgatggacatcatcagccgccgcgaccagcgggggtccggccaggtcgggacgtacggcctgaacaccttcaccaacatggaggcccagctcatccgccagatggagggcgaggggatcttcaagagcatccagcacctgaccgccacggaggagatcgccgcccagaactggctggcgcgggtgggccgcgagcggctctcccgcatggccatcagcggggacgactgcgtggtcaagcccatcgacgaccggttcgcctccgccctgaccgccctgaacgacatgggcaaggtgcgcaaggacatccagcagtgggagcccagccgggggtggaacgactggacccaggtgccgttctgctcccaccacttccacgagctcgtcatgaaggacggccgcgtgctggtggtcccctgccggaaccaggacgagctgatcggccgcgcgcggatcagccagggggccggctggtccctcaaggagaccgcctgcctgggcaagagctacgcccagatgtggaccctgatgtacttccaccgccgggacctccgcctggccgcgaacgccatctgctccgccgtgcccagccactgggtgcccacgtcccggaccacctggagcatccacgccaagcacgagtggatgaccacggaggacatgctggcggtctggaaccgcgtgtggatccaggagaacccgtggatggaggacaagacccccgtggagtcctgggaggaggtcccctacctcggcaagcgggaggaccagtggtgcgggagcctgatcggcctgacctcccgcgccacctgggccaagaacatccagacggccatcaaccaggtgcgcagcctcatcggcaacgaggagtacaccgactacatgcccagcatgaagcggttccgccgggaggaggaggaggccggggtgctgtggtga

SEQ ID NO: 9115 - RNA, 9867 nt, synthetic construct
  misc_feature 1..9867: note = derived and/or modified CDS sequence (opt1) from DENV-2__FJ182012__SS-prME
  source 1..9867: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaactccacctccacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaacgggaaggagatcaagatcaccccgcagtccagcatcaccgaggccgagctgaccggctacgggaccgtgacgatggagtgcagcccccggaccggcctcgacttcaacgagatggtcctgctgcagatggaggacaaggcctggctcgtgcaccggcagtggttcctggacctgcccctcccctggctgccgggcgccgacacccaggggagcaactggatccagaaggagaccctggtgacgttcaagaacccccacgcgaagaagcaggacgtcgtggtcctcggctcccaggagggggccatgcacaccgccctgaccggcgccaccgagatccagatgagcagcgggaacctcctcttcacgggccacctgaagtgccgcctgcggatggacaagctccagctgaagggcatgtcctacagcatgtgcaccgggaagttcaagatcgtgaaggagatcgccgagacccagcacggcaccatcgtgatccgcgtccagtacgagggggacggctccccctgcaagatccccttcgagatcacggacctggagaagcggcacgtgctcggccgcctgatcaccgtgaacccgatcgtcatcgagaaggacagccccgtgaacatcgaggcggagccgcccttcggggactcctacatcatcatcggcgtggagccggggcagctgaagctcaactggttcaagaagggcagctccatcgggcagatgttcgagaccaccatgcgcggcgccaagcggatggccatcctgggcgacacggcctgggacttcgggagcctgggcggggtcttcacctccatcggcaaggccctccaccaggtgttcggggcgatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgccatggtgcaggcggactccgggtgcgtggtcagctggaagaacaaggagctcaagtgcggctccggcatcttcatcaccgacaacgtgcacacctggacggagcagtacaagttccagcccgagagccccagcaagctggcctccgccatccagaaggcccacgaggaggggatctgcggcatccggagcgtgacccgcctggagaacctcatgtggaagcagatcacccccgagctgaaccacatcctgtccgagaacgaggtcaagctcaccatcatgacgggggacaccaagggcatcatgcaggccgggaagcggtacctgcgcccgcagcccaccgagctgaagtacagctggaagacctggggcaaggcgaagatgctctccacggagagccacaaccagaccttcctgatcgacggccccgagaccgccgagtgcccgaacaccaaccgggcctggaactccctggaggtggaggactacgggttcggcgtgttcacgaccaacatctggctcaagctgcgcgagaagcaggacgtcttctgcgacagcaagctgatgtccgccgccatcaaggacaaccgggcggtgcacgccgacatggggtactggatcgagagcgccctcaacgacacctggaagatggagaaggcctccttcatcgaggtcaagagctgccactggcccaagtcccacaccctgtggagcaacggcgtgctggagtccgagatgatcatccccaagaacttcgccggccccgtgagccagcacaactaccgcccggggtaccacacccagacggcgggcccctggcacctcgggaagctggagatggacttcgacttctgcgagggcaccaccgtggtcgtgaccgaggactgcgggaaccggggcccctccctgcgcacgaccaccgccagcggcaagctcatcaccgagtggtgctgccggagctgcacgctgcccccgctgcgctaccgcggggaggacggctgctggtacgggatggagatccgccccctcaaggagaaggaggagaacctggtgaactccctggtcaccgccggccacgggcagatcgacaacttcagcctcggcgtgctgggcatggccctgttcctcgaggagatgctgcggacccgcgtggggaccaagcacgcgatcctgctcgtcgccgtgtccttcgtgacgctgatcaccggcaacatgagcttccgggacctggggcgcgtcatggtgatggtgggcgccaccatgaccgacgacatcgggatgggcgtcacgtacctcgccctgctggccgcgttcaaggtgcgccccaccttcgccgccggcctcctgctgcggaagctcacctccaaggagctgatgatggccaccatcgggatcacgctgctcagccagtccaccatccccgagaccatcctggagctgaccgacgccctcgcgctgggcatgatggtgctgaagatcgtccgcaacatggagaagtaccagctcgccgtgacgatcatggccatcagctgcgtgccgaacgccgtcatcctgcggaacgcctggaaggtgtcctgcaccatcctggcggccgtcagcgtgagccccctcctgctgaccagctcccagcagaaggccgactggatccccctcgccctgaccatcaaggggctgaaccccacggcgatcttcctcaccaccctgagccgcacctccaagaagcggagctggccgctgaacgaggccatcatggccgtgggcatggtctccatcctcgccagctccctgctgaagaacgacatccccatgacgggccccctcgtggccgggggcctgctgaccgtgtgctacgtcctcaccgggcgcagcgcggacctggagctggagcgggccgccgacgtgaagtgggaggaccaggccgagatcagcggctccagccccatcctctccatcaccatcagcgaggacgggtccatgagcatcaagaacgaggaggaggagcagatcctgacgatcctgatccgcaccggcctcctggtgatctccggcgtcttcccggtgagcatccccatcaccgccgcggcctggtacctgtgggaggtgaagaagcagcgggccggggtcctctgggacgtgcccagcccgccgcccgtgggcaaggccgagctggaggacggggcctaccgcatcaagcagcggggcatcctggggtacagccagatcggcgcgggcgtctacaaggaggggaccttccacaccatgtggcacgtgacgcgcggcgccgtgctcatgcaccgggggaagcgcatcgagccctcctgggccgacgtcaagaaggacctgatcagctacggcgggggctggaagctggagggcgagtggaaggagggggaggaggtccaggtgctcgccctggagcccggcaagaacccccgggccgtccagaccaagcccgggatcttcaagaccaacaccggcacgatcggggcggtgtccctggacttcagccccggcacctccggcagccccatcgtggaccgcaaggggaaggtcgtgggcctctacgggaacggcgtggtcacccggtccggcgcctacgtgagcgccatcgcccagaccgagaagtccatcgaggacaaccccgagatcgaggacgacatcttccgcaagaagcggctgacgatcatggacctgcaccccggggcgggcaagaccaagcgctacctccccgccatcgtgcgggaggccatcaagcgcgggctgcgcaccctgatcctggccccgacccgggtcgtggccgcggagatggaggaggccctccgcggcctgcccatccggtaccagacgcccgccatcaaggccgagcacaccgggcgcgagatcgtggacctgatgtgccacgccaccttcaccatgcggctcctgagccccgtccgcgtgccgaactacaacctgatcatcatggacgaggcgcacttcacggaccccgccagcatcgccgcccggggctacatctccacccgcgtggagatgggcgaggccgcggggatcttcatgaccgccacgccgcccggcagccgggacccgttcccccagtccaacgcccccatcatggacgaggagcgcgagatccccgagcggagctggaactccgggcacgagtgggtcacggacttcaagggcaagaccgtgtggttcgtgccgagcatcaaggccgggaacgacatcgcggcctgcctccgcaagaacggcaagaaggtcatccagctgtcccggaagaccttcgacagcgagtacgtgaagacccgcgccaacgactgggacttcgtggtcacgaccgacatctccgagatgggcgccaacttcaaggccgagcgggtgatcgacccccgccggtgcatgaagcccgtgatcctgacccacggggaggagcgcgtcatcctcgcgggccccatgccggtgacccacagctccgccgcccagcggcgcgggcgcatcggccggaaccccaagaacgagaacgaccagtacatctacatgggggagcccctggagaacgacgaggactgcgcccactggaaggaggccaagatgctgctcgacaacatcaacacgcccgagggcatcatcccgagcatgttcgagcccgagcgcgagaaggtggacgcggtcgacggcgagtaccggctgcgcggggaggcccggaagaccttcgtggacctgatgcgccggggcgacctccccgtgtggctggcctacaaggtcgccgccgaggggatcaactacgcggaccgcaagtggtgcttcgacggcatcaagaacaaccagatcctggaggagaacgtggaggtcgagatctggaccaaggagggggagcggaagaagctcaagccgcgctggctggacgcccggatctactccgaccccctggccctcaaggagttcaaggagttcgccgcgggccgcaagagcctgaccctgaacctcatcacggagatgggccggctgcccaccttcatgacccagaaggcccgcaacgccctggacaacctcgccgtgctgcacaccgccgaggccgggggccgggcctacaaccacgccctgtccgagctccccgagacgctggagaccctgctcctgctgaccctcctggccaccgtgaccgggggcatcttcctgttcctcatgagcggcaaggggatcggcaagatgaccctggggatgtgctgcatcatcaccgcctccgtcctgctctggtacgcgcagatccagccgcactggatcgccgccagcatcatcctggagttcttcctgatcgtgctcctgatccccgagcccgagaagcagcgcacgccccaggacaaccagctgacctacgtggtcatcgccatcctcacggtggtggccgcgaccatggccaacgagatgggcttcctggagaagaccaagaaggacctggggctcggctccatcaccacgcaggagagcgagagcaacatcctggacatcgacctgcggccggcctccgcctggaccctctacgccgtcgcgaccaccttcgtgacgcccatgctgcgccacagcatcgagaactccagcgtgaacgtctccctgaccgccatcgccaaccaggccaccgtgctcatgggcctggggaagggctggcccctgagcaagatggacatcggggtgcccctcctggcgatcggctgctactcccaggtcaacccgatcaccctgacggccgccctcctgagcctggtggcccactacgccatcatcgggcccggcctccaggcgaaggccacccgggaggcccagaagcgcgccgccgcgggcatcatgaagaaccccaccgtggacgggatcaccgtcatcgacctggagcccatcccgtacgaccccaagttcgagaagcagctgggccaggtgatgctcctgatcctgtgcgtgacgcaggtcctcatgatgcggaccacctgggccctgtgcgaggccctgaccctcgccacggggcccatctccaccctgtgggagggcaaccccgggcgcttctggaacaccaccatcgccgtgagcatggcgaacatcttccgcggctcctacctggccggcgccgggctcctgttcagcatcatgaagaacacgaccaacacccggcgcggcaccgggaacatcggcgagacgctgggcgagaagtggaagtcccggctcaacgccctggggaagtccgagttccagatctacaagaagtccggcatccaggaggtggaccgcaccctggcgaaggaggggatcaagcggggcgagaccgaccaccacgccgtcagccgcgggtccgccaagctccggtggttcgtggagcgcaacatggtgaccccggagggcaaggtcgtggacctgggctgcgggcggggcgggtggagctactactgcggcgggctgaagaacgtgcgcgaggtcaagggcctcacgaagggcgggcccggccacgaggagcccatccccatgtccacctacgggtggaacctggtgcggctgcagagcggcgtggacgtcttcttcaccccgcccgagaagtgcgacaccctcctgtgcgacatcggggagagctcccccaaccccacgatcgaggccggccgcaccctgcgggtgctcaacctggtggagaactggctgaacaacaacacccagttctgcatcaaggtcctcaacccgtacatgcccagcgtgatcgagaagatggagaccctgcagcgcaagtacggcggggccctggtgcggaaccccctctcccgcaacagcacccacgagatgtactgggtctccaacgcgacgggcaacatcgtgagctccgtgaacatgatcagccggatgctgatcaaccgcttcaccatgaagcacaagaaggccacctacgagccggacgtcgacctggggtccggcacccggaacatcgggatcgagagcgagatccccaacctggacatcatcggcaagcgcatcgagaagatcaagcaggagcacgagacgtcctggcactacgaccaggaccacccctacaagacctgggcctaccacggcagctacgagaccaagcagaccgggtccgccagctccatggtgaacggcgtggtccgcctcctgacgaagccctgggacgtggtgccgatggtcacccagatggccatgaccgacaccacgcccttcgggcagcagcgggtgttcaaggagaaggtggacacccgcacccaggagcccaaggagggcaccaagaagctgatgcggatcacggcggagtggctctggaaggagctgggcaagaagaagacgccccgcatgtgcacccgggaggagttcacccgcaaggtccggagcaacgccgccctgggggccatcttcacggacgagaacaagtggaagtccgcccgcgaggcggtggaggacggccggttctgggagctcgtcgaccgcgagcggaacctgcacctggaggggaagtgcgagacctgcgtgtacaacatgatgggcaagcgcgagaagaagctcggggagttcggcaaggccaagggcagccgggccatctggtacatgtggctgggggcccgcttcctggagttcgaggcgctcggcttcctgaacgaggaccactggttctcccgggggaacagcctgagcggcgtggagggggagggcctccaccgcctgggctacatcctgcgggacgtcgggaagaaggagggcggggccatgtacgccgacgacaccgccggctgggacacccgcatcacgctcgaggacctgaagaacgaggagatggtgaccaaccacatgaagggggagcacaagaagctggccgaggcgatcttcaagctcacctaccagaacaaggtggtccgggtgcagcgcccgacgccccggggcacggtgatggacatcatctcccgccgcgaccagcggggcagcgggcaggtcggcacctacgggctgaacaccttcaccaacatggaggcccagctgatccgccagatggagggcgagggcatcttcaagtccatccagcacctcacggccaccgaggagatcgccgcccagaactggctggcgcgggtggggcgcgagcggctgagccgcatggccatctccggcgacgactgcgtggtcaagcccatcgacgaccggttcgccagcgccctcaccgccctgaacgacatggggaaggtgcgcaaggacatccagcagtgggagccctcccggggctggaacgactggacccaggtgccgttctgcagccaccacttccacgagctggtcatgaaggacgggcgcgtgctcgtggtcccctgccggaaccaggacgagctgatcggccgcgcgcggatctcccagggcgccgggtggagcctgaaggagacggcctgcctcggcaagtcctacgcccagatgtggaccctgatgtacttccaccgccgggacctgcgcctcgccgcgaacgccatctgcagcgccgtgccctcccactgggtgcccaccagccggaccacctggtccatccacgccaagcacgagtggatgacgaccgaggacatgctggcggtctggaaccgcgtgtggatccaggagaacccgtggatggaggacaagacccccgtggagagctgggaggaggtcccctacctggggaagcgggaggaccagtggtgcggctccctcatcgggctgaccagccgcgccacgtgggccaagaacatccagaccgccatcaaccaggtgcgcagcctgatcggcaacgaggagtacaccgactacatgccctccatgaagcggttccgccgggaggaggaggaggccggcgtgctctggtga

SEQ ID NO: 9116 - RNA, 9876 nt, synthetic construct
  misc_feature 1..9876: note = derived and/or modified CDS sequence (opt1) from DENV-2__EU854293__SS-prME
  source 1..9876: mol_type = other RNA
accgccggcatgatcatcatgctgatccccaccgtgatggccttccacctcaccacccggaacggggagccccacatgatcgtcagccggcaggagaagggcaagagcctgctgttcaagaccggggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggagcgtcgccctggtgccccacgtggggatgggcctcgagacccgcaccgagacctggatgagcagcgagggggcctggaagcacgcccagcggatcgagacgtggatcctgcgccaccccggcttcaccatcatggccgcgatcctggcctacaccatcgggaccacgcacttccagcgggccctcatcttcatcctgctgaccgccgtcgcgccctccatgaccatgcgctgcatcggcatcagcaaccgggacttcgtggagggcgtgtccgggggcagctgggtcgacatcgtgctcgagcacgggtcctgcgtgaccacgatggccaagaacaagcccaccctggacttcgagctgatcaagaccgaggccaagcagagcgccaccctccgcaagtactgcatcgaggccaagctgacgaacaccaccaccgagtcccggtgccccacgcagggcgagcccagcctgaacgaggagcaggacaagcgcttcgtctgcaagcactccatggtggaccggggctgggggaacggctgcgggctgttcggcaagggcgggatcgtgacctgcgcgatgttcacgtgcaagaagaacatgaagggcaaggtcgtgcagcccgagaacctggagtacaccatcgtgatcacgccccacagcggggaggagcacgccgtcggcaacgacaccgggaagcacggcaaggagatcaagatcacgccccagtccagcatcaccgaggccgagctgaccgggtacggcacggtgaccatggagtgctccccgcgcaccggcctcgacttcaacgagatggtgctgctgcagatggagaacaaggcctggctcgtccaccggcagtggttcctggacctgcccctcccctggctgcccggggccgacacccagggcagcaactggatccagaaggagacgctggtgaccttcaagaacccgcacgcgaagaagcaggacgtggtcgtgctcgggagccaggagggcgccatgcacaccgccctgaccggggccacggagatccagatgtccagcggcaacctcctgttcaccggccacctgaagtgccgcctgcggatggacaagctccagctgaaggggatgtcctacagcatgtgcaccggcaagttcaaggtcgtgaaggagatcgccgagacccagcacgggacgatcgtgatccgcgtccagtacgagggcgacggctccccctgcaagatccccttcgagatcatggacctggagaagcggcacgtgctcgggcgcctgatcaccgtgaaccccatcgtcaccgagaaggacagcccggtgaacatcgaggcggagccgcccttcggcgactcctacatcatcatcggggtggagcccggccagctgaagctcaactggttcaagaaggggagctccatcggccagatgttcgagaccacgatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggaccatgaagatcctgatcggcgtcatcatcacgtggatcgggatgaacagccgctccaccagcctgtccgtgagcctggtgctcgtcggcgtggtgaccctgtacctgggggtcatggtgcaggccgactccggctgcgtggtcagctggaagaacaaggagctcaagtgcggcagcgggatcttcatcaccgacaacgtgcacacgtggaccgagcagtacaagttccagccggagtcccccagcaagctggcgtccgccatccagaaggcccacgaggagggcatctgcgggatccggagcgtgacccgcctggagaacctcatgtggaagcagatcacccccgagctgaaccacatcctgtccgagaacgaggtcaagctcacgatcatgaccggcgacatcaaggggatcatgcaggccggcaagcggagcctgcgcccccagccgaccgagctgaagtactcctggaagacctggggcaaggccaagatgctcagcacggagtcccacaaccagaccttcctgatcgacgggcccgagaccgcggagtgccccaacaccaaccgggcctggaacagcctggaggtggaggactacggcttcggggtgttcacgaccaacatctggctcaagctgcgcgagaagcaggacgtcttctgcgactccaagctgatgagcgccgccatcaaggacaaccgggccgtgcacgcggacatgggctactggatcgagtccgccctcaacgacacctggaagatcgagaaggccagcttcatcgaggtgaagtcctgccactggcccaagagccacaccctgtggtccaacgaggtcctggagagcgagatgatcatccccaagaacttcgccggccccgtgagccagcacaactaccgccccgggtaccacacccagacggccggcccgtggcacctcgggaagctggagatggacttcgacttctgcgagggcaccaccgtggtcgtgaccgaggactgcgggaaccggggcccctccctgcgcacgaccaccgcgagcggcaagctcatcaccgagtggtgctgccggtcctgcacgctgccgcccctgcgctaccgcggggaggacggctgctggtacgggatggagatccgcccgctcaaggagaaggaggagaacctggtgaacagcctggtcaccgccggccacgggcagatcgacaacttctccctcggcgtgctgggcatggccctgttcctcgaggagatgctgcggacccgcgtggggaccaagcacgccatcctgctcgtcgcggtgagcttcgtgacgctgatcaccggcaacatgtccttccgggacctggggcgcgtcatggtgatggtgggcgccaccatgaccgacgacatcgggatgggcgtcacgtacctcgccctgctggccgccttcaaggtgcgccccaccttcgcggccggcctcctgctgcggaagctcaccagcaaggagctgatgatgaccacgatcgggatcgtgctgctctcccagagcaccatccccgagaccatcctggagctgaccgacgccctcgccctgggcatgatggtcctgaagatggtgcgcaagatggagaagtaccagctcgccgtgacgatcatggcgatcctgtgcgtccccaacgccgtgatcctgcagaacgcctggaaggtctcctgcaccatcctcgccgtggtgagcgtctccccgctgttcctgaccagctcccagcagaaggccgactggatccccctcgcgctgaccatcaaggggctgaaccccacggccatcttcctcaccaccctgagccggaccaacaagaagcgctcctggcccctgaacgaggccatcatggccgtgggcatggtgagcatcctcgcgtccagcctgctgaagaacgacatcccgatgacgggccccctcgtcgccgggggcctgctgaccgtgtgctacgtgctcaccgggcggagcgccgacctggagctggagcgcgccgccgacgtcaagtgggaggaccaggcggagatctccggcagctcccccatcctcagcatcaccatctccgaggacgggagcatgtccatcaagaacgaggaggaggagcagatcctgacgatcctgatccggaccggcctcctggtgatcagcggcctgttccccgtgtccatgccgatcaccgccgccgcctggtacctctgggaggtcaagaagcagcgcgccggggtgctgtgggacgtgccctccccgccgcccgtcggcaaggcggagctggaggacggggcctaccggatcaagcagaagggcatcctcgggtactcccagatcggcgccggcgtgtacaaggaggggaccttccacaccatgtggcacgtgacgcgcggcgccgtcctgatgcacaaggggaagcggatcgagcccagctgggccgacgtgaagaaggacctgatctcctacggcgggggctggaagctcgagggcgagtggaaggagggggaggaggtgcaggtcctggcgctggagcccggcaagaacccgcgcgccgtgcagaccaagcccggcctgttcaagaccaacgccggcaccatcggggccgtgagcctggacttctcccccggcacgagcggctcccccatcatcgacaagaaggggaaggtcgtgggcctgtacgggaacggcgtggtcacccggagcggcgcctacgtgtccgcgatcgcccagaccgagaagtccatcgaggacaacccggagatcgaggacgacatcttccgcaagcggaagctcaccatcatggacctgcaccccggggccggcaagacgaagcgctacctgcccgccatcgtgcgggaggcgatcaagcgcgggctgcggaccctcatcctggcccccacccgcgtcgtggccgccgagatggaggaggccctgcggggcctcccgatccgctaccagacccccgcgatccgcgccgagcacacggggcgggagatcgtggacctgatgtgccacgccaccttcaccatgcgcctgctcagccccgtccgggtgcccaactacaacctgatcatcatggacgaggcccacttcaccgacccggcctccatcgcggcccgcggctacatcagcacgcgggtggagatgggcgaggccgccgggatcttcatgaccgccacgccgcccggctcccgcgaccccttcccgcagagcaacgcgcccatcatggacgaggagcgggagatccccgagcgctcctggagctccgggcacgagtgggtcaccgacttcaagggcaagacggtgtggttcgtgcccagcatcaaggccgggaacgacatcgccgcctgcctgcggaagaacggcaagaaggtcatccagctctcccgcaagaccttcgacagcgagtacgtgaagacccggaccaacgactgggacttcgtggtcacgaccgacatctccgagatgggcgcgaacttcaaggccgagcgcgtgatcgacccgcggcgctgcatgaagcccgtgatcctgaccgacggggaggagcgggtcatcctggccggccccatgcccgtgacccacagctccgccgcccagcgccgggggcgcatcggccggaacccgaagaacgagaacgaccagtacatctacatgggggagcccctcgagaacgacgaggactgcgcgcactggaaggaggccaagatgctgctggacaacatcaacacgcccgagggcatcatccccagcatgttcgagccggagcgcgagaaggtggacgccatcgacggcgagtaccgcctccgcggggaggcccgcaagaccttcgtcgacctgatgcggcgcggcgacctgcccgtgtggctcgcctaccgggtggcggccgaggggatcaactacgccgaccgccggtggtgcttcgacggcatcaagaacaaccagatcctggaggagaacgtcgaggtggagatctggaccaaggagggggagcgcaagaagctgaagccccggtggctcgacgcccgcatctactccgacccgctggccctgaaggagttcaaggagttcgcggccggccgcaagagcctcaccctgaacctgatcacggagatgggccgcctccccaccttcatgacccagaaggcccgggacgccctggacaacctggcggtcctccacaccgccgaggccgggggccgcgcctacaaccacgccctgtccgagctgcccgagacgctcgagaccctgctgctcctgaccctgctcgcgaccgtgaccgggggcatcttcctgttcctgatgagcggccgggggatcggcaagatgaccctcgggatgtgctgcatcatcaccgcctccatcctgctgtggtacgcccagatccagccccactggatcgccgccagcatcatcctcgagttcttcctgatcgtgctgctcatcccggagcccgagaagcagcgcacgccccaggacaaccagctgacctacgtcgtgatcgcgatcctgacggtggtcgccgccaccatggccaacgagatgggcttcctcgagaagaccaagaaggacctggggctgggcagcatcaccacgcagcagcccgagtccaacatcctcgacatcgacctgcggccggccagcgcgtggaccctgtacgccgtggccaccaccttcgtgacgcccatgctccgccactccatcgagaacagctccgtcaacgtgagcctgaccgccatcgccaaccaggcgaccgtgctgatgggcctcgggaagggctggcccctgtccaagatggacatcggggtccccctgctcgccatcggctgctacagccaggtgaacccgatcaccctgacggccgccctgttcctcctggtggcgcactacgccatcatcgggcccggcctgcaggccaaggccacccgggaggcccagaagcgcgcggccgccggcatcatgaagaaccccaccgtcgacgggatcaccgtgatcgacctcgaccccatcccgtacgaccccaagttcgagaagcagctgggccaggtgatgctgctcgtcctgtgcgtgacccaggtgctgatgatgcggaccacctgggccctctgcgaggccctgaccctggcgacggggcccatctccaccctctgggagggcaaccccgggcgcttctggaacaccaccatcgccgtcagcatggccaacatcttccgcggctcctacctggccggcgccgggctcctcttcagcatcatgaagaacacgaccaacacccggcgcggcaccgggaacatcggcgagacgctgggcgagaagtggaagtcccggctgaacgcgctcggcaagagcgagttccagatctacaagaagtccggcatccaggaggtggaccgcaccctggccaaggaggggatcaagcggggcgagaccgaccaccacgccgtgagccgcgggtccgccaagctgcggtggttcgtcgagcgcaacatggtgaccccggagggcaaggtggtcgacctcggctgcgggcggggcgggtggagctactactgcggcgggctgaagaacgtgcgcgaggtgaagggcctgacgaagggcgggcccggccacgaggagcccatccccatgtccacctacgggtggaacctcgtccggctgcagagcggcgtggacgtgttcttcaccccgcccgagaagtgcgacaccctgctctgcgacatcggggagagctcccccaaccccacggtcgaggcgggccgcaccctgcgggtgctgaacctcgtggagaactggctgaacaacaacacccagttctgcatcaaggtcctgaacccgtacatgcccagcgtgatcgagaagatggaggccctccagcgcaagtacggcggggccctggtgcggaaccccctgtcccgcaacagcacccacgagatgtactgggtctccaacgccagcggcaacatcgtgtccagcgtgaacatgatctcccggatgctgatcaaccgcttcaccatgcggcacaagaaggccacgtacgagccggacgtcgacctcgggagcggcacccgcaacatcgggatcgagtccgagatccccaacctggacatcatcggcaagcgcatcgagaagatcaagcaggagcacgagaccagctggcactacgaccaggaccacccctacaagacctgggcgtaccacggctcctacgagacgaagcagaccgggagcgcctccagcatggtgaacggcgtggtccggctgctcaccaagccctgggacgtggtgccgatggtcacccagatggccatgacggacaccacccccttcgggcagcagcgcgtgttcaaggagaaggtggacacccggacgcaggagcccaaggagggcaccaagaagctgatgaagatcaccgccgagtggctgtggaaggagctcggcaagaagaagacgccccggatgtgcacgcgggaggagttcacccgcaaggtccggtccaacgccgcgctgggggccatcttcaccgacgagaacaagtggaagtccgcccgcgaggccgtggaggactcccggttctgggagctggtcgacaaggagcgcaacctccacctggagggcaagtgcgagacctgcgtgtacaacatgatggggaagcgggagaagaagctgggcgagttcgggaaggccaagggcagccgcgcgatctggtacatgtggctcggcgcccggttcctggagttcgaggccctggggttcctcaacgaggaccactggttcagccgcgagaactccctgagcggcgtggagggggagggcctgcacaagctcgggtacatcctgcgggacgtctccaagaaggagggcggcgccatgtacgcggacgacacggccgggtgggacacccgcatcaccctggaggacctcaagaacgaggagatggtgaccaaccacatggagggcgagcacaagaagctggccgaggccatcttcaagctgacgtaccagaacaaggtggtccgggtgcagcgcccgacgccccgggggaccgtgatggacatcatcagccgccgggaccagcgcggctccgggcaggtcggcacctacggcctcaacaccttcaccaacatggaggcccagctgatccgccagatggagggggagggcgtgttcaagagcatccagcacctgaccgtgaccgaggagatcgcggtccagaactggctcgcccgggtggggcgcgagcggctgtcccgcatggccatcagcggcgacgactgcgtggtcaagcccctggacgaccggttcgcctccgccctcacggcgctgaacgacatgggcaaggtgcgcaaggacatccagcagtgggagcccagccgggggtggaacgactggacccaggtgccgttctgctcccaccacttccacgagctgatcatgaaggacggccgcgtcctcgtggtgccctgccggaaccaggacgagctgatcgggcgcgcccggatcagccagggcgccgggtggtccctgcgcgagaccgcctgcctcggcaagagctacgcccagatgtggtccctgatgtacttccaccggcgcgacctgcggctcgcggccaacgccatctgcagcgccgtcccctcccactgggtgcccaccagccgcacgacctggagcatccacgccaagcacgagtggatgaccaccgaggacatgctgaccgtgtggaaccgggtctggatccaggagaacccgtggatggaggacaagacgcccgtggagtcctgggaggagatcccctacctgggcaagcgcgaggaccagtggtgcgggagcctcatcggcctgacctcccgggcgacctgggccaagaacatccagaccgccatcaaccaggtgcgcagcctgatcgggaacgaggagtacacggactacatgccctccatgaagcgcttccggcgcgaggaggaggaggccggcgtcctctggtga

SEQ ID NO: 9117 - RNA, 9876 nt, synthetic construct
  misc_feature 1..9876: note = derived and/or modified CDS sequence (opt1) from DENV-2__EU854294__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcatcgagaaggacagccccgtgaacatcgaggcggagccgcccttcggcgactcctacatcatcatcggggtggagccgggccagctgaagctcaactggttcaagaaggggagctccatcggccagatgttcgagaccacgatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggaccatgaagatcctgatcggcgtcgtgatcacgtggatcgggatgaacagccgctccaccagcctgtccgtgagcctggtcctcgtgggcgtggtcaccctgtacctgggggccatggtgcaggcggactccggctgcgtggtcagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtgacccgcctggagaacctcatgtggaagcagatcacccccgagctgaaccacatcctgtccgagaacgaggtcaagctcacgatcatgaccggcgacaccaaggggatcatgcaggccggcaagcggtacctgcgcccgcagcccaccgagctgaagtacagctggaagacgtggggcaaggcgaagatgctctccaccgagagccacaaccagaccttcctgatcgacgggcccgagaccgccgagtgcccgaacacgaaccgggcctggaactccctggaggtggaggactacggcttcggggtgttcaccaccaacatctggctcaagctgcgcgagaagcaggacgtcttctgcgacagcaagctgatgtccgccgccatcaaggacaaccgggcggtgcacgccgacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagaacttcgccgggcccgtgagccagcacaactaccgcccgggctaccacacgcagaccgcggggccctggcacctcggcaagctggagatggacttcgacttctgcgaggggaccaccgtggtcgtgacggaggactgcggcaaccggggcccctccctgcgcaccaccaccgccagcgggaagctcatcacggagtggtgctgccggagctgcaccctgcccccgctgcgctaccggggcgaggacgggtgctggtacggcatggagatccgccccctcaaggagaaggaggagaacctggtgaactccctggtcaccgccgggcacggccagatcgacaacttcagcctcggcgtgctggggatggccctgttcctcgaggagatgctgcggacccgcgtgggcacgaagcacgcgatcctgctcgtcgccgtgtccttcgtgaccctgatcaccgggaacatgagcttccgggacctgggccgcgtcatggtgatggtgggggccaccatgacggacgacatcggcatgggcgtcacctacctcgccctgctggccgcgttcaaggtgcgccccaccttcgccgccgggctcctgctgcggaagctcacctccaaggagctgatgatggccacgatcggcatcaccctgctcagccagtccaccatccccgagaccatcctggagctgacggacgccctcgcgctggggatgatggtgctgaagatcgtccgcaacatggagaagtaccagctcgccgtgaccatcatggccatcagctgcgtgccgaacgccgtcatcctgcggaacgcctggaaggtgtcctgcaccatcctggcggccgtcagcgtgagccccctcctgctgaccagctcccagcagaaggccgactggatccccctcgccctgacgatcaagggcctgaaccccaccgcgatcttcctcaccaccctgagccgcacgtccaagaagcggagctggccgctgaacgaggccatcatggccgtgggcatggtctccatcctcgccagctccctgctgaagaacgacatccccatgaccgggcccctcgtggccggcgggctgctgaccgtgtgctacgtcctcaccggccgcagcgcggacctggagctggagcgggccgccgacgtgaagtgggaggaccaggccgagatcagcgggtccagccccatcctctccatcacgatcagcgaggacggctccatgagcatcaagaacgaggaggaggagcagaccctgaccatcctgatccgcaccggcctcctggtgatctccggggtcttcccggtgagcatccccatcaccgccgcggcctggtacctgtgggaggtgaagaagcagcgggccggcgtcctctgggacgtgcccagcccgccgcccgtggggaaggccgagctggaggacggcgcctaccgcatcaagcagcgggggatcctgggctacagccagatcggcgcgggggtctacaaggagggcacgttccacaccatgtggcacgtgacccgcggggccgtgctcatgcaccggggcaagcgcatcgagccctcctgggccgacgtcaagaaggacctgatcagctacgggggcggctggaagctggagggggagtggaaggagggcgaggaggtccaggtgctcgccctggagcccgggaagaacccccgggccgtccagaccaagcccggcatcttcaagacgaacaccgggaccatcggcgcggtgtccctggacttcagccccggcacctccgggagccccatcgtggaccgcaagggcaaggtcgtggggctctacggcaacggcgtggtcacgcggtccggggcctacgtgagcgccatcgcccagaccgagaagtccatcgaggacaaccccgagatcgaggacgacatcttccgcaagaagcggctgaccatcatggacctgcaccccggcgcggggaagaccaagcgctacctccccgccatcgtgcgggaggccatcaagcgcggcctgcgcacgctgatcctggccccgacccgggtcgtggccgcggagatggaggaggccctccgcgggctgcccatccggtaccagacccccgccatcaaggccgagcacaccggccgcgagatcgtggacctgatgtgccacgccacgttcaccatgcggctcctgagccccgtccgcgtgccgaactacaacctgatcatcatggacgaggcgcacttcaccgaccccgccagcatcgccgcccggggctacatctccacccgcgtggagatgggggaggccgcgggcatcttcatgacggccacgccgcccgggagccgggacccgttcccccagtccaacgcccccatcatggacgaggagcgcgagatccccgagcggagctggaactccggccacgagtgggtcaccgacttcaaggggaagaccgtgtggttcgtgccgagcatcaaggccggcaacgacatcgcggcctgcctccgcaagaacggcaagaaggtcatccagctgtcccggaagacgttcgacagcgagtacgtgaagacccgcgccaacgactgggacttcgtggtcaccaccgacatctccgagatgggggccaacttcaaggccgagcgggtgatcgacccccgccggtgcatgaagcccgtgatcctgacggacggcgaggagcgcgtcatcctcgcggggcccatgccggtgacccacagctccgccgcccagcggcgcggccgcatcgggcggaaccccaagaacgagaacgaccagtacatctacatgggcgagcccctggagaacgacgaggactgcgcccactggaaggaggccaagatgctgctcgacaacatcaacacccccgagggcatcatcccgagcatgttcgagcccgagcgcgagaaggtggacgcggtcgacggggagtaccggctgcgcggcgaggcccggaagaccttcgtggacctgatgcgccgcggggacctccccgtgtggctggcctacaaggtcgccgccgagggcatcaactacgcggaccgcaagtggtgcttcgacgggatcaagaacaaccagatcctggaggagaacgtggaggtcgagatctggacgaaggagggcgagcggaagaagctcaagccgcgctggctggacgcccggatctactccgaccccctggccctcaaggagttcaaggagttcgccgcgggccgcaagagcctgaccctgaacctcatcaccgagatggggcggctgcccaccttcatgacgcagaaggcccgcaacgccctggacaacctcgccgtgctgcacaccgccgaggcgggcgggcgggcctacaaccacgccctgtccgagctccccgagaccctggagaccctgctcctgctgacgctcctggccaccgtgaccggcggcatcttcctgttcctcatgagcgggaagggcatcgggaagatgaccctgggcatgtgctgcatcatcaccgcctccgtcctgctctggtacgcgcagatccagccgcactggatcgccgccagcatcatcctggagttcttcctgatcgtgctcctgatccccgagcccgagaagcagcgcacgccccaggacaaccagctgacctacgtggtcatcgccatcctcaccgtggtggccgcgaccatggccaacgagatggggttcctggagaagacgaagaaggacctgggcctcggctccatcaccacccaggagagcgagagcaacatcctggacatcgacctgcggccggcctccgcctggaccctctacgccgtcgcgacgaccttcgtgacccccatgctgcgccacagcatcgagaactccagcgtgaacgtctccctgaccgccatcgccaaccaggccacggtgctcatggggctgggcaaggggtggcccctgagcaagatggacatcggcgtgcccctcctggcgatcgggtgctactcccaggtcaacccgatcaccctgaccgccgccctcctgctgctcgtggcccactacgccatcatcggccccggcctgcaggcgaaggccacccgggaggcccagaagcgcgccgccgcggggatcatgaagaaccccacggtggacggcatcaccgtcatcgacctggagcccatcccgtacgaccccaagttcgagaagcagctcggccaggtgatgctgctgatcctctgcgtgacccaggtcctgatgatgcggaccacgtgggccctgtgcgaggccctcaccctggccaccggccccatcagcaccctgtgggaggggaaccccggccgcttctggaacacgaccatcgccgtgtccatggcgaacatcttccgcggcagctacctcgccggggccggcctgctgttctccatcatgaagaacaccaccaacacgcggcgcgggaccggcaacatcggcgagaccctcggggagaagtggaagtcccggctgaacgccctgggcaagtccgagttccagatctacaagaagtccgggatccaggaggtggaccgcaccctcgcgaaggagggcatcaagcgcggggagacggaccaccacgccgtctcccgcggcagcgccaagctgcggtggttcgtggagcgcaacatggtgaccccggagggcaaggtcgtggacctggggtgcggccgcggcgggtggtcctactactgcggcgggctcaagaacgtgcgcgaggtcaaggggctgaccaagggcgggcccgggcacgaggagcccatccccatgagcacctacggctggaacctggtgcggctccagtccggggtggacgtcttcttcacgccgcccgagaagtgcgacaccctgctgtgcgacatcggcgagagcagccccaaccccaccatcgaggccggccgcaccctccgggtgctgaacctggtggagaactggctcaacaacaacacccagttctgcatcaaggtcctgaacccgtacatgccctccgtgatcgagaagatggagacgctgcagcgcaagtacgggggcgccctcgtgcggaaccccctgagccgcaactccacccacgagatgtactgggtcagcaacgcgaccgggaacatcgtgtccagcgtgaacatgatctcccggatgctgatcaaccgcttcaccatgaagcacaagaaggccacgtacgagccggacgtcgacctgggcagcgggacccggaacatcggcatcgagtccgagatccccaacctcgacatcatcggcaagcgcatcgagaagatcaagcaggagcacgagaccagctggcactacgaccaggaccacccctacaagacctgggcctaccacgggtcctacgagacgaagcagaccggcagcgcctccagcatggtgaacggggtggtccgcctgctgaccaagccctgggacgtggtgccgatggtcacccagatggccatgacggacaccacccccttcggccagcagcgggtgttcaaggagaaggtggacacccgcacgcaggagcccaaggagggcaccaagaagctcatgcggatcaccgcggagtggctgtggaaggagctggggaagaagaagacgccccggatgtgcacgcgggaggagttcacccgcaaggtccggtccaacgccgccctcggcgccatcttcaccgacgagaacaagtggaagtccgcccgcgaggcggtggaggacgggcggttctgggagctggtcgaccgcgagcggaacctgcacctcgagggcaagtgcgagacctgcgtgtacaacatgatggggaagcgcgagaagaagctgggcgagttcggcaaggccaaggggtcccgggccatctggtacatgtggctgggcgcccgcttcctcgagttcgaggcgctggggttcctgaacgaggaccactggttcagccggggcaactccctcagcggggtggagggcgagggcctgcaccgcctggggtacatcctccgggacgtcggcaagaaggagggcggcgccatgtacgccgacgacacggccgggtgggacacccgcatcaccctggaggacctgaagaacgaggagatggtgaccaaccacatgaagggcgagcacaagaagctcgccgaggcgatcttcaagctgacgtaccagaacaaggtggtccgggtgcagcgcccgacgccccggggcaccgtgatggacatcatcagccgccgcgaccagcgggggtccggccaggtcgggacctacggcctgaacacgttcaccaacatggaggcccagctcatccgccagatggagggcgaggggatcttcaagagcatccagcacctgaccgccaccgaggagatcgccgcccagaactggctggcgcgggtgggccgcgagcggctctcccgcatggccatcagcggggacgactgcgtggtcaagcccatcgacgaccggttcgcctccgccctgacggccctgaacgacatgggcaaggtgcgcaaggacatccagcagtgggagcccagccgggggtggaacgactggacccaggtgccgttctgctcccaccacttccacgagctcgtcatgaaggacggccgcgtgctggtggtcccctgccggaaccaggacgagctgatcggccgcgcgcggatcagccagggggccggctggtccctcaaggagaccgcctgcctgggcaagagctacgcccagatgtggaccctgatgtacttccaccgccgggacctccgcctggccgcgaacgccatctgctccgccgtgcccagccactgggtgcccacctcccggacgacctggagcatccacgccaagcacgagtggatgaccaccgaggacatgctggcggtctggaaccgcgtgtggatccaggagaacccgtggatggaggacaagacgcccgtggagtcctgggaggaggtcccctacctcggcaagcgggaggaccagtggtgcgggagcctgatcggcctgacctcccgcgccacctgggccaagaacatccagaccgccatcaaccaggtgcgcagcctcatcggcaacgaggagtacacggactacatgcccagcatgaagcggttccgccgggaggaggaggaggccggggtgctgtggtga

SEQ ID NO: 9118 - RNA, 9876 nt, synthetic construct
  misc_feature 1..9876: note = derived and/or modified CDS sequence (opt1) from DENV-2__FJ024477__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgccacccgcctggagaacctcatgtggaagcagatcacgcccgagctgaaccacatcctgtccgagaacgaggtgaagctcaccatcatgaccggcgacatcaaggggatcatgcaggcgggcaagcggagcctgcgcccgcagcccaccgagctgaagtactcctggaagacgtggggcaaggccaagatgctcagcaccgagtcccacaaccagaccttcctgatcgacgggcccgagaccgccgagtgcccgaacacgaaccgggcctggaacagcctggaggtggaggactacggcttcggggtcttcaccaccaacatctggctcaagctgcgcgagaagcaggacgtgttctgcgactccaagctgatgagcgccgcgatcaaggacaaccgggccgtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgcggggcccgtgtcccagcacaactaccgcccgggctaccacacgcagaccgccgggccctggcacctcggcaagctggagatggacttcgacttctgcgaggggaccaccgtcgtggtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggcgctgttcctcgaggagatgctgcggacccgcgtcggcacgaagcacgccatcctgctcgccgccgtgagcttcgtgaccctgatcaccgggaacatgtccttccgggacctgggccgcgtcatggtgatggtgggggccaccatgacggacgacatcggcatgggcgtcacctacctcgcgctgctggccgccttcaaggtgcgccccaccttcgccgccgggctcctgctgcggaagctcaccagcaaggagctgatgatggcgacgatcggcatcgccctgctctcccagagcaccatccccgagaccatcctggagctgaccgacgccctcgccctggggatgatggtgctgaagatcgtccgcaacatggagaagtaccagctcgccgtgacgatcatggcgatctcctgcgtgccgaacgccgtcatcctgcagaacgcctggaaggtgagctgcaccatcctggccgtggtctccgtgagccccctcctgctgacctccagccagcagaaggcggactggatccccctcgccctgaccatcaagggcctgaaccccacggccatcttcctcaccaccctgtcccggaccagcaagaagcgctcctggccgctgaacgaggccatcatggccgtcggcatggtgagcatcctcgcgtccagcctgctgaagaacgacatccccatgacggggcccctcgtggccggcgggctgctgaccgtctgctacgtgctcaccggccggagcgccgacctggagctggagcgcgccgccgacgtgaagtgggaggaccaggcggagatctccgggagctcccccatcctcagcatcaccatctccgaggacggcagcatgtccatcaagaacgaggaggaggagcagacgctgaccatcctgatccggaccggcctcctggtcatcagcggggtgttcccggtgtccatccccatcaccgccgccgcctggtacctgtgggaggtcaagaagcagcgcgccggcgtgctctgggacgtgcccagcccgccgcccgtcgggaaggcggagctggaggacggcgcctaccggatcaagcagcgcgggatcctgggctactcccagatcggcgccggggtgtacaaggagggcaccttccacacgatgtggcacgtgacccgcggggccgtcctcatgcaccgcggcaagcggatcgagcccagctgggccgacgtgaagaaggacctgatctcctacgggggcggctggaagctggagggggagtggaaggagggcgaggaggtgcaggtcctcgcgctggagcccgggaagaacccccgcgccgtgcagaccaagcccggcatcttcaagaccaacacggggaccatcggcgccgtgagcctggacttctcccccggcaccagcgggtcccccatcgtcgaccggaagggcaaggtggtggggctctacggcaacggcgtcgtgacccgcagcggggcctacgtgtccgcgatcgcccagacggagaagtccatcgaggacaaccccgagatcgaggacgacatcttccggaagaagcgcctgaccatcatggacctgcaccccggcgccgggaagaccaagcggtacctccccgccatcgtccgcgaggccatcaagcggggcctgcgcaccctgatcctggcgccgacgcgcgtggtggccgccgagatggaggaggccctccgggggctgcccatccgctaccagacccccgccatcaaggcggagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgccgcgcgcggctacatcagcacccgggtcgagatgggggaggccgccggcatcttcatgaccgccacgccgcccgggtcccgcgacccgttcccccagagcaacgcgcccatcatggacgaggagcgggagatccccgagcgctcctggaacagcggccacgagtgggtgaccgacttcaaggggaagaccgtgtggttcgtcccgtccatcaaggccggcaacgacatcgccgcctgcctccggaagaacggcaagaaggtgatccagctgagccgcaagaccttcgactccgagtacgtgaagacgcgggccaacgactgggacttcgtcgtgaccaccgacatcagcgagatgggggcgaacttcaaggccgagcgcgtgatcgacccccggcgctgcatgaagcccgtcatcctgaccgacggcgaggagcgggtgatcctcgccgggcccatgccggtgacgcactccagcgccgcccagcgccggggccgcatcgggcgcaaccccaagaacgagaacgaccagtacatctacatgggcgagcccctggagaacgacgaggactgcgcgcactggaaggaggccaagatgctgctcgacaacatcaacacccccgagggcatcatcccgtccatgttcgagcccgagcgggagaaggtcgacgccatcgacggggagtaccgcctgcggggcgaggcccgcaagaccttcgtggacctgatgcggcgcggggacctccccgtgtggctggcctacaaggtcgcggccgagggcatcaactacgccgaccggaagtggtgcttcgacgggatcaagaacaaccagatcctggaggagaacgtggaggtggagatctggaccaaggagggcgagcgcaagaagctcaagccgcggtggctggacgcccgcatctacagcgaccccctggcgctcaaggagttcaaggagttcgccgccggccggaagtccctgacgctgaacctcatcaccgagatggggcgcctgcccaccttcatgacccagaaggcccggaacgccctggacaacctcgcggtcctgcacacggccgaggccggcgggcgcgcctacaaccacgccctgagcgagctccccgagaccctggagaccctgctcctgctgaccctcctggcgacggtgaccggcggcatcttcctgttcctcatgtccgggaagggcatcgggaagatgaccctgggcatgtgctgcatcatcaccgccagcgtcctgctctggtacgcccagatccagccgcactggatcgccgcctccatcatcctggagttcttcctgatcgtgctcctgatccccgagcccgagaagcagcggacgccccaggacaaccagctgacgtacgtggtcatcgcgatcctcaccgtggtggccgccaccatggccaacgagatggggttcctggagaagaccaagaaggacctgggcctcggcagcatcacgacccaggagagcgagtccaacatcctggacatcgacctgcgcccggccagcgcgtggaccctctacgccgtcgccaccacgttcgtgacccccatgctgcggcactccatcgagaacagctccgtgaacgtcagcctgaccgccatcgcgaaccaggccaccgtgctcatggggctgggcaaggggtggcccctgtccaagatggacatcggcgtgcccctcctggccatcgggtgctacagccaggtcaacccgatcacgctgaccgccgccctcctgctgctcgtggcgcactacgccatcatcggccccggcctgcaggccaaggccacccgcgaggcccagaagcgggcggccgccgggatcatgaagaaccccaccgtggacggcatcacggtcatcgacctggagcccatcccgtacgaccccaagttcgagaagcagctcgggcaggtcatgctgctgatcctctgcgtgacccaggtcctgatgatgcgcaccacctgggccctgtgcgaggccctcacgctggcgaccggccccatctccaccctgtgggaggggaaccccggccggttctggaacaccacgatcgccgtgagcatggccaacatcttccgcggctcctacctcgccggggcgggcctgctgttcagcatcatgaagaacaccaccaacacccgccgggggacgggcaacatcggcgagaccctcggggagaagtggaagtcccgcctgaacgccctgggcaagagcgagttccagatctacaagaagtccgggatccaggaggtggaccggaccctcgccaaggagggcatcaagcgcggggagaccgaccaccacgccgtcagccggggctccgccaagctgcgctggttcgtggagcggaacatggtgacgccggagggcaaggtcgtggacctggggtgcggccgcgggggctggagctactactgcgggggcctcaagaacgtgcgggaggtcaagggcctgaccaagggcggccccgggcacgaggagcccatccccatgtccacctacggctggaacctggtgcgcctccagagcggggtggacgtcttcttcaccccgcccgagaagtgcgacacgctgctgtgcgacatcggcgagagctcccccaaccccaccatcgaggcgggccggaccctccgcgtgctgaacctggtggagaactggctcaacaacaacacccagttctgcatcaaggtcctgaacccgtacatgcccagcgtgatcgagaagatggagaccctgcagcggaagtacgggggcgccctcgtgcgcaaccccctgtcccggaacagcacgcacgagatgtactgggtctccaacgccaccgggaacatcgtgagctccgtgaacatgatcagccgcatgctgatcaaccggttcaccatgaagcacaagaaggccacctacgagccggacgtcgacctgggctccgggacgcgcaacatcggcatcgagagcgagatccccaacctcgacatcatcggcaagcggatcgagaagatcaagcaggagcacgagacctcctggcactacgaccaggaccacccctacaagacctgggcctaccacgggagctacgagaccaagcagacgggctccgcgagctccatggtgaacggggtggtccgcctgctgaccaagccctgggacgtggtgccgatggtcacccagatggccatgaccgacacgacccccttcggccagcagcgcgtgttcaaggagaaggtggacacccggacccaggagcccaaggagggcacgaagaagctcatgaagatcaccgccgagtggctgtggaaggagctggggaagaagaagacgccccgcatgtgcacccgggaggagttcacgcgcaaggtccggagcaacgccgccctcggcgcgatcttcaccgacgagaacaagtggaagtccgcccgcgaggccgtggaggacgggcggttctgggagctggtggaccgcgagcggaacctgcacctcgagggcaagtgcgagacctgcgtctacaacatgatggggaagcgcgagaagaagctgggcgagttcggcaaggccaaggggagccgggcgatctggtacatgtggctgggcgcccgcttcctcgagttcgaggccctggggttcctgaacgaggaccactggttctcccggggcaacagcctcagcggggtggagggcgagggcctgcaccgcctggggtacatcctccgggacgtctccaagaaggagggcggggccatgtacgccgacgacaccgcgggctgggacacgcgcatcaccctggaggacctgaagaacgaggagatggtgaccaaccacatgaagggggagcacaagaagctcgccgaggccatcttcaagctgacctaccagaacaaggtggtccgggtgcagcgcccgacgccccggggcaccgtgatggacatcatcagccgccgggaccagcgcggctccgggcaggtcggcacctacgggctgaacaccttcacgaacatggaggcccagctcatccgccagatggagggcgagggcatcttcaagagcatccagcacctgaccgccaccgaggagatcgcggtgcagaactggctggcccgggtggggcgcgagcggctctcccgcatggccatcagcggcgacgactgcgtcgtgaagcccatcgacgaccggttcgcctccgccctgaccgcgctgaacgacatggggaaggtgcgcaaggacatccagcagtgggagcccagccggggctggaacgactggacgcaggtcccgttctgctcccaccacttccacgagctcgtgatgaaggacgggcgcgtgctggtcgtgccctgccggaaccaggacgagctgatcggccgcgcccggatcagccagggcgccgggtggtccctcaaggagaccgcctgcctgggcaagagctacgcccagatgtggaccctgatgtacttccaccgccgggacctccgcctggcggccaacgccatctgctccgccgtgcccagccactgggtccccacctcccggaccacgtggagcatccacgcgaagcacgagtggatgaccaccgaggacatgctggccgtgtggaaccgcgtgtggatccaggagaacccgtggatggaggacaagacccccgtcgagtcctgggaggaggtgccctacctcgggaagcgggaggaccagtggtgcggcagcctgatcgggctgacgagccgcgccacctgggccaagaacatccagaccgccatcaaccaggtgcggtccctcatcggcaacgaggagtacaccgactacatgcccagcatgaagcgcttccgccgggaggaggaggaggcgggcgtcctgtggtga

SEQ ID NO: 9119 - RNA, 9876 nt, synthetic construct
  misc_feature 1..9876: note = derived and/or modified CDS sequence (opt1) from DENV-2__GQ868552__SS-prME
  source 1..9876: mol_type = other RNA
accgcgggggtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccaccccggcttcgccatcatggcggccatcctggcctacaccatcgggaccacccacttccagcgggccctcatcttcatcctgctgaccgcggtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccaccctggacttcgagctgatcaagaccgaggccaagcagcccgccaccctccgcaagtactgcatcgaggcgaagctgaccaacacgaccaccgagtcccggtgcccgacccagggcgagcccagcctgaacgaggagcaggacaagcgcttcatctgcaagcactccatggtggaccggggctgggggaacggctgcggcctcttcggcaagggcgggatcgtgacgtgcgccatgttcacgtgcaagaagaacatggagggcaaggtcgtgctgcccgagaacctggagtacaccatcgtgatcacgccccacagcggggaggagcacgccgtcggcaacgacacggggaagcacggcaaggagatcaagatcaccccgcagtccagcatcaccgaggccgagctcaccgggtacggcaccgtgacgatggagtgcagcccccgcaccggcctggacttcaacgagatggtgctgctccagatggaggagaaggcctggctggtccaccggcagtggttcctggacctccccctgccctggctgccgggggcggacacccagggcagcaactggatccagaaggagaccctcgtgacgttcaagaacccccacgccaagaagcaggacgtggtcgtgctggggtcccaggagggcgccatgcacaccgccctgaccggggccaccgagatccagatgagcagcggcaacctcctgttcacgggccacctgaagtgccgcctccggatggacaagctgcagctgaaggggatgtcctacagcatgtgcaccggcaagttcaagatcgtcaaggagatcgcggagacccagcacgggaccatcgtgatccgcgtgcagtacgagggcgacggctccccctgcaagatccccttcgagatcatggacctcgagaagcggcacgtcctggggcgcctgatcacggtgaacccgatcgtgaccgagaaggacagccccgtcaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtgttcacctccatcgggaaggcgctgcaccaggtcttcggcgccatctacggcgccgccttcagcggggtgtcctggaccatgaagatcctgatcggcgtgatcatcacctggatcgggatgaacagccgctccacgagcctgtccgtcagcctcgtgctggtgggcgtcgtgaccctgtacctcggggcgatggtgcaggccgactccggctgcgtcgtgagctggaagaacaaggagctgaagtgcggctccgggatcttcatcaccgacaacgtgcacacctggacggagcagtacaagttccagcccgagagccccagcaagctggcctccgccatccagaaggcccacgaggagggcatctgcgggatccggagcgtcacccgcctcgagaacctgatgtggaagcagatcacccccgagctgaaccacatcctctccgagaacgaggtgaagctgaccatcatgacgggcgacatcaaggggatcatgcaggcgggcaagcggagcctgcgcccgcagcccaccgagctcaagtactcctggaagacctggggcaaggccaagatgctgagcaccgagtcccacaaccagacgttcctgatcgacgggcccgagaccgccgagtgcccgaacaccaaccgggcctggaacagcctcgaggtggaggactacggcttcggggtcttcaccacgaacatctggctgaagctgcgcgagaagcaggacgtgttctgcgactccaagctcatgagcgccgcgatcaaggacaaccgggccgtgcacgccgacatgggctactggatcgagtccgccctgaacgacacctggaagatggagaaggccagcttcatcgaggtcaagtcctgccactggcccaagagccacaccctgtggtccaacggcgtgctcgagagcgagatgatcatccccaagaacttcgcggggcccgtgtcccagcacaactaccgcccgggctaccacacccagaccgccgggccctggcacctgggcaagctggagatggacttcgacttctgcgaggggacgaccgtcgtggtgaccgaggactgcggcaaccggggccccagcctccgcaccacgaccgccagcgggaagctgatcaccgagtggtgctgccggtcctgcaccctgcccccgctccgctaccggggcgaggacgggtgctggtacggcatggagatccgccccctgaaggagaaggaggagaacctggtcaacagcctcgtgacggccgggcacggccagatcgacaacttctccctgggcgtgctggggatcgccctcttcctggaggagatgctgcggacccgcgtcggcaccaagcacgccatcctcctggtggccatcagcttcgtgaccctgatcacggggaacatgtccttccgggacctcggccgcgtcatggtgatggtgggggccaccatgaccgacgacatcggcatgggcgtcacctacctggccctgctcgcggccttcaaggtgcgccccacgttcgccgccgggctgctgctccggcgcctgaccagcaaggagctgatgatggccaccatcggcatcgcgctcctgtcccagagcaccatccccgagacgatcctggagctcaccgacgccctggccctggggatgatggtgctcaagatcgtccggaacatggagaagtaccagctggccgtgaccatcatggccatctcctgcgtgccgaacgcggtcatcctgctcaacgcctggaaggtgagctgcaccatcctggccgccgtgtccgtcagccccctgctcctgacgtccagccagcagaaggcggactggatccccctggccctcaccatcaagggcctgaaccccaccgccatcttcctgaccacgctctcccgcaccagcaagaagcggtcctggccgctgaacgaggccgtgatggccgtcggcatggtgagcatcctggcgtccagcctcctgaagaacgacatccccatgaccgggcccctggtggccggcgggctcctgaccgtctgctacgtgctgacgggccgcagcgccgacctcgagctggagcgggccgccgacgtgaagtgggaggaccacgcggagatctccgggagctcccccatcctgagcatcaccatctccgaggacggcagcatgtccatcaagaacgaggaggaggagcagaccctcaccatcctgatccgcacgggcctgctcgtcatcagcggggtgttcccggtgtccatccccatcaccgccgccgcctggtacctgtgggaggtcaagaagcagcgggccggcgtgctgtgggacgtgcccagcccgccgcccgtcgagaaggcggagctcgaggacggggcctaccgcatcaagcagcggggcatcctggggtactcccagatcggcgccggcgtgtacaaggaggggaccttccacaccatgtggcacgtgacccgcggcgccgtcctgatgcaccgggggaagcgcatcgagcccagctgggccgacgtgaagaaggacctcatctcctacggcgggggctggaagctggagggcgagtggaaggagggggaggaggtgcaggtcctggcgctcgagcccggcaagaacccccgggccgtgcagacgaagcccgggctgttcaagaccaacaccggcaccatcggggccgtgagcctggacttctcccccggcacgagcggctcccccatcgtcgaccgcaaggggaaggtggtgggcctctacgggaacggcgtcgtgacccggagcggcgcctacgtgtccgcgatcgcccagaccgagaagtccatcgagaacaaccccgagatcgaggacgacatcttccgcaagaagcggctgaccatcatggacctgcaccccggggccggcaagacgaagcgctacctgcccgccatcgtccgggaggccatcaagcgcgggctccgcaccctgatcctggcgccgacccgggtggtggccgccgagatggaggaggccctccgcggcctgcccatccggtaccagacccccgccatccgcgcggagcacacggggcgggagatcgtcgacctgatgtgccacgccaccttcaccatgcgcctcctgagccccgtgcgggtgccgaactacaacctgatcatcatggacgaggcccacttcaccgaccccgcctccatcgccgcgcgcggctacatcagcacgcgggtcgagatgggcgaggccgccgggatcttcatgaccgccacgccgcccggctcccgcgacccgttcccccagagcaacgcgcccatcatggacgaggagcgggagatccccgagcgctcctggaacagcgggcacgagtgggtgaccgacttcaagggcaagacggtgtggttcgtcccgtccatcaaggccgggaacgacatcgccgcctgcctccggaagaacggcaagaaggtgatccagctgagccgcaagaccttcgactccgagtacgtgaagacccgggccaacgactgggacttcgtcgtgaccacggacatcagcgagatgggcgcgaacttccgcgccgagcgggtgatcgacccccgccggtgcatgaagcccgtcatcctgaccgacggggaggagcgcgtgatcctcgccggccccatgccggtgacccactccagcgccgcccagcgccgggggcgcatcggccggaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgcgagaaggtcgacgccatcgacggcgagtaccggctgcgcggggaggcccggaagacgttcgtggacctgatgcgccggggcgacctccccgtgtggctggcctaccgcgtcgcggccgaggggatcaactacgccgaccggcgctggtgcttcgacggcatcaagaacaaccagatcctggaggagaacgtggaggtggagatctggaccaaggagggggagcggaagaagctcaagccgcgctggctggacgcccggatctacagcgaccccctggcgctcaaggagttcaaggagttcgccgccggccgcaagtccctgaccctgaacctcatcaccgagatgggccggctgcccacgttcatgacccagaaggcccgcgacgccctggacaacctcagcgtcctgcacaccgcggaggccgggggccgggcctacaaccacgccctgtccgagctccccgagaccctggagacgctgctcctgctgaccctcctggccaccgtgaccgggggcatcttcctgttcctcatgagcggcaaggggatcggcaagatgacgctggggatgtgctgcatcatcaccgcgtccatcctgctctggtacgcccagatccagccgcactggatcgccgccagcatcatcctggagttcttcctgatcgtcctcctgatccccgagcccgagaagcagcgcacgccccaggacaaccagctgacctacgtggtgatcgccatcctcaccgtcgtggcggccacgatggccaacgagatgggcttcctggagaagaccaagaaggacctggggctcggcagcatcaccacccaggagccggagtccaacatcctggacatcgacctgcggcccgccagcgcctggacgctctacgcggtggccaccaccttcgtcacccccatgctgcgccactccatcgagaacagctccgtgaacgtgagcctgacggccatcgccaaccaggcgaccgtcctcatgggcctggggaagggctggcccctgtccaagatggacatcggggtgccgctcctggccatcggctgctacagccaggtgaaccccatcaccctgaccgccgccctcctgctgctcgtcgcccactacgcgatcatcgggcccggcctgcaggccaaggccacgcgcgaggcccagaagcgggccgcggccggcatcatgaagaaccccaccgtggacgggatcaccgtgatcgacctggagccgatcccctacgaccccaagttcgagaagcagctcggccaggtcatgctgctgatcctctgcgtgacccaggtgctgatgatgcgcacgacctgggccctgtgcgaggccctcaccctggccaccgggcccatctccacgctgtgggagggcaacccggggcggttctggaacaccaccatcgcggtcagcatggccaacatcttccgcggctcctacctcgccggcgccgggctgctgttcagcatcatgaagaacaccacgaacacccggcgcggcaccgggaacatcggcgagaccctcggcgagaagtggaagtcccggctgaacgcgctgggcaagagcgagttccagatctacaagaagtccggcatccaggaggtggaccgcacgctcgccaaggaggggatcaagcggggcgagaccgaccaccacgccgtgagccgcgggtccgccaagctgcggtggttcgtcgagcgcaacatggtgacccccgagggcaaggtggtcgacctgggctgcgggcggggcgggtggagctactactgcggcgggctcaagaacgtgcgcgaggtgaagggcctgaccaagggcgggcccggccacgaggagcccatcccgatgtccacgtacgggtggaacctggtccggctccagagcggcgtggacgtgttcttcacgccgcccgagaagtgcgacaccctgctgtgcgacatcggggagagctcccccaacccgaccatcgaggccggccgcacgctccgggtcctgaacctggtggagaactggctcaacaacaacacccagttctgcatcaaggtgctgaacccctacatgcccagcgtcatcgagaagatggagaccctgcagcgcaagtacggcggggcgctggtgcggaacccgctctcccgcaacagcacccacgagatgtactgggtgtccaacgccaccggcaacatcgtcagctccgtgaacatgatcagccgcatgctgatcaaccggttcacgatgaagcacaagaaggccacctacgagcccgacgtggacctggggtccggcacccgcaacatcgggatcgagagcgagatccccaacctcgacatcatcggcaagcggatcgagaagatcaagcaggagcacgagacctcctggcactacgaccaggaccacccctacaagacgtgggcctaccacggcagctacgagaccaagcagaccgggtccgccagctccatggtcaacggcgtggtgcgcctgctgaccaagccgtgggacgtcgtgcccatggtgacgcagatggcgatgaccgacaccacccccttcgggcagcagcgggtcttcaaggagaaggtggacacgcgcacccaggagcccaaggagggcaccaagaagctcatgaagatcaccgccgagtggctgtggaaggagctgggcaagaagaagacgccgcggatgtgcacccgcgaggagttcacccggaaggtgcgcagcaacgccgccctcggggccatcttcaccgacgagaacaagtggaagtccgcgcgggaggccgtcgaggacagccgcttctgggagctggtggaccgggagcgcaacctgcacctcgagggcaagtgcgagacgtgcgtgtacaacatgatggggaagcgggagaagaagctgggcgagttcgggaaggccaagggctcccgcgccatctggtacatgtggctgggcgcgcggttcctcgagttcgaggccctggggttcctgaacgaggaccactggttcagccgcggcaacagcctctccggggtcgagggcgaggggctgcaccggctgggctacatcctccgcgacgtgagcaagaaggagggcggggccatgtacgccgacgacaccgccggctgggacacccggatcaccctggaggacctgaagaacgaggagatggtcacgaaccacatgaagggggagcacaagaagctcgcggaggccatcttcaagctgacctaccagaacaaggtggtgcgcgtccagcgccccacgccccggggcaccgtgatggacatcatctcccgccgggaccagcgcgggagcggccaggtgggcacgtacgggctgaacaccttcaccaacatggaggcccagctcatccggcagatggagggcgaggggatcttcaagtccatccagcacctgaccgtcacggaggagatcgccgtgcagaactggctggcccgcgtgggccgggagcgcctcagccggatggcgatctccggcgacgactgcgtcgtgaagcccctggacgaccgcttcgccagcgccctgaccgccctcaacgacatggggaaggtgcggaaggacatccagcagtgggagccgtcccgcggctggaacgactggacccaggtccccttctgcagccaccacttccacgagctggtgatgaaggacgggcgggtgctggtcgtgccctgccgcaaccaggacgagctcatcggccgggcccgcatctcccagggggcgggctggagcctgaaggagaccgcctgcctgggcaagtcctacgcccagatgtggacgctcatgtacttccaccggcgcgacctgcggctggccgccaacgcgatctgcagcgccgtgccctcccactgggtcccgaccagccgcaccacctggtccatccacgccaagcacgagtggatgaccacggaggacatgctcgccgtgtggaaccgcgtgtggatccaggagaacccctggatggaggacaagacccccgtcgagagctgggaggaggtgccctacctggggaagcgggaggaccagtggtgcggcagcctgatcgggctcacctcccgcgcgacctgggccaagaacatccagacggccatcaaccaggtgcggagcctgatcggcaacgaggagtacaccgactacatgccgtccatgaagcgcttccggcgcgaggaggaggaggccggggtcctgtggtga

SEQ ID NO: 9120 - RNA, 9876 nt, synthetic construct
  misc_feature 1..9876: note = derived and/or modified CDS sequence (opt1) from DENV-2__GQ868553__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcaggtcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacgcagaccgtggggccctggcacctcggcaagctggagatggacttcgacttctgcgaggggaccaccgtcgtggtgacggaggactgcggcaaccggggccccagcctgcgcaccaccaccgcgagcgggaagctcatcacggagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcgtcggcacgaagcacgccatcctgctcgtggcggtgagcttcgtcaccctgatcaccgggaacatgtccttccgggacctgggccgcgtgatggtgatggtcggggccaccatgacggacgacatcggcatgggcgtgacctacctcgccctgctggccgccttcaaggtgcgccccaccttcgcggccgggctcctgctgcggaagctcaccagcaaggagctgatgatggccacgatcggcatcgccctgctctcccagagcaccatccccgagaccatcttcgagctgaccgacgccctggcgctcgggatgatggtcctgaagatcgtgcgcaacatggagaagtaccagctggccgtgacgatcatggccatctcctgcgtcccgaacgccgtgatcctccagaacgcctggaaggtcagctgcaccatcctggcggccgtgtccgtgagccccctgctcctgacctccagccagcagaaggccgactggatccccctggccctcaccatcaagggcctgaaccccacggcgatcttcctgaccaccctctcccggaccagcaagaagcgctcctggccgctgaacgaggccatcatggccgtcggcatggtgagcatcctggcctccagcctcctgaagaacgacatccccatgacggggcccctggtggccggcgggctcctgaccgtctgctacgtgctgaccggccggagcgcggacctcgagctggagcgcgccgccgacgtgaagtgggaggaccaggccgagatctccgggagctcccccatcctgagcatcaccatctccgaggacggcagcatgtccatcaagaacgaggaggaggagcagatcctcacgatcctgatccggaccggcctgctcgtcatcagcggggtgttcccggtgtccatccccatcaccgccgcggcctggtacctgtgggaggtcaagaagcagcgcgccggcgtgctgtgggacgtgcccagcccgccgcccgtcgagaaggccgagctcgaggacggggcctaccggatcaagcagcgcggcatcctggggtactcccagatcggcgcgggcgtgtacaaggaggggaccttccacaccatgtggcacgtgacgcggggcgccgtcctgatgcaccgcgggaagcggatcgagcccagctgggccgacgtgaagaaggacctcatctcctacggcgggggctggaagctggagggcgagtggaaggagggggaggaggtgcaggtcctggccctcgagcccggcaagaacccccgcgccgtgcagaccaagcccgggatcttccggaccaacaccggcacgatcggggcggtgagcctggacttctcccccggcaccagcggctcccccatcgtcgaccgcaaggggaaggtggtgggcctgtacgggaacggcgtcgtgacccggagcggcgcctacgtgtccgccatcgcccagaccgagaagtccatcgaggacaaccccgagatcgaggacgacatcttccgcaagaagcggctcacgatcatggacctgcaccccggggcgggcaagaccaagcgctacctgcccgccatcgtccgggaggccatcaagcgcgggctccgcaccctgatcctggccccgacccgggtggtggccgcggagatggaggaggccctgcgcggcctccccatccggtaccagacgcccgccatcaaggccgagcacaccgggcgcgagatcgtcgacctgatgtgccacgccaccttcaccatgcggctgctcagccccgtgcgcgtgccgaactacaacctgatcatcatggacgaggcgcacttcacggaccccgcctccatcgccgcccggggctacatcagcacccgcgtcgagatgggcgaggccgcggggatcttcatgaccgccacgccgcccggctcccgggacccgttcccccagagcaacgcccccatcatggacgaggagcgcgagatccccgagcggtcctggaacagcgggcacgagtgggtgacggacttcaagggcaagaccgtgtggttcgtcccgtccatcaaggccgggaacgacatcgcggcctgcctgcgcaagaacggcaagaaggtgatccagctcagccggaagaccttcgactccgagtacgtgaagacccgcgccaacgactgggacttcgtcgtgacgaccgacatcagcgagatgggcgccaacttcaaggccgagcgggtgatcgacccccgccggtgcatgaagcccgtcatcctgaccgacggggaggagcgcgtgatcctggcgggccccatgccggtgacccactccagcgccgcccagcggcgcgggcgcatcggccggaaccccaagaacgagaacgaccagtacatctacatgggggagcccctcgagaacgacgaggactgcgcccactggaaggaggccaagatgctgctggacaacatcaacacgcccgagggcatcatcccgtccatgttcgagcccgagcgcgagaaggtcgacgcgatcgacggcgagtaccggctccgcggggaggcccggaagaccttcgtggacctgatgcgccggggcgacctgcccgtgtggctcgcctacaaggtcgccgccgaggggatcaactacgcggaccgcaagtggtgcttcgacggcatcaagaacaaccagatcctggaggagaacgtggaggtcgagatctggaccaaggagggggagcggaagaagctgaagccgcgctggctcgacgcccggatctacagcgaccccctggccctgaaggagttcaaggagttcgccgcgggccgcaagtccctcaccctgaacctgatcacggagatgggccggctccccaccttcatgacccagaaggcccgcaacgccctggacaacctggccgtgctccacaccgccgaggccgggggccgggcctacaaccacgccctgagcgagctgcccgagacgctcgagaccctgctgctcctgaccctgctcgccaccgtgaccgggggcatcttcctgttcctgatgtccggcaaggggatcggcaagatgaccctcgggatgtgctgcatcatcaccgccagcatcctgctgtggtacgcgcagatccagccgcactggatcgccgcctccatcatcctcgagttcttcctgatcgtcctgctcatccccgagcccgagaagcagcgcacgccccaggacaaccagctgacctacgtggtgatcgccatcctgacggtcgtggccgcgaccatggccaacgagatgggcttcctcgagaagaccaagaaggacctggggctgggcagcatcaccacgcaggagagcgagtccaacatcctcgacatcgacctgcggccggccagcgcctggaccctgtacgccgtggcgaccaccttcgtcacgcccatgctccgccactccatcgagaacagctccgtgaacgtgagcctgaccgccatcgccaaccaggccaccgtcctgatgggcctcgggaagggctggcccctgtccaagatggacatcggggtgcccctgctcgcgatcggctgctacagccaggtgaacccgatcaccctgacggccgccctgctcctgctggtcgcccactacgccatcatcgggcccggcctccaggcgaaggccacccgggaggcccagaagcgcgccgccgcgggcatcatgaagaaccccaccgtggacgggatcaccgtgatcgacctggagcccatcccgtacgaccccaagttcgagaagcagctgggccaggtcatgctcctgatcctgtgcgtgacccaggtgctcatgatgcggaccacctgggccctgtgcgaggccctgaccctcgccacggggcccatctccaccctgtgggagggcaaccccgggcgcttctggaacaccaccatcgccgtcagcatggcgaacatcttccgcggctcctacctggccggcgccgggctcctgttcagcatcatgaagaacacgaccaacacccggcgcggcaccgggaacatcggcgagacgctgggcgagaagtggaagtcccggctcaacgccctgggcaagagcgagttccagatctacaagaagtccggcatccaggaggtggaccgcaccctggcgaaggaggggatcaagcggggcgagaccgaccaccacgccgtgagccgcgggtccgccaagctccggtggttcgtcgagcgcaacatggtgaccccggagggcaaggtggtcgacctgggctgcgggcggggcgggtggagctactactgcggcgggctgaagaacgtgcgcgaggtgaagggcctcacgaagggcgggcccggccacgaggagcccatccccatgtccacctacgggtggaacctggtccggctgcagagcggcgtggacgtgttcttcaccccgcccgagaagtgcgacaccctcctgtgcgacatcggggagagctcccccaaccccacgatcgaggccggccgcaccctgcgggtcctcaacctggtggagaactggctgaacaacaacacccagttctgcatcaaggtgctcaacccgtacatgcccagcgtcatcgagaagatggagaccctgcagcgcaagtacggcggggccctggtgcggaaccccctctcccgcaacagcacccacgagatgtactgggtgtccaacgcgacgggcaacatcgtcagctccgtgaacatgatcagccggatgctgatcaaccgcttcaccatgaagcacaagaaggccacctacgagccggacgtggacctggggtccggcacccggaacatcgggatcgagagcgagatccccaacctggacatcatcggcaagcgcatcgagaagatcaagcaggagcacgagacgtcctggcactacgaccaggaccacccctacaagacctgggcctaccacggcagctacgagaccaagcagaccgggtccgccagctccatggtcaacggcgtggtgcgcctcctgacgaagccctgggacgtcgtgccgatggtgacccagatggccatgaccgacaccacgcccttcgggcagcagcgggtcttcaaggagaaggtggacacccgcacccaggagcccaaggagggcaccaagaagctgatgaagatcacggcggagtggctctggaaggagctgggcaagaagaagacgccccggatgtgcacccgcgaggagttcacccggaaggtgcgcagcaacgccgccctgggggccatcttcacggacgagaacaagtggaagtccgcccgggaggcggtcgaggacggccgcttctgggagctcgtggaccgggagcgcaacctgcacctggaggggaagtgcgagacctgcgtctacaacatgatgggcaagcgggagaagaagctcggggagttcggcaaggccaagggcagccgcgccatctggtacatgtggctgggggcccggttcctggagttcgaggcgctcggcttcctgaacgaggaccactggttctcccgcgggaacagcctgagcggcgtggagggggagggcctccaccggctgggctacatcctgcgcgacgtggggaagaaggagggcggggccatgtacgccgacgacaccgccggctgggacacccggatcacgctcgaggacctgaagaacgaggagatggtcaccaaccacatgaagggggagcacaagaagctggccgaggcgatcttcaagctcacctaccagaacaaggtggtgcgcgtccagcggccgacgccccgcggcacggtgatggacatcatctcccggcgcgaccagcgcggcagcggccaggtgggcacctacgggctgaacaccttcaccaacatggaggcccagctgatccggcagatggagggcgagggcatcttcaagtccatccagcacctcacggccaccgaggagatcgccgcccagaactggctggcgcgcgtcgggcgggagcgcctgagccggatggccatctccggcgacgactgcgtggtgaagcccatcgacgaccgcttcgccagcgccctcaccgccctgaacgacatggggaaggtccggaaggacatccagcagtgggagccctcccgcggctggaacgactggacccaggtgccgttctgcagccaccacttccacgagctggtgatgaaggacgggcgggtcctcgtggtgccctgccgcaaccaggacgagctgatcggccgggcgcgcatctcccagggcgccgggtggagcctgaaggagacggcctgcctcggcaagtcctacgcccagatgtggaccctgatgtacttccaccggcgcgacctgcggctcgccgcgaacgccatctgcagcgccgtcccctcccactgggtgcccaccagccgcaccacctggtccatccacgccaagcacgagtggatgacgaccgaggacatgctggcggtgtggaaccgggtctggatccaggagaacccgtggatggaggacaagacccccgtggagagctgggaggaggtgccctacctggggaagcgcgaggaccagtggtgcggctccctcatcgggctgaccagccgggccacgtgggccaagaacatccagaccgccatcaaccaggtccgcagcctgatcggcaacgaggagtacaccgactacatgccctccatgaagcgcttccggcgcgaggaggaggaggccggcgtgctctggtga

SEQ ID NO: 9121 - RNA, 9876 nt, synthetic construct
  misc_feature 1..9876: note = derived and/or modified CDS sequence (opt1) from DENV-2__GQ868554__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcatcgagaaggacagccccgtgaacatcgaggcggagccgcccttcggcgactcctacatcatcatcggggtggagccgggccagctgaagctcaactggttcaagaaggggagctccatcggccagatgttcgagaccacgatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggaccatgaagatcctgatcggcgtcgtgatcacgtggatcgggatgaacagccgctccaccagcctgtccgtgagcctggtcctcgtgggcgtggtcaccctgtacctgggggccatggtgcaggcggactccggctgcgtggtcagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtgacccgcctggagaacctcatgtggaagcagatcacccccgagctgaaccacatcctgtccgagaacgaggtcaagctcacgatcatgaccggcgacaccaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgtggagtgcccgaacacgaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggccgtgcacgcggacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccgcccgggctaccacacgcagaccgccgggccctggcacctcggcaagctggagatggacttcgacttctgcgaggggaccaccgtcgtggtgacggaggactgcggcaaccggggccccagcctgcgcaccaccaccgcgagcgggaagctcatcacggagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcgtcggcacgaagcacgccatcctgctcgtggcggtgagcttcgtcaccctgatcaccgggaacatgtccttccgggacctgggccgcgtgatggtgatggtcggggccaccatgacggacgacatcggcatgggcgtgacctacctcgccctgctggccgccttcaaggtgcgccccaccttcgcggccgggctcctgctgcggaagctcaccagcaaggagctgatgatggccacgatcggcatcaccctgctctcccagagcaccatccccgagaccatcctggagctgacggacgccctcgccctggggatgatggtcctgaagatcgtgcgcaacatggagaagtaccagctcgcggtgaccatcatggccatctcctgcgtcccgaacgccgtgatcctgcggaacgcctggaaggtcagctgcaccatcctggccgcggtgtccgtgagccccctcctgctgacctccagccagcagaaggccgactggatccccctcgccctgacgatcaagggcctgaaccccaccgccatcttcctcaccaccctgtcccgcacgagcaagaagcggtcctggccgctgaacgaggcgatcatggccgtcggcatggtgagcatcctcgcctccagcctgctgaagaacgacatccccatgaccgggcccctcgtggccggcgggctgctgaccgtctgctacgtgctcaccggccgcagcgccgacctggagctggagcgggcggccgacgtgaagtgggaggaccaggccgagatctccgggagctcccccatcctcagcatcacgatctccgaggacggcagcatgtccatcaagaacgaggaggaggagcagaccctgaccatcctgatccgcaccggcctcctggtcatcagcggggtgttcccggtgtccatccccatcaccgccgccgcgtggtacctgtgggaggtcaagaagcagcgggccggcgtgctctgggacgtgcccagcccgccgcccgtcgggaaggccgagctggaggacggcgcctaccgcatcaagcagcgggggatcctgggctactcccagatcggcgccggggtgtacaaggagggcacgttccacaccatgtggcacgtgacccgcggggcggtcctcatgcaccggggcaagcgcatcgagcccagctgggccgacgtgaagaaggacctgatctcctacgggggcggctggaagctggagggggagtggaaggagggcgaggaggtgcaggtcctcgccctggagcccgggaagaacccccgggccgtgcagaccaagcccggcatcttcaagacgaacaccgggaccatcggcgccgtgagcctggacttctcccccggcaccagcgggtcccccatcgtcgaccgcaagggcaaggtggtggggctctacggcaacggcgtcgtgacgcggagcggggcgtacgtgtccgccatcgcccagaccgagaagtccatcgaggacaaccccgagatcgaggacgacatcttccgcaagaagcggctgaccatcatggacctgcaccccggcgccgggaagaccaagcgctacctccccgcgatcgtccgggaggccatcaagcgcggcctgcgcacgctgatcctggccccgacccgggtggtggccgccgagatggaggaggcgctccgcgggctgcccatccggtaccagacccccgccatcaaggccgagcacaccggccgcgagatcgtcgacctgatgtgccacgccacgttcaccatgcggctcctgagccccgtgcgcgtgccgaactacaacctgatcatcatggacgaggcccacttcaccgaccccgcgtccatcgccgcccggggctacatcagcacccgcgtcgagatgggggaggccgccggcatcttcatgacggcgacgccgcccgggtcccgggacccgttcccccagagcaacgcccccatcatggacgaggagcgcgagatccccgagcggtcctggaacagcggccacgagtgggtgaccgacttcaaggggaagaccgtgtggttcgtcccgtccatcaaggccggcaacgacatcgccgcgtgcctccgcaagaacggcaagaaggtgatccagctgagccggaagacgttcgactccgagtacgtgaagacccgcgccaacgactgggacttcgtcgtgaccaccgacatcagcgagatgggggccaacttcaaggccgagcgggtgatcgacccccgccggtgcatgaagcccgtcatcctgacggacggcgaggagcgcgtgatcctcgccgggcccatgccggtgacccactccagcgcggcccagcggcgcggccgcatcgggcggaaccccaagaacgagaacgaccagtacatctacatgggcgagcccctggagaacgacgaggactgcgcccactggaaggaggccaagatgctgctcgacaacatcaacacccccgagggcatcatcccgtccatgttcgagcccgagcgcgagaaggtcgacgccatcgacggggagtaccggctgcgcggcgaggcgcggaagaccttcgtggacctgatgcgccgcggggacctccccgtgtggctggcctacaaggtcgccgccgagggcatcaactacgccgaccgcaagtggtgcttcgacgggatcaagaacaaccagatcctggaggagaacgtggaggtcgagatctggacgaaggagggcgagcggaagaagctcaagccgcgctggctggacgcgcggatctacagcgaccccctggccctcaaggagttcaaggagttcgccgccggccgcaagtccctgaccctgaacctcatcaccgagatggggcggctgcccaccttcatgacgcagaaggcgcgcaacgccctggacaacctcgccgtgctgcacaccgccgaggccggcgggcgggcgtacaaccacgccctgagcgagctccccgagaccctggagaccctgctcctgctgacgctcctggccaccgtgaccggcggcatcttcctgttcctcatgtccgggaagggcatcgggaagatgaccctgggcatgtgctgcatcatcaccgccagcgtcctgctctggtacgcccagatccagccgcactggatcgcggcctccatcatcctggagttcttcctgatcgtgctcctgatccccgagcccgagaagcagcgcacgccccaggacaaccagctgacctacgtggtcatcgccatcctcaccgtggtggccgccaccatggcgaacgagatggggttcctggagaagacgaagaaggacctgggcctcggcagcatcaccacccaggagagcgagtccaacatcctggacatcgacctgcggccggccagcgcctggaccctctacgccgtcgccacgaccttcgtgacccccatgctgcgccactccatcgagaacagctccgtgaacgtcagcctgaccgcgatcgccaaccaggccacggtgctcatggggctgggcaaggggtggcccctgtccaagatggacatcggcgtgcccctcctggccatcgggtgctacagccaggtcaacccgatcaccctgaccgcggccctcctgctgctcgtggcccactacgccatcatcggccccggcctgcaggccaaggcgacccgggaggcccagaagcgcgccgccgccgggatcatgaagaaccccacggtggacggcatcaccgtcatcgacctggagcccatcccgtacgaccccaagttcgagaagcagctcgggcaggtcatgctgctgatcctctgcgtgacccaggtcctgatgatgcggaccacgtgggcgctgtgcgaggccctcaccctggccaccggccccatctccaccctgtgggaggggaaccccggccgcttctggaacacgaccatcgccgtgagcatggccaacatcttccgcggctcctacctcgcgggggccggcctgctgttcagcatcatgaagaacaccaccaacacgcggcgcgggaccggcaacatcggcgagaccctcggggagaagtggaagtcccggctgaacgccctgggcaagagcgagttccagatctacaagaagtccgggatccaggaggtggaccgcaccctcgccaaggagggcatcaagcgcggggagacggaccaccacgcggtcagccgcggctccgccaagctgcggtggttcgtggagcgcaacatggtgaccccggagggcaaggtcgtggacctggggtgcggccgcgggggctggagctactactgcgggggcctcaagaacgtgcgcgaggtcaagggcctgaccaagggcggccccgggcacgaggagcccatccccatgtccacctacggctggaacctggtgcggctccagagcggggtggacgtcttcttcacgccgcccgagaagtgcgacaccctgctgtgcgacatcggcgagagctcccccaaccccaccatcgaggccggccgcaccctccgggtgctgaacctggtggagaactggctcaacaacaacacccagttctgcatcaaggtcctgaacccgtacatgcccagcgtgatcgagaagatggagacgctgcagcgcaagtacgggggcgccctcgtgcggaaccccctgtcccgcaacagcacccacgagatgtactgggtctccaacgccaccgggaacatcgtgagctccgtgaacatgatcagccggatgctgatcaaccgcttcaccatgaagcacaagaaggcgacgtacgagccggacgtcgacctgggctccgggacccggaacatcggcatcgagagcgagatccccaacctcgacatcatcggcaagcgcatcgagaagatcaagcaggagcacgagacctcctggcactacgaccaggaccacccctacaagacctgggcctaccacgggagctacgagacgaagcagaccggctccgccagctccatggtgaacggggtggtccgcctgctgaccaagccctgggacgtggtgccgatggtcacccagatggccatgacggacaccacccccttcggccagcagcgggtgttcaaggagaaggtggacacccgcacgcaggagcccaaggagggcaccaagaagctcatgcggatcaccgccgagtggctgtggaaggagctggggaagaagaagacgccccggatgtgcacgcgggaggagttcacccgcaaggtccggagcaacgcggccctcggcgccatcttcaccgacgagaacaagtggaagtccgcccgcgaggccgtggaggacgggcggttctgggagctggtcgaccgcgagcggaacctgcacctcgagggcaagtgcgagacctgcgtgtacaacatgatggggaagcgcgagaagaagctgggcgagttcggcaaggcgaaggggagccgggccatctggtacatgtggctgggcgcccgcttcctcgagttcgaggccctggggttcctgaacgaggaccactggttctcccggggcaacagcctcagcggggtggagggcgagggcctgcaccgcctggggtacatcctccgggacgtcggcaagaaggagggcggcgcgatgtacgccgacgacacggccgggtgggacacccgcatcaccctggaggacctgaagaacgaggagatggtgaccaaccacatgaagggcgagcacaagaagctcgccgaggccatcttcaagctgacgtaccagaacaaggtggtccgggtgcagcgcccgacgccccggggcaccgtgatggacatcatctcccgccgcgaccagcgggggagcggccaggtcgggacctacggcctgaacacgttcaccaacatggaggcgcagctcatccgccagatggagggcgaggggatcttcaagtccatccagcacctgaccgccaccgaggagatcgccgtgcagaactggctggcccgggtgggccgcgagcggctcagccgcatggccatctccggggacgactgcgtcgtgaagcccatcgacgaccggttcgcgagcgccctgacggccctgaacgacatgggcaaggtgcgcaaggacatccagcagtgggagccctcccgggggtggaacgactggacccaggtcccgttctgcagccaccacttccacgagctcgtgatgaaggacggccgcgtgctggtcgtgccctgccggaaccaggacgagctgatcggccgcgcccggatctcccagggggccggctggagcctcaaggagaccgcgtgcctggggaagtcctacgcccagatgtggaccctgatgtacttccaccgccgggacctccgcctggccgccaacgccatctgcagcgcggtgccctcccactgggtccccaccagccggacgacctggtccatccacgccaagcacgagtggatgaccaccgaggacatgctggccgtgtggaaccgcgtgtggatccaggagaacccgtggatggaggacaagacgcccgtcgagagctgggaggaggtgccctacctcggcaagcgggaggaccagtggtgcgggtccctgatcggcctgaccagccgcgccacctgggcgaagaacatccagaccgccatcaaccaggtgcgcagcctcatcggcaacgaggagtacacggactacatgccctccatgaagcggttccgccgggaggaggaggaggccggggtcctgtggtga

SEQ ID NO: 9122 - RNA, 9876 nt, synthetic construct
  misc_feature 1..9876: note = derived and/or modified CDS sequence (opt1) from DENV-2__GQ868555__SS-prME
  source 1..9876: mol_type = other RNA
accgccggcgtgatcgtcatgctgatccccaccgccatcgcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcgtgatcacctggatcgggatgaacagccgctccaccagcctgtccgtgagcctggtcctcgtgggcgtggtcaccctgtacctgggggccatggtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacaccaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacacgctgtggtccaacggcgtcctggagagcgagatgatcatccccaagaacttcgccgggcccgtgtcccagcacaactaccgcccgggctaccacacccagaccgcggggccctggcacctcggcaagctggagatggacttcgacctgtgcgaggggaccacggtggtcgtgaccgaggactgcggcaaccggggccccagcctccgcaccaccacggccagcgggaagctgatcaccgagtggtgctgccggtcctgcaccctgcccccgctccgctaccggggcgaggacgggtgctggtacggcatggagatccgccccctgaaggagaaggaggagaacctggtgaacagcctcgtcaccgccgggcacggccagatcgacaacttctccctgggcgtgctggggatggccctcttcctggaggagatgctgcggacgcgcgtgggcaccaagcacgcgatcctcctggtcgccgtgagcttcgtgaccctgatcaccgggaacatgtccttccgggacctcggccgcgtcatggtgatggtgggggccacgatgaccgacgacatcggcatgggcgtcacctacctggccctgctcgccgcgttcaaggtgcgccccaccttcgccgccgggctgctgctccggaagctgacgagcaaggagctgatgatggccaccatcggcatcgccctcctgtcccagagcaccatccccgagaccatcctggagctcacggacgcgctggccctggggatgatggtgctcaagatcgtccgcaacatggagaagtaccagctggccgtgaccatcatggccatctcctgcgtgccgaacgccgtcatcctgcggaacgcgtggaaggtgagctgcaccatcctcgccgccgtctccgtgagccccctgctgctcacctccagccagcagaaggccgactggatccccctggcgctgacgatcaagggcctcaaccccaccgccatcttcctgaccaccctgtcccgcacgagcaagaagcggtcctggccgctcaacgaggccatcatggccgtgggcatggtcagcatcctggcctccagcctgctcaagaacgacatccccatgaccgggcccctggtggcgggcgggctgctcaccgtgtgctacgtcctgaccggccgcagcgccgacctggagctcgagcgggccgccgaggtgaagtgggaggaccaggccgagatctccgggagctcccccatcctgagcatcacgatctccgaggacggcagcatgtccatcaagaacgaggaggaggagcagaccctgaccatcctcatccgcaccggcctgctggtgatcagcggggtcttcccggtgtccatccccatcaccgcggccgcctggtacctctgggaggtgaagaagcagcgggccggcgtcctgtgggacgtgcccagcccgccgcccgtggggaaggccgagctggaggagggcgcgtaccgcatcaagcagcgggggatcctcggctactcccagatcggcgccggggtctacaaggagggcacgttccacaccatgtggcacgtgacccgcggggccgtgctgatgcaccggggcaagcgcatcgagcccagctgggccgacgtcaagaaggacctgatctcctacgggggcggctggaagctcgagggggagtggaaggagggcgaggaggtccaggtgctggccctggagcccgggaagaacccccgggcggtccagaccaagcccggcatcttcaagacgaacaccgggaccatcggcgccgtgagcctcgacttctcccccggcaccagcgggtcccccatcgtggaccgcaagggcaaggtcgtggggctgtacggcaacggcgtggtcacgcggagcggggcctacgtgtccgccatcgcgcagaccgagaagtccatcgaggacaaccccgagatcgaggacgacatcttccgcaagaagcggctgaccatcatggacctccaccccggcgccgggaagaccaagcgctacctgcccgccatcgtgcgggaggccatcaagcgcggcctgcgcacgctgatcctcgccccgacccgggtcgtggcggccgagatggaggaggccctgcgcgggctgcccatccggtaccagacccccgccatcaaggccgagcacaccggccgcgagatcgtggacctcatgtgccacgcgacgttcaccatgcggctgctgagccccgtccgcgtgccgaactacaacctcatcatcatggacgaggcccacttcaccgaccccgcctccatcgccgcccggggctacatcagcacccgcgtggagatgggggaggcggccggcatcttcatgacggccacgccgcccgggtcccgggacccgttcccccagagcaacgcccccatcatggacgaggagcgcgagatccccgagcggtcctggaacagcggccacgagtgggtcaccgacttcaaggggaagaccgtgtggttcgtgccgtccatcaaggcgggcaacgacatcgccgcctgcctgcgcaagaacggcaagaaggtcatccagctgagccggaagacgttcgactccgagtacgtgaagacccgcgccaacgactgggacttcgtggtcaccaccgacatcagcgagatgggggccaacttcaaggcggagcgggtgatcgacccccgccggtgcatgaagcccgtgatcctcacggacggcgaggagcgcgtcatcctggccgggcccatgccggtgacccactccagcgccgcccagcggcgcggccgcatcgggcggaaccccaagaacgagaacgaccagtacatctacatgggcgagcccctggagaacgacgaggactgcgcccactggaaggaggcgaagatgctcctggacaacatcaacacccccgagggcatcatcccgtccatgttcgagcccgagcgcgagaaggtggacgccatcgacggggagtaccggctgcgcggcgaggcccggaagaccttcgtcgacctcatgcgccgcggggacctgcccgtgtggctggcctacaaggtggccgcggagggcatcaactacgccgaccgcaagtggtgcttcgacgggatcaagaacaaccagatcctcgaggagaacgtcgaggtggagatctggacgaaggagggcgagcggaagaagctgaagccgcgctggctggacgcccggatctacagcgaccccctcgccctgaaggagttcaaggagttcgcggccggccgcaagtccctgaccctcaacctgatcaccgagatggggcggctgcccaccttcatgacgcagaaggcccgcaacgccctcgacaacctggccgtcctgcacaccgcggaggccggcgggcgggcctacaaccacgccctcagcgagctgcccgagaccctggagaccctcctgctgctcacgctgctggccaccgtgaccggcggcatcttcctcttcctgatgtccgggaagggcatcgggaagatgaccctgggcatgtgctgcatcatcaccgcgagcgtgctcctgtggtacgcccagatccagccgcactggatcgccgcctccatcatcctggagttcttcctcatcgtcctgctgatccccgagcccgagaagcagcgcacgccccaggacaaccagctcacctacgtggtgatcgccatcctgaccgtcgtggcggccaccatggccaacgagatggggttcctggagaagacgaagaaggacctcggcctgggcagcatcaccacccaggagagcgagtccaacatcctggacatcgacctccggccggccagcgcctggaccctgtacgcggtggccacgaccttcgtcacccccatgctgcgccactccatcgagaacagctccgtgaacgtgagcctcaccgccatcgccaaccaggcgacggtcctgatggggctgggcaaggggtggcccctctccaagatggacatcggcgtgcccctgctggccatcgggtgctacagccaggtgaacccgatcaccctcaccgccgccctgctgctcctggtcgcccactacgcgatcatcggccccggcctgcaggccaaggccacccgggaggcccagaagcgcgccgcggccgggatcatgaagaaccccacggtggacggcatcaccgtgatcgacctcgagcccatcccgtacgaccccaagttcgagaagcagctggggcaggtcatgctgctcatcctgtgcgtgacccaggtgctgatgatgcggaccacgtgggccctctgcgaggccctgaccctggccaccggccccatctccaccctctgggaggggaaccccggccgcttctggaacacgaccatcgcggtcagcatggccaacatcttccgcggctcctacctggccggggccggcctcctgttcagcatcatgaagaacaccaccaacacgcggcgcgggaccggcaacatcggcgagaccctgggggagaagtggaagtcccggctgaacgcgctcggcaagagcgagttccagatctacaagaagtccgggatccaggaggtggaccgcaccctggccaaggagggcatcaagcgcggggagacggaccaccacgccgtgagccgcggctccgccaagctgcggtggttcgtcgagcgcaacatggtgaccccggagggcaaggtggtcgacctcgggtgcggccgcgggggctggagctactactgcgggggcctgaagaacgtgcgcgaggtgaagggcctgaccaagggcggccccgggcacgaggagcccatccccatgtccacctacggctggaacctcgtccggctgcagagcggggtggacgtgttcttcacgccgcccgagaagtgcgacaccctgctctgcgacatcggcgagagctcccccaaccccaccatcgaggccggccgcaccctgcgggtcctgaacctcgtggagaactggctgaacaacaacacccagttctgcatcaaggtgctgaacccgtacatgcccagcgtcatcgagaagatggagacgctccagcgcaagtacgggggcgcgctggtgcggaaccccctgtcccgcaacagcacccacgagatgtactgggtgtccaacgccaccgggaacatcgtcagctccgtgaacatgatcagccggatgctgatcaaccgcttcaccatgaagcacaagaaggccacgtacgagccggacgtggacctcggctccgggacccggaacatcggcatcgagagcgagatccccaacctggacatcatcggcaagcgcatcgagaagatcaagcaggagcacgagacctcctggcactacgaccaggaccacccctacaagacctgggcctaccacgggagctacgagacgaagcagaccggctccgccagctccatggtcaacggggtggtgcgcctgctcaccaagccctgggacgtcgtgccgatggtgacccagatggcgatgacggacaccacccccttcggccagcagcgggtcttcaaggagaaggtggacacccgcacgcaggagcccaaggagggcaccaagaagctgatgaagatcaccgccgagtggctgtggaaggagctcgggaagaagaagacgccccggatgtgcacgcgcgaggagttcacccggaaggtgcgcagcaacgccgccctgggcgccatcttcaccgacgagaacaagtggaagtccgcgcgggaggccgtcgaggacgggcgcttctgggagctggtggaccgggagcgcaacctccacctggagggcaagtgcgagacctgcgtctacaacatgatggggaagcgggagaagaagctgggcgagttcggcaaggccaaggggagccgcgccatctggtacatgtggctcggcgcgcggttcctggagttcgaggccctggggttcctcaacgaggaccactggttctcccgcggcaacagcctgagcggggtggagggcgagggcctgcaccggctcgggtacatcctgcgcgacgtgtccaagaaggagggcggggccatgtacgccgacgacacggccggctgggacacccggatcaccctggaggacctcaagaacgaggagatggtcaccaaccacatgaagggggagcacaagaagctggcggaggccatcttcaagctgacgtaccagaacaaggtggtgcgcgtccagcggccgacgccccggggcaccgtgatggacatcatcagccggcgcgaccagcgcggctccggccaggtgggcacctacgggctcaacacgttcaccaacatcgaggcccagctgatccggcagatggagggcgagggcatcttcaagagcatccagcacctgaccgccaccgaggagatcgccgtccagaactggctcgcgcgcgtggggcgggagcgcctgtcccggatggccatcagcggcgacgactgcgtggtcaagcccatcgacgaccgcttcgcctccgccctgacggccctcaacgacatggggaaggtgcggaaggacatccagcagtgggagcccagccgcggctggaacgactggacccaggtgccgttctgctcccaccacttccacgagctggtcatgaaggacgggcgggtgctggtggtcccctgccgcaaccaggacgagctcatcggccgggcgcgcatcagccagggcgccgggtggtccctgaaggagaccgcctgcctgggcaagagctacgcccagatgtggaccctcatgtacttccaccggcgcgacctgcggctggccgcgaacgccatctgctccgccgtgcccagccactgggtgcccacctcccgcacgacctggagcatccacgccaagcacgagtggatgaccaccgaggacatgctcgcggtctggaaccgggtgtggatccaggagaacccgtggatggaggacaagacgcccgtggagtcctgggaggaggtcccctacctggggaagcgcgaggaccagtggtgcggcagcctgatcgggctcaccagccgggccacctgggccaagaacatccagaccgccatcaaccaggtgcgctccctgatcggcaacgaggagtacacggactacatgcccagcatgaagcgcttccggcgcgaggaggaggaggccggcgtgctgtggtga

SEQ ID NO: 9123 - RNA, 9876 nt, synthetic construct
  misc_feature 1..9876: note = derived and/or modified CDS sequence (opt1) from DENV-2__GQ868556__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcatcgagaaggacagccccgtgaacatcgaggcggagccgcccttcggcgactcctacatcatcatcggggtggagccgggccagctgaagctcaactggttcaagaaggggagctccatcggccagatgttcgagaccacgatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggaccatgaagatcctgatcggcgtcgtgatcacgtggatcgggatgaacagccgctccaccagcctgtccgtgagcctggtcctcgtgggcgtggtcaccctgtacctgggggccatggtgcaggcggactccggctgcgtggtcagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtgacccgcctggagaacctcatgtggaagcagatcacccccgagctgaaccacatcctgtccgagaacgaggtcaagctcacgatcatgaccggcgacaccaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtggtcgtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcgtgggcacgaagcacgcgatcctgctcgtcgccgtgagcttcgtgaccctgatcaccgggaacatgtccttccgggacctgggccgcgtcatggtgatggtgggggccaccatgacggacgacatcggcatgggcgtcacctacctcgccctgctggccgcgttcaaggtgcgccccaccttcgccgccgggctcctgctgcggaagctcaccagcaaggagctgatgatggccacgatcggcatcaccctgctctcccagagcaccatccccgagaccatcctggagctgacggacgccctcgcgctggggatgatggtgctgaagatcgtccgcaacatggagaagtaccagctcgccgtgaccatcatggccatctcctgcgtgccgaacgccgtcatcctgcggaacgcctggaaggtgagctgcaccatcctggcggccgtctccgtgagccccctcctgctgacctccagccagcagaaggccgactggatccccctcgccctgacgatcaagggcctgaaccccaccgcgatcttcctcaccaccctgtcccgcacgagcaagaagcggtcctggccgctgaacgaggccatcatggccgtgggcatggtcagcatcctcgcctccagcctgctgaagaacgacatccccatgaccgggcccctcgtggccggcgggctgctgaccgtgtgctacgtcctcaccggccgcagcgcggacctggagctggagcgggccgccgacgtgaagtgggaggaccaggccgagatctccgggagctcccccatcctcagcatcacgatctccgaggacggcagcatgtccatcaagaacgaggaggaggagcagaccctgaccatcctgatccgcaccggcctcctggtgatcagcggggtcttcccggtgtccatccccatcaccgccgcggcctggtacctgtgggaggtgaagaagcagcgggccggcgtcctctgggacgtgcccagcccgccgcccgtggggaaggccgagctggaggacggcgcctaccgcatcaagcagcgggggatcctgggctactcccagatcggcgcgggggtctacaaggagggcacgttccacaccatgtggcacgtgacccgcggggccgtgctcatgcaccggggcaagcgcatcgagcccagctgggccgacgtcaagaaggacctgatctcctacgggggcggctggaagctggagggggagtggaaggagggcgaggaggtccaggtgctcgccctggagcccgggaagaacccccgggccgtccagaccaagcccggcatcttcaagacgaacaccgggaccatcggcgcggtgagcctggacttctcccccggcaccagcgggtcccccatcgtggaccgcaagggcaaggtcgtggggctctacggcaacggcgtggtcacgcggagcggggcctacgtgtccgccatcgcccagaccgagaagtccatcgaggacaaccccgagatcgaggacgacatcttccgcaagaagcggctgaccatcatggacctgcaccccggcgcggggaagaccaagcgctacctccccgccatcgtgcgggaggccatcaagcgcggcctgcgcacgctgatcctggccccgacccgggtcgtggccgcggagatggaggaggccctccgcgggctgcccatccggtaccagacccccgccatcaaggccgagcacaccggccgcgagatcgtggacctgatgtgccacgccacgttcaccatgcggctcctgagccccgtccgcgtgccgaactacaacctgatcatcatggacgaggcgcacttcaccgaccccgcctccatcgccgcccggggctacatcagcacccgcgtggagatgggggaggccgcgggcatcttcatgacggccacgccgcccgggtcccgggacccgttcccccagagcaacgcccccatcatggacgaggagcgcgagatccccgagcggtcctggaacagcggccacgagtgggtcaccgacttcaaggggaagaccgtgtggttcgtgccgtccatcaaggccggcaacgacatcgcggcctgcctccgcaagaacggcaagaaggtcatccagctgagccggaagacgttcgactccgagtacgtgaagacccgcgccaacgactgggacttcgtggtcaccaccgacatcagcgagatgggggccaacttcaaggccgagcgggtgatcgacccccgccggtgcatgaagcccgtgatcctgacggacggcgaggagcgcgtcatcctcgcggggcccatgccggtgacccactccagcgccgcccagcggcgcggccgcatcgggcggaaccccaagaacgagaacgaccagtacatctacatgggcgagcccctggagaacgacgaggactgcgcccactggaaggaggccaagatgctgctcgacaacatcaacacccccgagggcatcatcccgtccatgttcgagcccgagcgcgagaaggtggacgcgatcgacggggagtaccggctgcgcggcgaggcccggaagaccttcgtcgacctgatgcgccgcggggacctccccgtgtggctggcctacaaggtggccgccgagggcatcaactacgcggaccgcaagtggtgcttcgacgggatcaagaacaaccagatcctggaggagaacgtcgaggtggagatctggacgaaggagggcgagcggaagaagctcaagccgcgctggctggacgcccggatctacagcgaccccctggccctcaaggagttcaaggagttcgccgcgggccgcaagtccctgaccctgaacctcatcaccgagatggggcggctgcccaccttcatgacgcagaaggcccgcaacgccctggacaacctcgccgtcctgcacaccgccgaggcgggcgggcgggcctacaaccacgccctgagcgagctccccgagaccctggagaccctgctcctgctgacgctcctggccaccgtgaccggcggcatcttcctgttcctcatgtccgggaagggcatcgggaagatgaccctgggcatgtgctgcatcatcaccgccagcgtgctgctctggtacgcgcagatccagccgcactggatcgccgcctccatcatcctggagttcttcctgatcgtcctcctgatccccgagcccgagaagcagcgcacgccccaggacaaccagctgacctacgtggtgatcgccatcctcaccgtcgtggccgcgaccatggccaacgagatggggttcctggagaagacgaagaaggacctgggcctcggcagcatcaccacccaggagagcgagtccaacatcctggacatcgacctgcggccggccagcgcctggaccctctacgccgtggcgacgaccttcgtcacccccatgctgcgccactccatcgagaacagctccgtgaacgtgagcctgaccgccatcgccaaccaggccacggtcctcatggggctgggcaaggggtggcccctgtccaagatggacatcggcgtgcccctcctggcgatcgggtgctacagccaggtgaacccgatcaccctgaccgccgccctcctgctgctcgtcgcccactacgccatcatcggccccggcctgcaggcgaaggccacccgggaggcccagaagcgcgccgccgcggggatcatgaagaaccccacggtggacggcatcaccgtgatcgacctggagcccatcccgtacgaccccaagttcgagaagcagctcgggcaggtcatgctgctgatcctctgcgtgacccaggtgctgatgatgcggaccacgtgggccctgtgcgaggccctcaccctggccaccggccccatctccaccctgtgggaggggaaccccggccgcttctggaacacgaccatcgccgtcagcatggcgaacatcttccgcggctcctacctcgccggggccggcctgctgttcagcatcatgaagaacaccaccaacacgcggcgcgggaccggcaacatcggcgagaccctcggggagaagtggaagtcccggctgaacgccctgggcaagagcgagttccagatctacaagaagtccgggatccaggaggtggaccgcaccctcgcgaaggagggcatcaagcgcggggagacggaccaccacgccgtgagccgcggctccgccaagctgcggtggttcgtcgagcgcaacatggtgaccccggagggcaaggtggtcgacctggggtgcggccgcgggggctggagctactactgcgggggcctcaagaacgtgcgcgaggtgaagggcctgaccaagggcggccccgggcacgaggagcccatccccatgtccacctacggctggaacctggtccggctccagagcggggtggacgtgttcttcacgccgcccgagaagtgcgacaccctgctgtgcgacatcggcgagagctcccccaaccccaccatcgaggccggccgcaccctccgggtcctgaacctggtggagaactggctcaacaacaacacccagttctgcatcaaggtgctgaacccgtacatgcccagcgtcatcgagaagatggagacgctgcagcgcaagtacgggggcgccctcgtgcggaaccccctgtcccgcaacagcacccacgagatgtactgggtgtccaacgcgaccgggaacatcgtcagctccgtgaacatgatcagccggatgctgatcaaccgcttcaccatgaagcacaagaaggccacgtacgagccggacgtggacctgggctccgggacccggaacatcggcatcgagagcgagatccccaacctcgacatcatcggcaagcgcatcgagaagatcaagcaggagcacgagacctcctggcactacgaccaggaccacccctacaagacctgggcctaccacgggagctacgagacgaagcagaccggctccgccagctccatggtcaacggggtggtgcgcctgctgaccaagccctgggacgtcgtgccgatggtgacccagatggccatgacggacaccacccccttcggccagcagcgggtcttcaaggagaaggtggacacccgcacgcaggagcccaaggagggcaccaagaagctcatgcggatcaccgcggagtggctgtggaaggagctggggaagaagaagacgccccggatgtgcacgcgggaggagttcacccgcaaggtgcggagcaacgccgccctcggcgccatcttcaccgacgagaacaagtggaagtccgcccgcgaggcggtcgaggacgggcggttctgggagctggtggaccgcgagcggaacctgcacctcgagggcaagtgcgagacctgcgtctacaacatgatggggaagcgcgagaagaagctgggcgagttcggcaaggccaaggggagccgggccatctggtacatgtggctgggcgcccgcttcctcgagttcgaggcgctggggttcctgaacgaggaccactggttctcccggggcaacagcctcagcggggtggagggcgagggcctgcaccgcctggggtacatcctccgggacgtgggcaagaaggagggcggcgccatgtacgccgacgacacggccgggtgggacacccgcatcaccctggaggacctgaagaacgaggagatggtcaccaaccacatgaagggcgagcacaagaagctcgccgaggcgatcttcaagctgacgtaccagaacaaggtggtgcgggtccagcgcccgacgccccggggcaccgtgatggacatcatctcccgccgcgaccagcgggggagcggccaggtggggacctacggcctgaacacgttcaccaacatggaggcccagctcatccgccagatggagggcgaggggatcttcaagtccatccagcacctgaccgccaccgaggagatcgccgtccagaactggctggcccgggtgggccgcgagcggctcagccgcatggcgatctccggggacgactgcgtggtcaagcccatcgacgaccggttcgccagcgccctgacggccctgaacgacatgggcaaggtgcgcaaggacatccagcagtgggagccctcccgggggtggaacgactggacccaggtgccgttctgcagccaccacttccacgagctcgtcatgaaggacggccgcgtgctggtggtcccctgccggaaccaggacgagctgatcggccgcgcccggatctcccagggggcgggctggagcctcaaggagaccgcctgcctggggaagtcctacgcccagatgtggaccctgatgtacttccaccgccgggacctccgcctggccgccaacgcgatctgcagcgccgtgccctcccactgggtgcccaccagccggacgacctggtccatccacgccaagcacgagtggatgaccaccgaggacatgctggccgtctggaaccgcgtgtggatccaggagaacccgtggatggaggacaagacgcccgtggagagctgggaggaggtcccctacctcggcaagcgggaggaccagtggtgcgggtccctgatcggcctgaccagccgcgcgacctgggccaagaacatccagaccgccatcaaccaggtgcgcagcctcatcggcaacgaggagtacacggactacatgccctccatgaagcggttccgccgggaggaggaggaggccggggtgctgtggtga

SEQ ID NO: 9124 - RNA, 9876 nt, synthetic construct
  misc_feature 1..9876: note = derived and/or modified CDS sequence (opt1) from DENV-2__GQ868557__SS-prME
  source 1..9876: mol_type = other RNA
accgccggcgtgatcgtcatgctgatccccaccgccatcgcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcgtgatcacctggatcgggatgaacagccgctccaccagcctgtccgtgagcctggtcctcgtgggcgtggtcaccctgtacctgggggccatggtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacaccaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacacgctgtggtccaacggcgtcctggagagcgagatgatcatccccaagaacttcgccgggcccgtgtcccagcacaactaccgcccgggctaccacacccagaccgcggggccctggcacctcggcaagctggagatggacttcgacctgtgcgaggggaccacggtggtcgtgaccgaggactgcggcaaccggggccccagcctccgcaccaccacggccagcgggaagctgatcaccgagtggtgctgccggtcctgcaccctgcccccgctccgctaccggggcgaggacgggtgctggtacggcatggagatccgccccctgaaggagaaggaggagaacctggtgaacagcctcgtcaccgccgggcacggccagatcgacaacttctccctgggcgtgctggggatggccctcttcctggaggagatgctgcggacgcgcgtgggcaccaagcacgcgatcctcctggtcgccgtgagcttcgtgaccctgatcaccgggaacatgtccttccgggacctcggccgcgtcatggtgatggtgggggccacgatgaccgacgacatcggcatgggcgtcacctacctggccctgctcgccgcgttcaaggtgcgccccaccttcgccgccgggctgctgctccggaagctgacgagcaaggagctgatgatggccaccatcggcatcgccctcctgtcccagagcaccatccccgagaccatcctggagctcacggacgcgctggccctggggatgatggtgctcaagatcgtccgcaacatggagaagtaccagctggccgtgaccatcatggccatctcctgcgtgccgaacgccgtcatcctgcggaacgcgtggaaggtgagctgcaccatcctcgccgccgtctccgtgagccccctgctgctcacctccagccagcagaaggccgactggatccccctggcgctgacgatcaagggcctcaaccccaccgccatcttcctgaccaccctgtcccgcacgagcaagaagcggtcctggccgctcaacgaggccatcatggccgtgggcatggtcagcatcctggcctccagcctgctcaagaacgacatccccatgaccgggcccctggtggcgggcgggctgctcaccgtgtgctacgtcctgaccggccgcagcgccgacctggagctcgagcgggccgccgaggtgaagtgggaggaccaggccgagatctccgggagctcccccatcctgagcatcacgatctccgaggacggcagcatgtccatcaagaacgaggaggaggagcagaccctgaccatcctcatccgcaccggcctgctggtgatcagcggggtcttcccggtgtccatccccatcaccgcggccgcctggtacctctgggaggtgaagaagcagcgggccggcgtcctgtgggacgtgcccagcccgccgcccgtggggaaggccgagctggaggacggcgcgtaccgcatcaagcagcgggggatcctcggctactcccagatcggcgccggggtctacaaggagggcacgttccacaccatgtggcacgtgacccgcggggccgtgctgatgcaccggggcaagcgcatcgagcccagctgggccgacgtcaagaaggacctgatctcctacgggggcggctggaagctcgagggggagtggaaggagggcgaggaggtccaggtgctggccctggagcccgggaagaacccccgggcggtccagaccaagcccggcatcttcaagacgaacaccgggaccatcggcgccgtgagcctcgacttctcccccggcaccagcgggtcccccatcgtggaccgcaagggcaaggtcgtggggctgtacggcaacggcgtggtcacgcggagcggggcctacgtgtccgccatcgcgcagaccgagaagtccatcgaggacaaccccgagatcgaggacgacatcttccgcaagaagcggctgaccatcatggacctccaccccggcgccgggaagaccaagcgctacctgcccgccatcgtgcgggaggccatcaagcgcggcctgcgcacgctgatcctcgccccgacccgggtcgtggcggccgagatggaggaggccctgcgcgggctgcccatccggtaccagacccccgccatcaaggccgagcacaccggccgcgagatcgtggacctcatgtgccacgcgacgttcaccatgcggctgctgagccccgtccgcgtgccgaactacaacctcatcatcatggacgaggcccacttcaccgaccccgcctccatcgccgcccggggctacatcagcacccgcgtggagatgggggaggcggccggcatcttcatgacggccacgccgcccgggtcccgggacccgttcccccagagcaacgcccccatcatggacgaggagcgcgagatccccgagcggtcctggaacagcggccacgagtgggtcaccgacttcaaggggaagaccgtgtggttcgtgccgtccatcaaggcgggcaacgacatcgccgcctgcctgcgcaagaacggcaagaaggtcatccagctgagccggaagacgttcgactccgagtacgtgaagacccgcgccaacgactgggacttcgtggtcaccaccgacatcagcgagatgggggccaacttcaaggcggagcgggtgatcgacccccgccggtgcatgaagcccgtgatcctcacggacggcgaggagcgcgtcatcctggccgggcccatgccggtgacccactccagcgccgcccagcggcgcggccgcatcgggcggaaccccaagaacgagaacgaccagtacatctacatgggcgagcccctggagaacgacgaggactgcgcccactggaaggaggcgaagatgctcctggacaacatcaacacccccgagggcatcatcccgtccatgttcgagcccgagcgcgagaaggtggacgccatcgacggggagtaccggctgcgcggcgaggcccggaagaccttcgtcgacctcatgcgccgcggggacctgcccgtgtggctggcctacaaggtggccgcggagggcatcaactacgccgaccgcaagtggtgcttcgacgggatcaagaacaaccagatcctcgaggagaacgtcgaggtggagatctggacgaaggagggcgagcggaagaagctgaagccgcgctggctggacgcccggatctacagcgaccccctcgccctgaaggagttcaaggagttcgcggccggccgcaagtccctgaccctcaacctgatcaccgagatggggcggctgcccaccttcatgacgcagaaggcccgcaacgccctcgacaacctggccgtcctgcacaccgcggaggccggcgggcgggcctacaaccacgccctcagcgagctgcccgagaccctggagaccctcctgctgctcacgctgctggccaccgtgaccggcggcatcttcctcttcctgatgtccgggaagggcatcgggaagatgaccctgggcatgtgctgcatcatcaccgcgagcgtgctcctgtggtacgcccagatccagccgcactggatcgccgcctccatcatcctggagttcttcctcatcgtcctgctgatccccgagcccgagaagcagcgcacgccccaggacaaccagctcacctacgtggtgatcgccatcctgaccgtcgtggcggccaccatggccaacgagatggggttcctggagaagacgaagaaggacctcggcctgggcagcatcaccacccaggagagcgagtccaacatcctggacatcgacctccggccggccagcgcctggaccctgtacgcggtggccacgaccttcgtcacccccatgctgcgccactccatcgagaacagctccgtgaacgtgagcctcaccgccatcgccaaccaggcgacggtcctgatggggctgggcaaggggtggcccctctccaagatggacatcggcgtgcccctgctggccatcgggtgctacagccaggtgaacccgatcaccctcaccgccgccctgctgctcctggtcgcccactacgcgatcatcggccccggcctgcaggccaaggccacccgggaggcccagaagcgcgccgcggccgggatcatgaagaaccccacggtggacggcatcaccgtgatcgacctcgagcccatcccgtacgaccccaagttcgagaagcagctggggcaggtcatgctgctcatcctgtgcgtgacccaggtgctgatgatgcggaccacgtgggccctctgcgaggccctgaccctggccaccggccccatctccaccctctgggaggggaaccccggccgcttctggaacacgaccatcgcggtcagcatggccaacatcttccgcggctcctacctggccggggccggcctcctgttcagcatcatgaagaacaccaccaacacgcggcgcgggaccggcaacatcggcgagaccctgggggagaagtggaagtcccggctgaacgcgctcggcaagagcgagttccagatctacaagaagtccgggatccaggaggtggaccgcaccctggccaaggagggcatcaagcgcggggagacggaccaccacgccgtgagccgcggctccgccaagctgcggtggttcgtcgagcgcaacatggtgaccccggagggcaaggtggtcgacctcgggtgcggccgcgggggctggagctactactgcgggggcctgaagaacgtgcgcgaggtgaagggcctgaccaagggcggccccgggcacgaggagcccatccccatgtccacctacggctggaacctcgtccggctgcagagcggggtggacgtgttcttcacgccgcccgagaagtgcgacaccctgctctgcgacatcggcgagagctcccccaaccccaccatcgaggccggccgcaccctgcgggtcctgaacctcgtggagaactggctgaacaacaacacccagttctgcatcaaggtgctgaacccgtacatgcccagcgtcatcgagaagatggagacgctccagcgcaagtacgggggcgcgctggtgcggaaccccctgtcccgcaacagcacccacgagatgtactgggtgtccaacgccaccgggaacatcgtcagctccgtgaacatgatcagccggatgctgatcaaccgcttcaccatgaagcacaagaaggccacgtacgagccggacgtggacctcggctccgggacccggaacatcggcatcgagagcgagatccccaacctggacatcatcggcaagcgcatcgagaagatcaagcaggagcacgagacctcctggcactacgaccaggaccacccctacaagacctgggcctaccacgggagctacgagacgaagcagaccggctccgccagctccatggtcaacggggtggtgcgcctgctcaccaagccctgggacgtcgtgccgatggtgacccagatggcgatgacggacaccacccccttcggccagcagcgggtcttcaaggagaaggtggacacccgcacgcaggagcccaaggagggcaccaagaagctgatgaagatcaccgccgagtggctgtggaaggagctcgggaagaagaagacgccccggatgtgcacgcgcgaggagttcacccggaaggtgcgcagcaacgccgccctgggcgccatcttcaccgacgagaacaagtggaagtccgcgcgggaggccgtcgaggacgggcgcttctgggagctggtggaccgggagcgcaacctccacctggagggcaagtgcgagacctgcgtctacaacatgatggggaagcgggagaagaagctgggcgagttcggcaaggccaaggggagccgcgccatctggtacatgtggctcggcgcgcggttcctggagttcgaggccctggggttcctcaacgaggaccactggttctcccgcggcaacagcctgagcggggtggagggcgagggcctgcaccggctcgggtacatcctgcgcgacgtgtccaagaaggagggcggggccatgtacgccgacgacacggccggctgggacacccggatcaccctggaggacctcaagaacgaggagatggtcaccaaccacatgaagggggagcacaagaagctggcggaggccatcttcaagctgacgtaccagaacaaggtggtgcgcgtccagcggccgacgccccggggcaccgtgatggacatcatcagccggcgcgaccagcgcggctccggccaggtgggcacctacgggctcaacacgttcaccaacatggaggcccagctgatccggcagatggagggcgagggcatcttcaagagcatccagcacctgaccgccaccgaggagaacgccgtccagaactggctcgcgcgcgtggggcgggagcgcctgtcccggatggccatcagcggcgacgactgcgtggtcaagcccatcgacgaccgcttcgcctccgccctgacggccctcaacgacatggggaaggtgcggaaggacatccagcagtgggagcccagccgcggctggaacgactggacccaggtgccgttctgctcccaccacttccacgagctggtcatgaaggacgggcgggtgctggtggtcccctgccgcaaccaggacgagctcatcggccgggcgcgcatcagccagggcgccgggtggtccctgaaggagaccgcctgcctgggcaagagctacgcccagatgtggaccctcatgtacttccaccggcgcgacctgcggctggccgcgaacgccatctgctccgccgtgcccagccactgggtgcccacctcccgcacgacctggagcatccacgccaagcacgagtggatgaccaccgaggacatgctcgcggtctggaaccgggtgtggatccaggagaacccgtggatggaggacaagacgcccgtggagtcctgggaggaggtcccctacctggggaagcgcgaggaccagtggtgcggcagcctgatcgggctcaccagccgggccacctgggccaagaacatccagaccgccatcaaccaggtgcgctccctgatcggcaacgaggagtacacggactacatgcccagcatgaagcgcttccggcgcgaggaggaggaggccggcgtgctgtggtga

SEQ ID NO: 9125 - RNA, 9876 nt, synthetic construct
  misc_feature 1..9876: note = derived and/or modified CDS sequence (opt1) from DENV-2__GU131947__SS-prME
  source 1..9876: mol_type = other RNA
accgccggcgtgatcgtcatgctgatccccaccgccatcgcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcgtgatcacctggatcgggatgaacagccgctccaccagcctgtccgtgagcctggtcctcgtgggcgtggtcaccctgtacctgggggccatggtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacaccaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacacgctgtggtccaacggcgtcctggagagcgagatgatcatccccaagaacttcgccgggcccgtgtcccagcacaactaccgcccgggctaccacacccagaccgcggggccctggcacctcggcaagctggagatggacttcgacctgtgcgaggggaccacggtggtcgtgaccgaggactgcggcaaccggggccccagcctccgcaccaccacggccagcgggaagctgatcaccgagtggtgctgccggtcctgcaccctgcccccgctccgctaccggggcgaggacgggtgctggtacggcatggagatccgccccctgaaggagaaggaggagaacctggtgaacagcctcgtcaccgccgggcacggccagatcgacaacttctccctgggcgtgctggggatggccctcttcctggaggagatgctgcggacgcgcgtgggcaccaagcacgcgatcctcctggtcgccgtgagcttcgtgaccctgatcaccgggaacatgtccttccgggacctcggccgcgtcatggtgatggtgggggccacgatgaccgacgacatcggcatgggcgtcacctacctggccctgctcgccgcgttcaaggtgcgccccaccttcgccgccgggctgctgctccggaagctgacgagcaaggagctgatgatggccaccatcggcatcgccctcctgtcccagagcaccatccccgagaccatcctggagctcacggacgcgctggccctggggatgatggtgctcaagatcgtccgcaacatggagaagtaccagctggccgtgaccatcatggccatctcctgcgtgccgaacgccatgatcctgcggaacgcgtggaaggtcagctgcaccatcctcgccgccgtgtccgtcagccccctgctgctcacctccagccagcagaaggccgactggatccccctggcgctgacgatcaagggcctcaaccccaccgccatcttcctgaccaccctgtcccgcacgagcaagaagcggtcctggccgctcaacgaggccatcatggccgtgggcatggtgagcatcctggcctccagcctgctcaagaacgacatccccatgaccgggcccctggtcgcgggcgggctgctcaccgtgtgctacgtgctgaccggccgcagcgccgacctggagctcgagcgggccgccgaggtcaagtgggaggaccaggccgagatctccgggagctcccccatcctgagcatcacgatctccgaggacggcagcatgtccatcaagaacgaggaggaggagcagaccctgaccatcctcatccgcaccggcctgctggtgatcagcggggtgttcccggtctccatccccatcaccgcggccgcctggtacctctgggaggtgaagaagcagcgggccggcgtgctgtgggacgtccccagcccgccgcccgtggggcgcgccgagctggaggacggcgcgtaccggatcaagcagcgcgggatcctcggctactcccagatcggcgccggggtgtacaaggagggcacgttccacaccatgtggcacgtcacccgcggggccgtgctgatgcaccgcggcaagcggatcgagcccagctgggccgacgtgaagaaggacctgatctcctacgggggcggctggaagctcgagggggagtggaaggagggcgaggaggtccaggtgctggccctggagcccgggaagaacccccgcgcggtgcagaccaagcccggcatcttcaagacgaacaccgggaccatcggcgccgtcagcctcgacttctcccccggcaccagcgggtcccccatcgtggaccggaagggcaaggtggtcgggctgtacggcaacggcgtggtgacgcgcagcggggcctacgtctccgccatcgcgcagaccgagaagtccatcgaggacaaccccgagatcgaggacgacatcttccggaagaagcgcctgaccatcatggacctccaccccggcgccgggaagaccaagcggtacctgcccgccatcgtgcgcgaggccatcaagcgcggcctgcggacgctgatcctcgccccgacccgcgtggtcgcggccgagatggaggaggccctgcgggggctgcccatccgctaccagacccccgccatcaaggccgagcacaccggccgggagatcgtggacctcatgtgccacgcgacgttcaccatgcgcctgctgagccccgtgcgggtcccgaactacaacctcatcatcatggacgaggcccacttcaccgaccccgcctccatcgccgcccgcggctacatcagcacccgggtggagatgggggaggcggccggcatcttcatgacggccacgccgcccgggtcccgcgacccgttcccccagagcaacgcccccatcatggacgaggagcgggagatccccgagcgctcctggaacagcggccacgagtgggtgaccgacttcaaggggaagaccgtctggttcgtgccgtccatcaaggcgggcaacgacatcgccgcctgcctgcggaagaacggcaagaaggtgatccagctgagccgcaagacgttcgactccgagtacgtcaagacccgggccaacgactgggacttcgtggtgaccaccgacatcagcgagatgggggccaacttcaaggcggagcgcgtcatcgacccccggcgctgcatgaagcccgtgatcctcacggacggcgaggagcgggtgatcctggccgggcccatgccggtcacccactccagcgccgcccagcgccgcggccggatcgggcgcaaccccaagaacgagaacgaccagtacatctacatgggcgagcccctggagaacgacgaggactgcgcccactggaaggaggcgaagatgctcctggacaacatcaacacccccgagggcatcatcccgtccatgttcgagcccgagcgggagaaggtggacgccatcgacggggagtaccgcctgcggggcgaggcccgcaagaccttcgtggacctcatgcggcgcggggacctgcccgtctggctggcctacaaggtggccgcggagggcatcaactacgccgaccggaagtggtgcttcgacgggatcaagaacaaccagatcctcgaggagaacgtggaggtcgagatctggacgaaggagggcgagcgcaagaagctgaagccgcggtggctggacgcccgcatctacagcgaccccctcgccctgaaggagttcaaggagttcgcggccggccggaagtccctgaccctcaacctgatcaccgagatggggcgcctgcccaccttcatgacgcagaaggcccggaacgccctcgacaacctggccgtgctgcacaccgcggaggccggcgggcgcgcctacaaccacgccctcagcgagctgcccgagaccctggagaccctcctgctgctcacgctgctggccaccgtcaccggcggcatcttcctcttcctgatgtccgggaagggcatcgggaagatgaccctgggcatgtgctgcatcatcaccgcgagcgtgctcctgtggtacgcccagatccagccgcactggatcgccgcctccatcatcctggagttcttcctcatcgtgctgctgatccccgagcccgagaagcagcggacgccccaggacaaccagctcacctacgtcgtgatcgccatcctgaccgtggtcgcggccaccatggccaacgagatggggttcctggagaagacgaagaaggacctcggcctgggcagcatcaccacccaggagagcgagtccaacatcctggacatcgacctccgcccggccagcgcctggaccctgtacgcggtggccacgaccttcgtgacccccatgctgcggcactccatcgagaacagctccgtcaacgtgagcctcaccgccatcgccaaccaggcgacggtgctgatggggctgggcaaggggtggcccctctccaagatggacatcggcgtccccctgctggccatcgggtgctacagccaggtgaacccgatcaccctcaccgccgccctgctgctcctggtggcccactacgcgatcatcggccccggcctgcaggccaaggccacccgcgaggcccagaagcgggccgcggccgggatcatgaagaaccccacggtcgacggcatcaccgtgatcgacctcgagcccatcccgtacgaccccaagttcgagaagcagctggggcaggtcatgctgctcatcctgtgcgtcacccaggtgctgatgatgcgcaccacgtgggccctctgcgaggccctgaccctggccaccggccccatctccaccctctgggaggggaaccccggccgcttctggaacacgaccatcgcggtgagcatggccaacatcttccggggctcctacctggccggggccggcctcctgttcagcatcatgaagaacaccaccaacacgcgccgggggaccggcaacatcggcgagaccctgggggagaagtggaagtcccgcctgaacgcgctcggcaagagcgagttccagatctacaagaagtccgggatccaggaggtcgaccggaccctggccaaggagggcatcaagcgcggggagacggaccaccacgccgtgagccggggctccgccaagctgcgctggttcgtggagcggaacatggtcaccccggagggcaaggtggtggacctcgggtgcggccgcgggggctggagctactactgcgggggcctgaagaacgtccgggaggtgaagggcctgaccaagggcggccccgggcacgaggagcccatccccatgtccacctacggctggaacctcgtgcgcctgcagagcggggtcgacgtgttcttcacgccgcccgagaagtgcgacaccctgctctgcgacatcggcgagagctcccccaaccccaccatcgaggccggccggaccctgcgcgtgctgaacctcgtcgagaactggctgaacaacaacacccagttctgcatcaaggtgctgaacccgtacatgcccagcgtgatcgagaagatggagacgctccagcggaagtacgggggcgcgctggtccgcaaccccctgtcccggaacagcacccacgagatgtactgggtgtccaacgccaccgggaacatcgtgagctccgtcaacatgatcagccgcatgctgatcaaccggttcaccatgaagcacaagaaggccacgtacgagccggacgtggacctcggctccgggacccgcaacatcggcatcgagagcgagatccccaacctggacatcatcggcaagcgcatcgagaagatcaagcaggagcacgagacctcctggcactacgaccaggaccacccctacaagacctgggcctaccacgggagctacgagacgaagcagaccggctccgccagctccatggtgaacggggtcgtgcggctgctcaccaagccctgggacgtggtcccgatggtgacccagatggcgatgacggacaccacccccttcggccagcagcgcgtgttcaaggagaaggtcgacacccggacgcaggagcccaaggagggcaccaagaagctgatgaagatcaccgccgagtggctgtggaaggagctcgggaagaagaagacgccccgcatgtgcacgcgggaggagttcacccgcaaggtgcggagcaacgccgccctgggcgccatcttcaccgacgagaacaagtggaagtccgcgcgcgaggccgtggaggacgggcggttctgggagctggtcgaccgcgagcggaacctccacctggagggcaagtgcgagacctgcgtgtacaacatgatggggaagcgcgagaagaagctgggcgagttcggcaaggccaaggggagccgggccatctggtacatgtggctcggcgcgcgcttcctggagttcgaggccctggggttcctcaacgaggaccactggttctcccggggcaacagcctgagcggggtcgagggcgagggcctgcaccgcctcgggtacatcctgcgggacgtgtccaagaaggagggcggggccatgtacgccgacgacacggccggctgggacacccgcatcaccctggaggacctcaagaacgaggagatggtgaccaaccacatgaagggggagcacaagaagctggcggaggccatcttcaagctgacgtaccagaacaaggtcgtgcgggtgcagcgcccgacgccccggggcaccgtcatggacatcatcagccgccgcgaccagcggggctccggccaggtgggcacctacgggctcaacacgttcaccaacatggaggcccagctgatccgccagatggagggcgagggcatcttcaagagcatccagcacctgaccgccatcgaggagatcgccgtgcagaactggctcgcgcgggtcgggcgcgagcggctgtcccgcatggccatcagcggcgacgactgcgtggtgaagcccatcgacgaccggttcgcctccgccctgaccgccctcaacgacatggggaaggtccgcaaggacatccagcagtgggagcccagccggggctggaacgactggacccaggtgccgttctgctcccaccacttccacgagctggtgatgaaggacgggcgcgtcctggtggtgccctgccggaaccaggacgagctcatcggccgcgcgcggatcagccagggcgccgggtggtccctgaaggagaccgcctgcctgggcaagagctacgcccagatgtggaccctcatgtacttccaccgccgggacctgcgcctggccgcgaacgccatctgctccgccgtccccagccactgggtgcccacctcccggaccacgtggagcatccacgccaagcacgagtggatgaccaccgaggacatgctcgcggtgtggaaccgcgtctggatccaggagaacccgtggatggaggacaagacccccgtggagtcctgggaggaggtgccctacctggggaagcgggaggaccagtggtgcggcagcctgatcgggctcacgagccgcgccacctgggccaagaacatccagaccgccatcaaccaggtccgctccctgatcggcaacgaggagtacaccgactacatgcccagcatgaagcggttccgccgggaggaggaggaggccggcgtgctgtggtga

SEQ ID NO: 9126 - RNA, 9876 nt, synthetic construct
  misc_feature 1..9876: note = derived and/or modified CDS sequence (opt1) from DENV-2__GQ868558__SS-prME
  source 1..9876: mol_type = other RNA
accgccggcgtgatcgtcatgctgatccccaccgccatcgcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgaagcagaacgagcccgaggacatcgactgctggtgcaacagcaccagcacctgggtcacctacgggacctgcaccaccacgggcgagcaccgccgggagaagcgctccgtggccctggtgccccacgtcgggatgggcctcgagacccggaccgagacctggatgagctccgagggggcctggaagcacgtgcagcgcatcgagacgtggatcctgcggcacccgggcttcaccatcatggccgcgatcctggcctacaccatcgggaccacgcacttccagcgcgccctcatcttcatcctgctgaccgccgtggcgcccagcatgaccatgcggtgcatcggcatctccaaccgcgacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccggaagtactgcatcgaggccaagctgacgaacaccaccaccgagtcccgctgcccgacgcagggcgagcccagcctgaacgaggagcaggacaagcggttcatctgcaagcactccatggtggaccgcggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccgccagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccggctgcgcatggacaagctccagctgaaggggatgtcctacagcatgtgcaccggcaagttcaagatcgtgaaggagatcgccgagacccagcacgggacgatcgtgatccgggtccagtacgagggcgacggctccccctgcaagatccccttcgagatcaccgacctggagaagcgccacgtgctcgggcggctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcgcatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcgtgatcacctggatcgggatgaacagccggtccaccagcctgtccgtgagcctggtcctcgtgggcgtggtcaccctgtacctgggggccatggtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccgcagcgtgacccggctggagaacctcatgtggaagcagatcacgcccgagctgaaccacatcctgtccgagaacgaggtcaagctcaccatcatgaccggcgacaccaaggggatcatgcaggccggcaagcgcagcctgcggccgcagcccacggagctgaagtactcctggaagacctggggcaaggcgaagatgcacagcaccgagtcccacaaccagaccttcctcatcgacgggcccgagacggccgagtgcccgaacaccaaccgcgcctggaacagcctggaggtggaggactacggcttcggggtgttcaccaccaacatctggctgaagctccgggagaagcaggacgtcttctgcgactccaagctgatgagcgccgccatcaaggacaaccgcgcggtgcacgccgacatgggctactggatcgagtccgccctgaacgacacctggaagatggagaaggccagcttcatcgaggtgaagtcctgccactggcccaagagccacacgctctggtccaacggcgtcctggagagcgagatgatcatccccaagaacttcgccgggcccgtgtcccagcacaactaccggccgggctaccacacccagaccgcggggccctggcacctgggcaagctcgagatggacttcgacctgtgcgaggggaccacggtggtcgtgaccgaggactgcggcaaccgcggccccagcctgcggaccaccacggccagcgggaagctcatcaccgagtggtgctgccgctcctgcaccctgcccccgctgcggtaccgcggcgaggacgggtgctggtacggcatggagatccggcccctcaaggagaaggaggagaacctggtgaacagcctggtcaccgccgggcacggccagatcgacaacttctccctcggcgtgctggggatggccctgttcctcgaggagatgctgcgcacgcgggtgggcaccaagcacgcgatcctgctcgtcgccgtgagcttcgtgaccctgatcaccgggaacatgtccttccgcgacctgggccgggtcatggtgatggtgggggccacgatgaccgacgacatcggcatgggcgtcacctacctcgccctgctggccgcgttcaaggtgcgccccaccttcgccgccgggctcctgctgcgcaagctcacgagcaaggagctgatgatggccaccatcggcatcgccctgctctcccagagcaccatccccgagaccatcctggagctgacggacgcgctcgccctggggatgatggtgctgaagatcgtccggaacatggagaagtaccagctcgccgtgaccatcatggccatctcctgcgtgccgaacgccgtcatcctgcgcaacgcgtggaaggtgagctgcaccatcctggccgccgtctccgtgagccccctcctgctgacctccagccagcagaaggccgactggatccccctcgtgctgacgatcaagggcctgaaccccaccgcgatcttcctcaccaccctgtcccggacgagcaagaagcgctcctggccgctgaacgaggccatcatggccgtcggcatggtgagcatcctcgcctccagcctgctgaagaacgacatccccatgaccgggcccctcgtggccggcgggctgctgaccgtctgctacgtgctcaccggccggagcgcggacctggagctggagcgcgccgccgaggtgaagtgggaggaccaggccgagatctccgggagctcccccatcctcagcatcacgatctccgaggacggcagcatgtccatcaagaacgaggaggaggagcagaccctgaccatcctgatccggaccggcctcctggtcatcagcggggtgttcccggtgtccatccccatcaccgccgcggcctggtacctgtgggaggtcaagaagcagcgcgccggcgtgctctgggacgtgcccagcccgccgcccgtcgggaaggccgagctggaggacggcgcctaccggatcaagcagcgcgggatcctgggctactcccagatcggcgcgggggtgtacaaggagggcacgttccacaccatgtggcacgtgacccgcggggccgtcctcatgcaccgcggcaagcggatcgagcccagctgggccgacgtgaagaaggacctgatctcctacgggggcggctggaagctggagggggagtggaaggagggcgaggaggtgcaggtcctcgccctggagcccgggaagaacccccgcgccgtgcagaccaagcccggcatcttcaagacgaacgcggggaccatcggcgccgtgagcctggacttctcccccggcaccagcgggtcccccatcgtcgaccggaagggcaaggtggtggggctctacggcaacggcgtcgtgacccgcagcggggcctacgtgtccgccatcgcgcagacggagaagtccatcgaggacaaccccgagatcgaggacgacatcttccggaagaagcgcctgaccatcatggacctgcaccccggcgccgggaagaccaagcggtacctccccgccatcgtccgcgaggccatcaagcggggcctgcgcaccctgatcctggccccgacgcgcgtggtggcggccgagatggaggaggccctccgggggctgcccatccgctaccagacccccgccatcaaggccgagcacaccggccgggagatcgtcgacctgatgtgccacgcgaccttcacgatgcgcctcctgagccccgtgcgggtgccgaactacaacctgatcatcatggacgaggcccacttcaccgaccccgcctccatcgccgcccgcggctacatcagcacccgggtcgagatgggggaggcggccggcatcttcatgaccgccacgccgcccgggtcccgcgacccgttcccccagagcaacgcccccatcatggacgaggagcgggagatccccgagcgctcctggaacagcggccacgagtgggtgaccgacttcaaggggaagaccgtgtggttcgtcccgtccatcaaggcgggcaacgacatcgccgcctgcctccggaagaacggcaagaaggtgatccagctgagccgcaagaccttcgactccgagtacgtgaagacgcgggccaacgactgggacttcgtcgtgaccaccgacatcagcgagatgggggccaacttcaaggcggagcgcgtgatcgacccccggcgctgcatgaagcccgtcatcctgaccgacggcgaggagcgggtgatcctcgccgggcccatgccggtgacgcactccagcgccgcccagcgccggggccgcatcgggcgcaaccccaagaacgagaacgaccagtacatctacatgggcgagcccctggagaacgacgaggactgcgcccactggaaggaggcgaagatgctgctcgacaacatcaacacccccgagggcatcatcccgtccatgttcgagcccgagcgggagaaggtcgacgccatcgacggggagtaccgcctgcggggcgaggcccgcaagaccttcgtggacctgatgcggcgcggggacctccccgtgtggctggcctacaaggtcgccgcggagggcatcaactacgccgaccggaagtggtgcttcgacgggatcaagaacaaccagatcctggaggagaacgtggaggtcgagatctggaccaaggagggcgagcgcaagaagctcaagccgcggtggctggacgcccgcatctacagcgaccccctggccctcaaggagttcaaggagttcgcggccggccggaagtccctgacgctgaacctcatcaccgagatggggcgcctgcccaccttcatgacccagaaggcccggaacgccctggacaacctcgccgtgctgcacacggcggaggccggcgggcgcgcctacaaccacgccctgagcgagctccccgagaccctggagaccctgctcctgctgaccctcctggccacggtgaccggcggcatcttcctgttcctcatgtccgggaagggcatcgggaagatgaccctgggcatgtgctgcatcatcaccgcgagcgtcctgctctggtacgcccagatccagccgcactggatcgccgcctccatcatcctggagttcttcctgatcgtgctcctgatccccgagcccgagaagcagcggacgccccaggacaaccagctgacgtacgtggtcatcgccatcctcaccgtggtggcggccaccatggccaacgagatggggttcctggagaagaccaagaaggacctgggcctcggcagcatcacgacccaggagagcgagtccaacatcctggacatcgacctgcgcccggccagcgcctggaccctctacgcggtcgccaccacgttcgtgacccccatgctgcggcactccatcgagaacagctccgtgaacgtcagcctgaccgccatcgccaaccaggcgaccgtgctcatggggctgggcaaggggtggcccctgtccaagatggacatcggcgtgcccctcctggccatcgggtgctacagccaggtcaacccgatcacgctgaccgccgccctcctgctgctcgtggcccactacgcgatcatcggccccggcctgcaggccaaggccacccgcgaggcccagaagcgggccgcggccgggatcatgaagaaccccaccgtggacggcatcacggtcatcgacctggagcccatcccgtacgaccccaagttcgagaagcagctcgggcaggtcatgctgctgatcctctgcgtgacccaggtcctgatgatgcgcaccacctgggccctgtgcgaggccctcacgctggccaccggccccatctccaccctgtgggaggggaaccccggccggttctggaacaccacgatcgcggtgagcatggccaacatcttccgcggctcctacctcgccggggccggcctgctgttcagcatcatgaagaacaccaccaacacccgccgggggacgggcaacatcggcgagaccctcggggagaagtggaagtcccgcctgaacgcgctgggcaagagcgagttccagatctacaagaagtccgggatccaggaggtggaccggaccctcgccaaggagggcatcaagcgcggggagaccgaccaccacgccgtcagccggggctccgccaagctgcgctggttcgtggagcggaacatggtgacgccggagggcaaggtcgtggacctggggtgcggccgcgggggctggagctactactgcgggggcctcaagaacgtgcgggaggtcaagggcctgaccaagggcggccccgggcacgaggagcccatccccatgtccacctacggctggaacctggtgcgcctccagagcggggtggacgtcttcttcaccccgcccgagaagtgcgacacgctgctgtgcgacatcggcgagagctcccccaaccccaccatcgaggccggccggaccctccgcgtgctgaacctggtggagaactggctcaacaacaacacccagttctgcatcaaggtcctgaacccgtacatgcccagcgtgatcgagaagatggagaccctgcagcggaagtacgggggcgcgctcgtgcgcaaccccctgtcccggaacagcacgcacgagatgtactgggtctccaacgccaccgggaacatcgtgagctccgtgaacatgatcagccgcatgctgatcaaccggttcaccatgaagcacaagaaggccacctacgagccggacgtcgacctgggctccgggacgcgcaacatcggcatcgagagcgagatccccaacctcgacatcatcggcaagcggatcgagaagatcaagcaggagcacgagacctcctggcactacgaccaggaccacccctacaagacctgggcctaccacgggagctacgagaccaagcagacgggctccgccagctccatggtgaacggggtggtccgcctgctgaccaagccctgggacgtggtgccgatggtcacccagatggcgatgaccgacacgacccccttcggccagcagcgcgtgttcaaggagaaggtggacacccggacccaggagcccaaggagggcacgaagaagctcatgaagatcaccgccgagtggctgtggaaggagctggggaagaagaagacgccccggatgtgcacccgggaggagttcacgcgcaaggtccggagcaacgccgccctcggcgccatcttcaccgacgagaacaagtggaagtccgcgcgcgaggccgtggaggacgggcggttctgggagctggtcgaccgcgagcggaacctgcacctcgagggcaagtgcgagacctgcgtgtacaacatgatggggaagcgcgagaagaagctgggcgagttcggcaaggccaaggggagccgggccatctggtacatgtggctgggcgcgcgcttcctcgagttcgaggccctggggttcctgaacgaggaccactggttctcccggggcaacagcctcagcggggtggagggcgagggcctgcaccgcctggggtacatcctccgggacgtctccaagaaggagggcggggccatgtacgccgacgacaccgccggctgggacacgcgcatcaccctggaggacctgaagaacgaggagatggtgaccaaccacatgaagggggagcacaagaagctcgcggaggccatcttcaagctgacctaccagaacaaggtggtccgggtgcagcgcccgacgccccggggcaccgtgatggacatcatcagccgccgggaccagcgcggctccgggcaggtcggcacctacgggctgaacaccttcacgaacatggaggcccagctcatccgccagatggagggcgagggcatcttcaagagcatccagcacctgaccgccatcgaggagatcgccgtgcagaactggctggcgaaggtggggcgggagcgcctctcccggatggccatcagcggcgacgactgcgtcgtgaagcccatcgacgaccgcttcgcctccgccctgaccgccctgaacgacatggggaaggtgcggaaggacatccagcagtgggagcccagccgcggctggaacgactggacccaggtcccgttctgctcccaccacttccacgagctcgtgatgaaggacgggcgggtgctggtcgtgccctgccgcaaccaggacgagctgatcggccgggcgcgcatcagccagggcgccgggtggtccctcaaggagacggcctgcctgggcaagagctacgcccagatgtggaccctgatgtacttccaccggcgcgacctccggctggccgcgaacgccatctgctccgccgtgcccagccactgggtccccacctcccgcaccacctggagcatccacgccaagcacgagtggatgacgaccgaggacatgctggcggtgtggaaccgggtgtggatccaggagaacccgtggatggaggacaagacccccgtcgagtcctgggaggaggtgccctacctcgggaagcgcgaggaccagtggtgcggcagcctgatcgggctgaccagccgggccacgtgggccaagaacatccagaccgccatcaaccaggtgcgctccctcatcggcaacgaggagtacaccgactacatgcccagcatgaagcggttccgccgcgaggaggaggaggccggcgtcctgtggtga

SEQ ID NO: 9127 - RNA, 9876 nt, synthetic construct
  misc_feature 1..9876: note = derived and/or modified CDS sequence (opt1) from DENV-2__KJ189305__SS-prME
  source 1..9876: mol_type = other RNA
accgccggcgtcatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtcgaggactacggcttcggggtgttcaccaccaacatctggctcaagctgaaggagaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgcgtcccagcacaactaccggccgggctactacacgcagaccgccgggccctggcacctcggcaagctggagatggacttcgacttctgcgaggggaccaccgtcgtggtgacggaggactgcggcaaccgcggccccagcctgcggaccaccaccgccagcgggaagctcatcacggagtggtgctgccgctcctgcaccctgcccccgctgcggtaccgcggcgaggacgggtgctggtacggcatggagatccggcccctcaaggagaaggaggagaacctggtcaacagcctggtgaccgccgggcacggccagatcgacaacttctccctcggcgtgctggggatggcgctgttcctcgaggagatgctgcgcacccgggtcggcacgaagcacgccatcctgctcgtggccgtgagcttcgtcaccctgatcaccgggaacatgtccttccgcgacctgggccgggtgatggtgatggtcggggccaccatgacggacgacatcggcatgggcgtgacctacctcgccctgctggcggccttcaaggtgcgccccaccttcgccgccgggctcctgctgcgcaagctcaccagcaaggagctgatgatggccacgatcggcatcgcgctgctctcccagagcaccatccccgagaccatcctggagctgaccgacgccctcgccctggggatgatggtcctgaagatcgtgcggaacatggagaagtaccagctcgccgtgacgatcatggccatctcctgcgtcccgaacgcggtgatcctgcagaacgcctggaaggtgagctgcaccatcctggccgccgtctccgtgagccccctcctgctgacctccagccagcagaaggcggactggatccccctcgccctgaccatcaagggcctgaaccccacggccatcttcctcaccaccctgtcccgcaccagcaagaagcggtcctggccgctgaacgaggccatcatggccgtcggcatggtgagcatcctcgcgtccagcctgctgaagaacgacatccccatgacggggcccctcgtggccggcgggctgctgaccgtctgctacgtgctcaccggccgcagcgccgacctggagctggagcgggccgccgacgtgaagtgggaggaccaggcggagatctccgggagctcccccatcctcagcatcaccatctccgaggacggcagcatgtccatcaagaacgaggaggaggagcagacgctgaccatcctgatccgcaccggcctcctggtcatcagcggggtgttcccggtgtccatccccatcaccgccgccgcctggtacctgtgggaggtcaagaagcagcgggccggcgtgctctgggacgtgcccagcccgccgcccgtcgggaaggcggagctggaggacggcgcctaccgcatcaagcagcgggggatcctgggctactcccagatcggcgccggggtgtacaaggagggcaccttccacacgatgtggcacgtgacccgcggggccgtcctcatgcaccggggcaagcgcatcgagcccagctgggccgacgtgaagaaggacctgatctcctacgggggcggctggaagctggagggggagtggaaggagggcgaggaggtgcaggtcctcgcgctggagcccgggaagaacccccgggccgtgcagaccaagcccggcatcttcaagaccaacacggggaccatcggcgccgtgagcctggacttctcccccggcaccagcgggtcccccatcgtcgacaagaagggcaaggtggtggggctctacggcaacggcgtcgtgacccgcagcggggcctacgtgtccgcgatcgcccagacggagaagtccatcgaggacaaccccgagatcgaggacgacatcttccggaagaagcgcctgaccatcatggacctgcaccccggcgccgggaagaccaagcggtacctccccgccatcgtccgcgaggccatcaagcggggcctgcgcaccctgatcctggcgccgacgcgggtggtggccgccgagatggaggaggccctccgcgggctgcccatccgctaccagacccccgccatcaaggcggagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgccgcgcgcggctacatcagcacccgggtcgagatgggggaggccgccggcatcttcatgaccgccacgccgcccgggtcccgcgacccgttcccccagagcaacgcgcccatcatggacgaggagcgggagatccccgagcgctcctggaacagcggccacgagtgggtgaccgacttcaaggggaagaccgtgtggttcgtcccgtccatcaaggccggcaacgacatcgccgcctgcctccggaagaacggcaagaaggtgatccagctgagccgcaagaccttcgactccgagtacgtgaagacgcgggccaacgactgggacttcgtcgtgaccaccgacatcagcgagatgggggcgaacttcaaggccgagcgcgtgatcgacccccggcgctgcatgaagcccgtcatcctgaccgacggcgaggagcgggtgatcctcgccgggcccatgccggtgacgcactccagcgccgcccagcgccggggccgcatcgggcggaaccccaagaacgagaacgaccagtacatctacatgggcgagcccctggagaacgacgaggactgcgcgcactggaaggaggccaagatgctgctcgacaacatcaacacccccgagggcatcatcccgtccatgttcgagcccgagcgcgagaaggtcgacgccatcgacggggagtaccgcctgcggggcgaggcccgcaagaccttcgtggacctgatgcggcgcggggacctccccgtgtggctggcctacaaggtcgcggccgagggcatcaactacgccgaccggaagtggtgcttcgacgggatcaagaacaaccagatcctggaggagaacgtggaggtggagatctggaccaaggagggcgagcgcaagaagctcaagccgcggtggctggacgcccgcatctacagcgaccccctggcgctcaaggagttcaaggagttcgccgccggccggaagtccctgacgctgaacctcatcaccgagatggggcgcctgcccaccttcatgacccagaaggcccggaacgccctggacaacctcgcggtcctgcacacggccgaggccggcgggcgcgcctacaaccacgccctgagcgagctccccgagaccctggagaccctgctcctgctgaccctcctggcgacggtgaccggcggcatcttcctgttcctcatgtccgggaagggcatcgggaagatgaccctgggcatgtgctgcatcatcaccgccagcatcctgctctggtacgcccagatccagccgcactggatcgccgcctccatcatcctggagttcttcctgatcgtcctcctgatccccgagcccgagaagcagcggacgccccaggacaaccagctgacgtacgtggtgatcgcgatcctcaccgtcgtggccgccaccatggccaacgagatggggttcctggagaagaccaagaaggacctgggcctcggcagcatcacgacccaggagagcgagtccaacatcctggacatcgacctgcgcccggccagcgcgtggaccctctacgccgtggccaccacgttcgtcacccccatgctgcggcactccatcgagaacagctccgtgaacgtgagcctgaccgccatcgcgaaccaggccaccgtcctcatggggctgggcaaggggtggcccctgtccaagatggacatcggcgtgcccctcctggccatcgggtgctacagccaggtgaacccgatcacgctgaccgccgccctcctgctgctcgtcgcgcactacgccatcatcggccccggcctgcaggccaaggccacccgcgaggcccagaagcgggcggccgccgggatcatgaagaaccccaccgtggacggcatcacggtgatcgacctggagcccatcccgtacgaccccaagttcgagaagcagctcgggcaggtcatgctgctgatcctctgcgtgacccaggtgctgatgatgcgcaccacctgggccctgtgcgaggccctcacgctggcgaccggccccatctccaccctgtgggaggggaaccccggccggttctggaacaccacgatcgccgtcagcatggccaacatcttccgcggctcctacctcgccggggcgggcctgctgttcagcatcatgaagaacaccaccaacacccggcgcgggacgggcaacatcggcgagaccctcggggagaagtggaagtcccgcctgaacaccctgggcaagagcgagttccagatctacaagaagtccgggatccaggaggtggaccggaccctcgccaaggagggcatcaagcgcggggagacggaccaccacgccgtgagccggggctccgccaagctgcgctggttcgtcgagcggaacatggtgaccccggagggcaaggtggtcgacctggggtgcggccgcgggggctggagctactactgcgggggcctcaagaacgtgcgggaggtgaagggcctgaccaagggcggccccgggcacgaggagcccatccccatgtccacctacggctggaacctggtccgcctccagagcggggtggacgtgttcttcacgccgcccgagaagtgcgacaccctgctgtgcgacatcggcgagagctcccccaaccccaccatcgaggccggccggaccctccgcgtcctgaacctggtggagaactggctcaacaacaacacccagttctgcatcaaggtgctgaacccgtacatgcccagcgtcatcgagaagatggagacgctgcagcggaagtacgggggcgcgctcgtgcgcaaccccctgtcccggaacagcacccacgagatgtactgggtgtccaacgccaccgggaacatcgtcagctccgtgaacatgatcagccgcatgctgatcaaccggttcaccatgaagcacaagaaggccacgtacgagccggacgtggacctgggctccgggacccgcaacatcggcatcgagagcgagatccccaacctcgacatcatcggcaagcggatcgagaagatcaagcaggagcacgagacctcctggcactacgaccaggaccacccctacaagacctgggcctaccacgggagctacgagacgaagcagaccggctccgccagctccatggtcaacggggtggtgcgcctgctgaccaagccctgggacgtcgtgccgatggtgacccagatggcgatgacggacaccacccccttcggccagcagcgggtcttcaaggagaaggtggacacccgcacgcaggagcccaaggagggcaccaagaagctcatgaagatcaccgccgagtggctgtggaaggagctggggaagaagaagacgccccgcatgtgcacgcgggaggagttcacccgcaaggtgcggagcaacgccgccctcggcgccatcttcaccgacgagaacaagtggaagtccgcgcgcgaggccgtcgaggacgggcggttctgggagctggtggaccgcgagcggaacctgcacctcgagggcaagtgcgagacctgcgtgtacaacatgatggggaagcgcgagaagaagctgggcgagttcggcaaggccaaggggagccgggccatctggtacatgtggctgggcgcgcgcttcctcgagttcgaggccctggggttcctgaacgaggaccactggttctcccggggcaacagcctcagcggggtcgagggcgagggcctgcaccgcctggggtacatcctccgggacgtgggcaagaaggagggcggcgccatgtacgccgacgacacggccgggtgggacacccgcatcaccctggaggacctgaagaacgaggagatggtcaccaaccacatgaagggcgagcacaagaagctcgcggaggccatcttcaagctgacgtaccagaacaaggtggtgcgggtccagcgcccgacgccccggggcaccgtgatggacatcatctcccgccgggaccagcgcgggagcggccaggtggggacctacggcctgaacacgttcaccaacatggaggcccagctcatccggcagatggagggcgaggggatcttcaagtccatccagcacctgaccgccaccgaggagatcgccgtccagaactggctggcgcgcgtgggccgcgagcggctcagccgcatggccatctccggggacgactgcgtggtcaagcccatcgacgaccggttcgccagcgccctgacggccctgaacgacatgggcaaggtgcgcaaggacatccagcagtgggagccctcccgggggtggaacgactggacccaggtgccgttctgcagccaccacttccacgagctcgtcatgaaggacggccgcgtgctggtggtcccctgccggaaccaggacgagctgatcggccgcgcgcggatctcccagggggccggctggagcctcaaggagaccgcctgcctggggaagtcctacgcccagatgtggaccctgatgtacttccaccgccgggacctccgcctggccgcgaacgccatctgcagcgccgtgccctcccactgggtgcccaccagccggacgacctggtccatccacgccaagcacgagtggatgaccaccgaggacatgctggcggtctggaaccgcgtgtggatccaggagaacccgtggatggaggacaagacgcccgtggagagctgggaggaggtcccctacctcggcaagcgggaggaccagtggtgcgggtccctgatcggcctgaccagccgcgccacctgggccaagaacatccagaccgccatcaaccaggtgcggagcctcatcggcaacgaggagtacacggactacatgccctccatgaagcgcttccggcgcgaggaggaggaggccggggtgctgtggtga

SEQ ID NO: 9128 - RNA, 9876 nt, synthetic construct
  misc_feature 1..9876: note = derived and/or modified CDS sequence (opt1) from DENV-2__FJ898451__SS-prME
  source 1..9876: mol_type = other RNA
accgccggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtcacgtacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcggcacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcggcggggtcttcacgtccatcgggaaggccctccaccaggtgttcggggcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggtcatggtgcaggccgactccggctgcatcgtgagctggaagaacaaggagctcaagtgcggctccgggatcttcatcaccgacaacgtccacacctggaccgagcagtacaagttccagcccgagagccccagcaagctggcgtccgccatccagaaggcccacgaggagggcatctgcgggatccggagcgtgacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggccaagatgctcagcaccgagtcccacaaccagaccttcctgatcgacgggcccgagacggcggagtgcccgaacaccaaccgggcctggaacagcctggaggtcgaggactacggcttcggggtgttctccaccaacatctggctcaagctgcgcgagaagcaggacgtgttctgcgacagcaagctgatgtccgccgccatcaaggacaaccgggccgtccacgcggacatgggctactggatcgagagcgtgctcaacgacacctggaagatggagaaggcctccttcatcgaggtcaagagctgccactggcccaagtcccacaccctgtggagcaacggcgtgctggagtccgagatgatcatccccaagaacttcgccgggcccgtgagccagcacaactaccgcccgggctaccacacgcagaccgccgggccctggcacctcggcaagctggagatggacttcgacttctgcgaggggaccaccgtggtcgtgacggaggactgcggcaaccggggccccagcctgcgcaccaccaccgcctccgggaagctcatcacggagtggtgctgccggagctgcaccctgcccccgctgcgctaccggggcgaggacgggtgctggtacggcatggagatccgccccctcaaggagaaggaggagaacctggtgaactccctggtcaccgcggggcacggccagatcgacaacttcagcctcggcgtgctggggatggccctgttcctcgaggagatgctgcggacccgcgtgggcacgaagcacgccatcctgctcgtcgccctgtccttcgtgaccctgatcaccgggaacatgagcttccgggacctcggccgcgtgatggtcatggtgggggcgaccatgacggacgacatcggcatgggcgtgacctacctggccctgctcgccgccttcaaggtccgccccaccttcgccgcggggctgctgctccggaagctgacctccaaggagctgatgatggccacgatcggcatcgccctcctgagccagtccaccctgcccgagaccatcctcgagctgaccgacgccctggccctcgggatgatggtgctgaagatcgtgcgcaacatggagaagtaccagctggcggtcacgatcatggccatcagctgcgtgccgaacgccgtgatcctccagaacgcctggaaggtctcctgcaccatcctggccgcggtgagcgtcagccccctgctcctgaccagctcccagcagaaggccgactggatccccctggccctcaccatcaagggcctgaaccccacggccatcttcctgaccaccctcagccggacctccaagaagcgcagctggccgctgaacgaggcgatcatggccgtgggcatggtgtccatcctggccagcagcctcctgaagaacgacatccccatgacggggcccctggtcgccggcgggctcctgaccgtgtgctacgtgctgaccggccggtccgccgacctcgagctggagcgcgcggccgacgtcaagtgggaggaccaggccgagatcagcgggtccagccccatcctgtccatcaccatcagcgaggacggctccatgagcatcaagaacgaggaggaggagcagacgctcaccatcctgatccggaccggcctgctcgtgatctccggggtgttcccggtcagcatccccatcaccgccgccgcgtggtacctgtgggaggtgaagaagcagcgcgccggcgtgctgtgggacgtccccagcccgccgcccgtggggaaggccgagctcgaggacggcgcctaccggatcaagcagcgcgggatcctgggctacagccagatcggcgccggggtgtacaaggagggcaccttccacacgatgtggcacgtcacccgcggggcggtgctgatgcaccgcggcaagcggatcgagccctcctgggccgacgtgaagaaggacctcatcagctacgggggcggctggaagctggagggggagtggaaggagggcgaggaggtccaggtgctggccctcgagcccgggaagaacccccgcgccgtgcagaccaagcccggcatcttcaagaccaacacggggaccatcggcgccgtctccctggacttcagccccggcacctccgggagccccatcgtggaccggaagggcaaggtggtcgggctgtacggcaacggcgtggtgacccgctccggggcgtacgtcagcgccatcgcccagacggagaagtccatcgaggacaaccccgagatcgaggacgacatcttccggaagaagcgcctcaccatcatggacctgcaccccggcgccgggaagaccaagcggtacctgcccgcgatcgtgcgcgaggccatcaagcggggcctgcgcaccctcatcctggccccgacgcgcgtggtcgccgccgagatggaggaggcgctgcgggggctccccatccgctaccagacccccgccatccgggccgagcacaccggccgcgagatcgtggacctgatgtgccacgccaccttcacgatgcggctgctctcccccgtgcgcgtcccgaactacaacctgatcatcatggacgaggcccacttcaccgaccccgcgagcatcgccgcccggggctacatctccacccgcgtggagatgggggaggccgccggcatcttcatgaccgcgacgccgcccgggagccgggacccgttcccccagtccaacgcccccatcatggacgaggagcgcgagatccccgagcggagctggaactccggccacgagtgggtgaccgacttcaaggggaagaccgtctggttcgtgccgagcatcaaggccggcaacgacatcgccgcgtgcctgcgcaagaacggcaagaaggtgatccagctctcccggaagaccttcgacagcgagtacgtcaagacgcgcgccaacgactgggacttcgtggtgaccaccgacatctccgagatgggggccaacttcaaggccgagcgggtcatcgacccccgccggtgcatgaagcccgtgatcctgaccgacggcgaggagcgcgtgatcctggccgggcccatgccggtcacgcacagctccgcggcccagcggcgcggccgcatcgggcggaaccccaagaacgagaacgaccagtacatctacatgggcgagcccctcgagaacgacgaggactgcgcccactggaaggaggccaagatgctgctggacaacatcaacacccccgagggcatcatcccgagcatgttcgagcccgagcgcgagaaggtggacgccatcgacggggagtaccggctccgcggcgaggcgcggaagaccttcgtggacctgatgcgccgcggggacctgcccgtctggctcgcctacaaggtggccgccgagggcatcaactacgccgaccgcaagtggtgcttcgacgggatcaagaacaaccagatcctggaggagaacgtggaggtcgagatctggaccaaggagggcgagcggaagaagctgaagccgcgctggctcgacgcgcggatctactccgaccccctggccctgaaggagttcaaggagttcgccgccggccgcaagagcctcacgctgaacctgatcaccgagatggggcggctccccaccttcatgacccagaaggcgcgcaacgccctggacaacctggccgtgctccacacggccgaggtcggcgggcgggcctacaaccacgcgctgtccgagctgcccgagaccctcgagaccctgctgctcctgaccctgctcgccacggtgaccggcggcatcttcctgttcctgatgagcgggaagggcatcgggaagatgaccctcggcatgtgctgcatcatcaccgcctccatcctgctgtggtacgcccagatccagccgcactggatcgccgcgagcatcatcctcgagttcttcctgatcgtgctgctcatccccgagcccgagaagcagcgcacgccccaggacaaccagctgacgtacgtcgtgatcgccatcctgaccgtggtcgccgccaccatggccaacgagatggggttcctcgagaagaccaagaaggacctgggcttcggcagcatcacgacccaggagtccgagagcaacatcctggacatcgacctccggccggcgtccgcctggaccctgtacgccgtggccaccacgttcgtgacccccatgctgcgccacagcatcgagaactccagcgtcaacgtgtccctcaccgccatcgcgaaccaggccaccgtgctgatggggctgggcaaggggtggcccctcagcaagatggacatcggcgtccccctgctggccatcgggtgctactcccaggtgaacccgatcacgctcaccgccgcgctgctgctcctggtggcccactacgccatcatcggccccggcctgcaggccaaggccacccgggaggcgcagaagcgcgccgccgccgggatcatgaagaaccccaccgtcgacggcatcacggtgatcgacctcgagcccatcccgtacgaccccaagttcgagaagcagctggggcaggtcatgctgctcatcctgtgcgtcacccaggtgctgatgatgcggaccacctgggccctctgcgaggcgctgacgctggccaccggccccatcagcaccctctgggaggggaaccccggccgcttctggaacaccacgatcgccgtgtccatggccaacatcttccgcggcagctacctggccggggcgggcctcctgttctccatcatgaagaacaccaccaacacccggcgcgggacgggcaacgtcggcgagaccctgggggagaagtggaagtcccggctgaacgccctcggcaagtccgagttccagatctacaagaagtccgggatccaggaggtggaccgcaccctggccaaggagggcatcaagcgcggggagaccgaccaccacgccgtgtcccgcggcagcgcgaagctgcggtggttcgtcgagcgcaacatggtgacgccggagggcaaggtggtcgacctcgggtgcggccgcggcgggtggtcctactactgcggcgggctgaagaacgtgcgcgaggtgaaggggctgaccaagggcggccccgggcacgaggagcccatccccatgagcacctacggctggaacctcgtccggctgcagagcggggtggacgtgttcttcaccccgcccgagaagtgcgacacgctgctctgcgacatcggcgagtccagccccaaccccaccatcgaggccggccgcaccctgcgggtcctgaacctcgtggagaactggctgaacaacaacacccagttctgcatcaaggtgctgaacccgtacatgccctccgtcatcgagaagatggagaccctccagcgcaagtacgggggcgccctggtgcggaaccccctgagccgcaactccacgcacgagatgtactgggtgagcaacgccaccgggaacatcgtctccagcgtgaacatgatctcccggatgctgatcaaccgcttcaccatgaagcacaagaaggccacctacgagccggacgtggacctcggcagcgggacgcggaacatcggcatcgagtccgagatccccaacctggacatcatcggcaagcgcatcgagaagatcaagcaggagcacgagaccagctggcactacgaccaggaccacccctacaagacctgggcgtaccacgggtcctacgagaccaagcagacgggcagcgcctccagcatggtcaacggggtggtgcgcctgctcaccaagccctgggacgtcgtgccgatggtgacccagatggccatgaccgacacgacccccttcggccagcagcgggtcttcaaggagaaggtggacacccgcacccaggagcccaaggagggcacgaagaagctgatgaagatcaccgccgagtggctgtggaaggagctcgggaagaagaagacgccccggatgtgcacccgcgaggagttcacgcggaaggtgcgctccaacgccgcgctgggcgccatcttcaccgacgagaacaagtggaagtccgcccgggaggccgtcgaggacgggcgcttctgggagctggtggaccgggagcgcaacctccacctggagggcaagtgcgagacctgcgtctacaacatgatggggaagcgggagaagaagctgggcgagttcggcaaggccaaggggtcccgcgcgatctggtacatgtggctcggcgcccggttcctggagttcgaggccctggggttcctcaacgaggaccactggttcagccgcggcaacagcctgtccggggtggagggcgagggcctgcaccggctcgggtacatcctgcgcgaggtgggcaagaaggagggcggcgccatgtacgcggacgacaccgccgggtgggacacgcggatcaccctggaggacctcaagaacgaggagatggtcaccaaccacatgaagggcgagcacaagaagctggccgaggccatcttcaagctgacctaccagaacaaggtggtgcgcgtccagcggccgacgccccgcggcaccgtgatggacatcatcagccggaaggaccagcgcgggtccggccaggtggggacctacggcctcaacaccttcacgaacatggaggcccagctgatccgccagatggagggcgaggggatcttcaagagcatccagcacctgaccgcgaccgaggagatcgccgtccagaactggctcgcccgggtgggccgcgagcggctgtcccgcatggccatcagcggggacgactgcgtggtcaagcccatcgacgaccggttcgcctccgcgctgaccgccctcaacgacatgggcaaggtgcgcaaggacatccagcagtgggagcccagccgggggtggaacgactggacccaggtgccgttctgctcccaccacttccacgagctggtcatgaaggacggccgcgtgctggtggtcccctgccggaaccaggacgagctcatcggccgcgcccggatcagccagggggccggctggtccctgaaggagaccgcctgcctgggcaagagctacgcgcagatgtggaccctcatgtacttccaccgccgggacctgcgcctggccgccaacgccatctgctccgccgtgcccagccactgggtgcccacctcccggaccacgtggagcatccacgcgaagcacgagtggatgaccaccgaggacatgctcgccgtctggaaccgcgtgtggatccaggagaacccgtggatggaggacaagacccccgtggagtcctgggaggaggtcccctacctgggcaagcgggaggaccagtggtgcgggagcctgatcggcctcacgagccgcgccacctgggccaagaacatccagaccgcgatcaaccaggtgcggtccctgatcggcaacgaggagtacaccgactacatgcccagcatgaagcgcttccgccgggaggaggaggaggccggggtgctgtggtga

SEQ ID NO: 9129 - RNA, 9876 nt, synthetic construct
  misc_feature 1..9876: note = derived and/or modified CDS sequence (opt1) from DENV-2__HM488257__SS-prME
  source 1..9876: mol_type = other RNA
accgccgggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacgtacgggacctgcaccgtcaccggcgagcaccggcgcgagaagcggagcgtggccctggtgccccacgtcggcatggggctggagacgcgcaccgagacctggatgtccagcgagggcgcctggaagcacgcccagcggatcgagacctgggtgctccgccaccccgggttcacgatcatggccgcgatcctggcctacaccatcggcaccacctacttccagcgggtgctgatcttcatcctcctgacggccgtcgccccctccatgaccatgcgctgcatcgggatcagcaaccgggacttcgtggagggcgtgtccggcgggagctgggtcgacatcgtgctggagcacggctcctgcgtgaccaccatggcgaagaacaagcccacgctcgacttcgagctgatcaagaccgaggccaagcaccccgccaccctgcgcaagtactgcatcgaggccaagctcaccaacacgaccaccgccagccggtgcccgacccagggggagccctccctgaacgaggagcaggacaagcgcttcgtctgcaagcacagcatggtggaccggggctggggcaacgggtgcggcctgttcgggaagggcgggatcgtgacgtgcgcgatgttcacgtgcaagaagaacatggagggcaagatcgtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgtgacgatggagtgcagcccccgcaccggcctggacttcaacgagatggtgctcctgcagatggagaacaaggcctggctggtccaccggcagtggttcctcgacctgcccctgccctggctcccgggcgccgacacccaggggtccaactggatccagaaggagaccctggtgacgttcaagaacccccacgcgaagaagcaggacgtcgtggtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtcgtgaaggagatcgccgagacccagcacggcaccatcgtgatccgcgtccagtacgagggggacggcagcccctgcaagatccccttcgagatcatggacctggagaagcggcacgtgctgggccgcctcatcacggtgaacccgatcgtcaccgagaaggactcccccgtgaacatcgaggcggagccgcccttcggggacagctacatcatcgtgggcgtcgagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggccctgcaccaggtgttcggggcgatctacggcgccgccttcagcggcgtctcctggaccatgaagatcctcatcggggtggtgatcacctggatcggcatgaacagccgctccacgagcctgtccgtcagcctggtgctggtgggggtcgtgaccctctacctgggcgtgatggtccaggccgactccgggtgcgtggtgagctggaagaacaaggagctgaagtgcggcagcggcatcttcatcaccgacaacgtccacacctggacggagcagtacaagttccagcccgagtcccccagcaagctcgcgtccgccatccagaaggcccacgaggaggggatctgcggcatccggagcgtgacccgcctggagaacctgatgtggaagcagatcacccccgagctcaaccacatcctgtccgagaacgaggtgaagctgaccatcatgacgggggacatcaagggcatcatgcaggccgggaagcggagcctccgcccgcagcccaccgagctgaagtactcctggaaggcctggggcaaggcgaagatgctgagcaccgagctccacaaccacaccttcctgatcgacggccccgagacggccgagtgcccgaacaccaaccgggcctggaactccctggaggtcgaggactacgggttcggcgtgttcaccaccaacatctggctcaagctgaaggagcgccaggacgtgttctgcgacagcaagctgatgtccgccgccatcaaggacaaccgggcggtccacgccgacatggggtactggatcgagagcgccctcaacgacacgtggaagatcgagaaggcctccttcatcgaggtcaagagctgccactggcccaagtcccacaccctgtggagcaacggcgtgctggagtccgagatgatcatccccaagaacttcgccggccccgtgagccagcacaactaccgcccggggtaccacacccagaccgcgggcccctggcacctcgggcggctggagatggacttcgacttctgcgagggcaccacggtggtggtcaccgaggactgcgggaaccgcggccccagcctgcggaccaccacggcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtgaccgccggccacgggcagatcgacaacttcagcctcggcgtcctgggcatggccctgttcctcgaggagatgctgcgcacgcgggtggggaccaagcacgcgatcctgctcgtggccgtctccttcgtgaccctgatcaccggcaacatgagcttccgcgacctggggcgcgtgatggtcatggtgggcgccacgatgaccgacgacatcgggatgggcgtgacctacctcgccctgctggccgcgttcaaggtccggcccacctacgccgccggcctcctgctgcgcaagctcacgtccaaggagctgatgatgaccaccatcgggatcgtgctgctcagccagtccaccatccccgagacgatcctggagctgaccgacgccctcgccctgggcatgatggtcctgaagatcgtgcggaacatggagaagtaccagctcgcggtgaccatcatggccatcctgtgcgtcccgaacgccgtgatcctgcagaacgcctggaaggtgagctgcaccacgctcgccatggtctccgtgagccccctgctgctcacctccagccagcagaaggcggactggatccccctggccctgaccatcaaggggctcaaccccaccgccatcttcctgacgaccctgtcccgcaccagcaagaagcggtcctggccgctcaacgaggccatcatggcggtgggcatggtcagcatcctggcctccagcctgctcaagaacgacatccccatgaccggccccctggtggccgggggcctgctcacggtgtgctacgtcctgaccgggcgcagcgccgacctggagctcgagcgggccgcggacgtgcgctgggaggagcaggccgagatctccggcagctcccccatcctgagcatcaccatctccgaggacgggagcatgtccatcaagaacgaggaggaggagcagaccctgacgatcctcatccggaccggcctgctggtgatcagcggcctcttcccggtctccatccccatcaccgccgccgcctggtacctgtgggaggtgaagaagcagcgcgcgggggtgctgtgggacgtccccagcccgccgcccgtgggcaaggccgagctcgaggacggggcctaccggatcaagcagaagggcatcctggggtactcccagatcggcgccggcgtgtacaaggaggggaccttccacaccatgtggcacgtcacgcgcggcgccgtgctgatgcacaaggggaagcggatcgagcccagctgggcggacgtgaagaaggacctcatctcctacggcgggggctggaagctggagggcgagtggaaggagggggaggaggtccaggtgctggccctcgagcccggcaagaacccccgcgccgtgcagaccaagcccgggctgttcaagaccaacaccggcacgatcggggccgtcagcctggacttctcccccggcaccagcggctcccccatcgtggacaagaaggggaaggtggtcggcctctacgggaacggcgtggtgacccggagcggcacctacgtctccgccatcgcgcagacggagaagtccatcgaggacaaccccgagatcgaggacgacatcttccgcaagaagcggctgaccatcatggacctgcaccccggggccggcaagaccaagcgctacctgcccgccatcgtgcgggaggccatcaagcgcgggctccggaccctgatcctggcgccgacgcgcgtggtcgccgccgagatggaggaggccctccgcggcctgcccatccggtaccagacccccgccatccgcgcggagcacaccgggcgggagatcgtggacctgatgtgccacgccaccttcacgatgcgcctcctgagccccatccgggtgccgaactacaacctgatcatcatggacgaggcccacttcaccgaccccgcctccatcgccgcgcgcggctacatcagcacccgggtcgagatgggcgaggccgccgggatcttcatgaccgccacgccgcccggctcccgcgacccgttcccccagagcaacgcccccatcatggacgaggagcgggagatccccgagcgctcctggaacagcgggcacgagtgggtgaccgacttcaagggcaagaccgtgtggttcgtcccgtccatcaaggcggggaacgacatcgccgcctgcctccggaagaacggcaagaaggtgatccagctgagccgcaagaccttcgactccgagtacatcaagacgcggaccaacgactgggacttcgtggtcaccaccgacatcagcgagatgggcgccaacttcaaggcggagcgcgtgatcgacccccggcgctgcatgaagcccgtgatcctgacggacggggaggagcgggtcatcctcgccggccccatgccggtgacccactccagcgccgcccagcgccgggggcgcgtgggccgcaaccccaagaacgagaacgaccagtacatctacatgggggagcccctggagaacgacgaggactgcgcccactggaaggaggcgaagatgctgctcgacaacatcaacacccccgagggcatcatcccgtccatgttcgagcccgagcgggagaaggtcgacgccatcgacggcgagtaccgcctgcgcggggaggcccgcaagaccttcgtggacctgatgcggcgcggcgacctccccgtctggctggcctaccgggtggccgcggaggggatcaactacgccgaccgccggtggtgcttcgacggcgtgaagaacaaccagatcctggaggagaacgtcgaggtggagatctggacgaaggagggggagcgcaagaagctcaagccgcggtggctggacgcccgcatctacagcgaccccctggccctcaaggagttcaaggagttcgccgcgggccggaagtccctgaccctgaacctcatcaccgagatgggccgcctgcccaccttcatgacgcagaaggcccggaacgccctggacaacctcgccgtgctgcacaccgcggaggccgggggccgcgcctacaaccacgccctgagcgagctccccgagaccctggagaccctgctcctgctgacgctcctggccaccgtcaccgggggcatcttcctgttcctcatgtccggcaaggggatcggcaagatgaccctggggatgtgctgcatcatcaccgcgagcatcctgctctggtacgcccagatccagccgcactggatcgccgcctccatcatcctggagttcttcctgatcgtgctcctgatccccgagcccgagaagcagcggacgccccaggacaaccagctgacctacgtggtcatcgccatcctcaccgtggtggcggccaccatggccaacgagatgggcttcctggagaagacgaagaaggacttcgggctgggcagcatcaccacccagcagccggagagcaacatcctcgacatcgacctgcgccccgcctccgcctggaccctgtacgcggtcgccacgaccttcatcacccccatgctccggcacagcatcgagaactccagcgtgaacgtgtccctgaccgccatcgccaaccaggccacggtcctgatgggcctcgggaagggctggcccctgagcaagatggacatcggggtgccgctgctcgcgatcggctgctactcccaggtgaaccccatcaccctgaccgccgccctgctcctgctggtcgcccactacgcgatcatcgggcccggcctccaggccaaggccacccgcgaggcccagaagcgggccgcggccggcatcatgaagaaccccacggtggacgggatcaccgtgatcgacctggacccgatcccctacgaccccaagttcgagaagcagctgggccaggtcatgctcctggtgctgtgcgtgacccaggtcctcatgatgcgcaccacgtgggccctgtgcgaggccctgaccctcgccaccgggcccatcagcaccctgtgggagggcaacccggggcgcttctggaacacgaccatcgcggtgtccatggccaacatcttccggggcagctacctggccggcgccgggctcctgttctccatcatgaagaacaccgccaacacccgccggggcacggggaacaccggcgagaccctgggcgagaagtggaagcaccgcctcaacgcgctgggcaagagcgagttccagatctacaagaagtccggcatccaggaggtggaccggaccctggccaaggaggggatcaagcgcggcgagacggaccaccacgccgtcagccgggggtccgccaagctccgctggttcgtggagcggaacctggtgacccccgagggcaaggtcgtggacctgggctgcgggcgcggcgggtggagctactactgcggcgggctcaagaacgtgaaggaggtcaagggcctgaccaagggcgggcccggccacgaggagcccatcccgatgtccacctacgggtggaacctggtgcggctccagagcggcgtggacgtcttcttcacgccgcccgagaagtgcgacaccctgctgtgcgacatcggggagtccagccccaacccgaccgtggaggcgggccgcaccctccgggtgctgaacctggtcgagaactggctcaacaacaacacccagttctgcatcaaggtgctgaacccctacatgcccagcgtgatcgagaagatggaggccctgcagcgcaagtacggcggggccctggtccggaacccgctctcccgcaacagcacgcacgagatgtactgggtgtccaacgccagcggcaacatcgtgtccagcgtcaacatgatctcccggatgctgatcaaccgcttcaccatgcggcacaagaaggccacctacgagcccgacgtggacctggggagcggcacccgcaacatcgggatcgagtccgagacgcccaacctcgacatcatcggcaagcgcatcgagaagatcaagcaggagcacgagaccagctggcactacgaccaggaccacccctacaagacctgggcgtaccacggctcctacgagaccaagcagacggggagcgcctccagcatggtgaacggcgtcgtgcggctgctgaccaagccgtgggacgtgatccccatggtcacccagatggccatgaccgacacgacccccttcgggcagcagcgcgtgttcaaggagaaggtcgacacccggacccaggagcccaaggagggcacgaagaagctcatgaagatcaccgccgagtggctgtggaaggagctgggcaagaagaagaccccgcgcatgtgcacccgggaggagttcacgcgcaaggtgcggtccaacgccgcgctcggggccatcttcaccgacgagaacaagtggaagtccgcccgcgaggccgtggaggactccggcttctgggagctggtcgacaaggagcggaacctgcacctcgaggggaagtgcgagacctgcgtgtacaacatgatgggcaagcgcgagaagaagctgggggagttcggcaaggccaagggcagccgggcgatctggtacatgtggctgggggcccgcttcctcgagttcgaggccctgggcttcctgaacgaggaccactggttctcccggaagaacagcctcagcggggtggagggcgaggggctgcacaagctgggctacatcctccgcgacgtctccaagaaggagggcggggccatgtacgcggacgacaccgccggctgggacacgcggatcaccctggaggacctgaagaacgaggagatggtgaccaaccacatggagggggagcacaagaagctcgccgaggccatcttccgcctgacctaccagaacaaggtggtccgggtgcagcgccccacgccccggggcaccgtgatggacatcatcagccgccgggaccagcgcgggtccggccaggtcgtgacctacggcctgaacaccttcacgaacatggaggcccagctcatccgccagatggagggggagggcgtgttcaagagcatccagcacctgaccgcgaccgaggagatcgccgtcaagacctggctggtgcgggtggggcgcgagcggctctcccgcatggccatcagcggcgacgactgcgtcgtgaagcccctggacgaccggttcgcctccgccctgacggcgctcaacgacatgggcaaggtgcgcaaggacatccagcagtgggagccgagccgggggtggaacgactggacccaggtccccttctgctcccaccacttccacgagctgatcatgaaggacggccgcgtgctggtggtcccctgccggaaccaggacgagctcatcgggcgcgcccggatcagccagggcgccgggtggtccctgcgcgagaccgcctgcctgggcaagagctacgcccagatgtggtccctcatgtacttccaccggcgcgacctgcggctggcggccaacgccatctgcagcgccgtgccctcccactgggtgccgaccagccgcaccacgtggtccatccacgccacccacgagtggatgaccaccgaggacatgctcacggtctggaaccgggtgtggatccaggagaacccctggatggaggacaagacccccgtggagagctgggaggagatcccctacctgggcaagcgcgaggaccagtggtgcgggagcctgatcggcctcacctcccgggcgacctgggccaagaacatccagacggccatcaaccaggtccgcagcctgatcgggaacgaggagtacaccgactacatgccgtccatgaagcgcttccggcgcgaggaggaggaggccggcgtgctgtggtga

SEQ ID NO: 9130 - RNA, 9876 nt, synthetic construct
  misc_feature 1..9876: note = derived and/or modified CDS sequence (opt1) from DENV-2__HQ999999__SS-prME
  source 1..9876: mol_type = other RNA
accgcgggcgtgatcgtgatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacatccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatcagcaaccgggacttcgtggagggcgtcagcgggggcagctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcaccgacctggagaagcggcacgtcctcgggcgcctgatcaccgtgaacccgatcgtgaccgagaaggacagccccatcaacatcgaggcggagccgcccttcggcgactcctacatcatcatcggggtcgagccgggccagctgaagctcaactggttcaagaaggggagctccatcggccagatgttcgagacgaccatgcgcggcgccaagcggatggccatcctgggggacaccgcctgggacttcggcagcctcgggggcgtgttcacctccatcgggaaggccctccaccaggtgttcggcgcgatctacggcgccgccttcagcggggtctcctggacgatgaagatcctgatcggcgtgatcatcacctggatcgggatgaacagccgctccaccagcctgtccgtgagcctggtcctcgtgggcgtggtcaccctgtacctgggggccatggtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgaaggagaagcaggacgtcttctgcgactccaagctgatgagcgccgccatcaaggacaaccgcgcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccggccgggctaccacacgcagaccgcggggccctggcacctcggcaagctggagatggacttcgacctgtgcgaggggaccaccgtggtcgtgacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtcaccgccgggcacggccagatcgacaacttctccctgggcgtgctggggatggccctcttcctggaggagatgctgcgcacccggatcggcacgaagcacgcgatcctcctggtggccgtcagcttcgtgaccctgatcaccgggaacatgtccttccgcgacctcggccgggtgatggtcatggtgggggccaccatgacggacgacatcggcatgggcgtgacctacctggccctgctcgccgcgttcaaggtccgccccaccttcgccgccgggctgctgctccgcaagctgaccagcaaggagctgatgatggccacgatcggcatcgccctcctgtcccagagcaccatccccgagaccatcctggagctcaccgacgcgctggccctggggatgatggtgctcaaggtggtccggaacatggagaagtaccagctggccgtgacgatcatggccatctcctgcgtgccgaacgccgtcatcctgcagaacgcgtggaaggtgagctgcaccatcctcgccgccgtgtccgtcagccccctgctgctcacctccagccagcagaaggccgactggatccccctggcgctgaccatcaagggcctcaaccccacggccatcttcctgaccaccctgtcccgcaccagcacgaagcggtcctggccgctcaacgaggccatcatggccgtgggcatggtcagcatcctggcctccagcctgctcaagaacgacatccccatgaccgggcccctggtggcgggcgggctgctcaccgtgtgctacgtcctgaccggccgcagcgccgacctggagctcgagcgggccgccgacgtgaagtgggaggaccaggccgagatctccgggagctcccccatcctgagcatcacgatctccgaggacggcagcatgtccatcaagaacgaggaggaggagcagaccctgaccatcctcatccgcaccggcctgctggtgatcagcggggtcttcccggtgtccatccccatcaccgcggccgcctggtacctctgggaggtgaagaagcagcgggccggcgtcctgtgggacgtgcccagcccgccgcccgtggagaaggccgagctggaggacggggcgtaccgcatcaagcagcggggcatcctcgggtactcccagatcggcgccggcgtctacaaggaggggacgttccacaccatgtggcacgtgacccgcggcgccgtgctgatgcaccgggggaagcgcatcgagcccagctgggccgacgtcaagaaggacctgatctcctacggcgggggctggaagctcgagggcgagtggaaggagggggaggaggtccaggtgctggccctggagcccggcaagaacccccgggcggtccagaccaagcccgggatcttcaagacgaacaccggcaccatcggggccgtgagcctcgacttctcccccggcaccagcggctcccccatcgtggaccgcaaggggaaggtcgtgggcctgtacgggaacggcgtggtcacgcggagcggcgcctacgtgtccgccatcgcgcagaccgagaagtccatcgaggacaaccccgagatcgaggacgacatcttccgcaagaagcggctgaccatcatggacctccaccccggggccggcaagaccaagcgctacctgcccgccatcgtgcgggaggccatcaagcgcgggctgcggacgctgatcctcgccccgacccgcgtcgtggcggccgagatggaggaggccctgcgcggcctgcccatccggtaccagacccccgccatcaagaccgagcacacggggcgcgagatcgtggacctcatgtgccacgccaccttcaccatgcggctgctgagccccgtccgcgtgccgaactacaacctcatcatcatggacgaggcgcacttcaccgaccccgcctccatcgccgcccggggctacatcagcacgcgcgtggagatgggcgaggccgcggggatcttcatgaccgccacgccgcccggctcccgggacccgttcccccagagcaacgcccccatcatggacgaggagcgcgagatccccgagcggtcctggaacagcgggcacgagtgggtcaccgacttcaagggcaagacggtgtggttcgtgccgtccatcaaggccgggaacgacatcgcggcctgcctgcgcaagaacggcaagaaggtcatccagctgagccggaagaccttcgactccgagtacgtgaagacccgcgccaacgactgggacttcgtggtcaccacggacatcagcgagatgggcgccaacttcaaggccgagcgggtgatcgacccccgccggtgcatgaagcccgtgatcctcaccgacggggaggagcgcgtcatcctggcgggccccatgccggtgacccactccagcgccgcccagcggcgcgggcggatcggccgcaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgcgagaaggtggacgcgatcgacggcgagtaccggctgcgcggggaggcccggaagacgttcgtcgacctcatgcgccggggcgacctgcccgtgtggctggcctacaaggtggccgccgaggggatcaactacgcggaccgccggtggtgcttcgacggcatcaagaacaaccagatcctcgaggagaacatggaggtcgagatctggaccaaggagggggagcgcaagaagctgaagccgcggtggctggacgcccgcatctacagcgaccccctcgccctgaaggagttcaaggagttcgccgcgggccggaagtccctgaccctcaacctgatcaccgagatgggccgcctgcccacgttcatgacccagaaggcccggaacgccctcgacaacctggccgtgctgcacaccgccgaggccgggggccgcgcctacaaccacgccctcagcgagctgcccgagaccctggagacgctcctgctgctcaccctgctggccaccgtgaccgggggcatcttcctcttcctgatgtccggcaaggggatcggcaagatgaccctggggatgtgctgcatcatcacggccagcatcctcctgtggtacgcgcagatccagccgcactggatcgccgcctccatcatcctggagttcttcctcatcgtcctgctgatccccgagcccgagaagcagcggacgccccaggacaaccagctcacctacgtggtcatcgccatcctgaccgtggtggccgcgacgatggccaacgagatgggcttcctggagaagaccaagaaggacctcgggctgggcagcatcaccacccaggagagcgagtccaacatcctggacatcgacctccgcccggccagcgcctggacgctgtacgccgtcgcgaccaccttcctgacccccatgctccggcactccatcgagaacagctccgtgaacgtgagcctgacggccatcgccaaccaggccaccgtcctgatgggcctcgggaagggctggcccctgtccaagatggacatcggggcgcccctgctcgccatcggctgctacagccaggtgaacccgatcaccctgaccgccgccctgctcctgctggtggcccactacgcgatcatcgggcccggcctccaggccaaggccacgcgcgaggcccagaagcgggccgcggccggcatcatgaagaaccccaccgtcgacgggatcaccgtgatcgacctggaccccatcccgtacgaccccaagttcgagaagcagctgggccaggtgatgctcctgatcctgtgcgtcacccaggtgctcatgatgcgcacgacctgggccctgtgcgaggccctgaccctcgccaccgggcccatctccacgctgtgggagggcaaccccgggcggttctggaacaccaccatcgcggtgagcatggccaacatcttccgcggctcctacctggccggcgccgggctcctgttcagcatcatgaagaacaccacgtccacccgccggggcaccgggaacatcggcgagaccctgggcgagaagtggaagtcccgcctcaacgcgctggggaagtccgagttccagatctacaagaagtccggcatccaggaggtcgaccggacgctggccaaggaggggatcaagcgcggcgagaccgaccaccacgccgtgtcccgggggagcgccaagctccgctggttcgtggagcggaacatggtcaccccggagggcaaggtggtggacctgggctgcgggcgcggcgggtggtcctactactgcggcgggctgaagaacgtccgggaggtgaagggcctcaccaagggcgggcccggccacgaggagcccatccccatgagcacgtacgggtggaacctggtgcgcctgcagagcggcgtcgacgtgttcttcaccccgcccgagaagtgcgacaccctcctgtgcgacatcggggagtccagccccaaccccaccatcgaggccggccggaccctgcgcgtgctcaacctggtcgagaactggctgaacaacaacacgcagttctgcatcaaggtgctcaacccgtacatgccctccgtgatcgagaagatggaggcgctgcagcggaagtacggcggggccctggtccgcaaccccctgagccggaactccacccacgagatgtactgggtgagcaacgccaccggcaacatcgtgtccagcgtcaacatgatctcccgcatgctcatcaaccggttcaccatgaagcacaagaaggccacgtacgagccggacgtggacctggggagcggcacccgcaacatcgggatcgagtccgaggtgcccaacctggacatcatcggcaagcggatcgagaagatcaagcaggagcacgagaccagctggcactacgaccaggaccacccctacaagacctgggcctaccacggctcctacgagacgaagcagaccgggagcgcgtccagcatggtcaacggcgtggtgcgcctcctgaccaagccctgggacgtcgtgccgatggtgacccagatggccatgacggacaccacccccttcgggcagcagcgcgtcttcaaggagaaggtggacacccggacgcaggagcccaaggagggcaccaagaagctgatgaagatcaccgccgagtggctctggaaggagctgggcaagaagaagacgccccgcatgtgcacgcgggaggagttcacccgcaaggtgcggtccaacgccgccctgggggcgatcttcaccgacgagaacaagtggaagtccgcccgcgaggccgtcgaggacggccggttctgggagctcgtggaccgcgagcggaacctgcacctggaggggaagtgcgagacctgcgtgtacaacatgatgggcaagcgcgagaagaagctcggggagttcggcaaggccaagggctcccgggcgatctggtacatgtggctgggggcccgcttcctggagttcgaggccctcggcttcctgaacgaggaccactggttcagccgggggaacagcctgtccggcgtcgagggggagggcctccaccgcctgggctacatcctgcgggaggtgagcaagaaggagggcggcgccatgtacgccgacgacacggcggggtgggacacccgcatcaccctcgaggacctgaagaacgaggagatggtgaccaaccacatgaagggcgagcacaagaagctggccgaggccatcttcaagctcacgtaccagaacaaggtcgtgcgggtccagcgcccgacgccccgggggaccgtgatggacatcatctcccgccgggaccagcgcggcagcggccaggtggggacctacggcctgaacacgttcaccaacatggaggcccagctgatccgccagatggagggggagggcatcttcaagtccatccagcacctcaccgccaccgaggagatcgcggtccagaactggctggcccgggtgggccgcgagcggctgagccgcatggccatctccggggacgactgcgtggtcaagcccatcgacgaccggttcgccagcgccctcacggcgctgaacgacatgggcaaggtgcgcaaggacatccagcagtgggagccctcccgggggtggaacgactggacccaggtgccgttctgcagccaccacttccacgagctggtcatgaaggacggccgcgtgctcgtggtcccctgccggaaccaggacgagctgatcgggcgcgcccggatctcccagggcgccggctggagcctgaaggagaccgcctgcctcgggaagtcctacgcccagatgtggaccctgatgtacttccaccgccgggacctgcgcctcgcggccaacgccatctgcagcgccgtgccctcccactgggtgcccaccagccggacgacctggtccatccacgcgaagcacgagtggatgaccaccgaggacatgctggccgtctggaaccgcgtgtggatccaggagaacccgtggatggaggacaagacgcccgtggagagctgggaggaggtcccctacctgggcaagcgggaggaccagtggtgcgggagcctcatcggcctgacctcccgcgccacctgggccaagaacatccagaccgccatcaaccaggtgcggagcctgatcgggaacgaggagtacacggactacatgccctccatgaagcgcttccgccgggaggaggaggaggcgggcgtgctctggtga

SEQ ID NO: 9131 - RNA, 9876 nt, synthetic construct
  misc_feature 1..9876: note = derived and/or modified CDS sequence (opt1) from DENV-2__FJ898449__SS-prME
  source 1..9876: mol_type = other RNA
accgcgggcatgatcatcatgctgatccccaccgtgatggccttccacctcaccacccggaacggggagccccacatgatcgtgagccggcaggagaagggcaagagcctgctgttcaagaccaaggacgggaccaacatgtgcacgctcatggcgatggacctgggcgagctgtgcgaggacaccatcacctacaagtgccccttcctcaagcagaacgagcccgaggacatcgactgctggtgcaacagcacctccacctgggtgacctacgggacctgcaccacgaccggcgagcaccgccgggagaagcgcagcgtggccctggtcccccacgtgggcatggggctggagacccggaccgagacgtggatgtccagcgagggcgcctggaagcacgcccagcgcatcgagacctggatcctccggcaccccgggttcaccatcatggccgcgatcctggcctacaccatcggcacgacccacttccagcgcgtgctgatcttcatcctcctgaccgccatcgccccctccatgaccatgcggtgcatcgggatcagcaaccgcgacttcgtcgagggcgtgtccggcgggagctgggtggacatcgtcctggagcacggctcctgcgtgacgaccatggcgaagaacaagcccaccctcgacttcgagctgatcaagaccgaggccaagcagcccgccacgctgcggaagtactgcatcgaggccaagctcaccaacaccaccacggacagccgctgcccgacccagggggagcccaccctgaacgaggagcaggacaagcggttcgtgtgcaagcactccatggtcgaccgcggctggggcaacgggtgcggcctgttcgggaagggcgggatcgtgacctgcgccatgttcacgtgcaagaagaacatggagggcaagatcgtgcagcccgagaacctcgagtacaccgtcgtgatcacgccccacagcggcgaggagcacgcggtggggaacgacaccggcaagcacgggaaggaggtcaagatcaccccgcagtccagcatcacggaggccgagctgaccggctacgggaccgtgaccatggagtgcagcccccggacgggcctggacttcaacgagatggtgctcctgcagatggaggacaaggcctggctggtccaccgccagtggttcctcgacctgcccctgccctggctcccgggcgccgacacccaggggagcaactggatccagaaggagaccctggtgaccttcaagaacccccacgccaagaagcaggacgtggtcgtgctgggctcccaggagggggcgatgcacacggccctcaccggcgccaccgagatccagatgagcagcgggaacctgctgttcaccggccacctcaagtgccggctgcgcatggacaagctgcagctcaagggcatgtcctacagcatgtgcacggggaagttcaagatcgtcaaggagatcgccgagacccagcacggcaccatcgtgatccgggtgcagtacgagggggacggctccccctgcaagatccccttcgagatcatggacctggagaagcgccacgtcctgggccggctcatcaccgtgaacccgatcgtgacggagaaggacagccccgtcaacatcgaggccgagccgcccttcggggactcctacatcatcatcggcgtggagccggggcagctgaagctggactggttcaagaagggcagctccatcgggcagatgttcgagaccaccatgcgcggcgcgaagcgcatggccatcctcggcgacaccgcctgggacttcgggagcctgggcggggtgttcacgtccatcggcaaggccctgcaccaggtcttcggggccatctacggcgcggccttcagcggcgtgtcctggaccatgaagatcctcatcggggtgatcatcacctggatcggcatgaacagccggtccaccagcctgtccgtcagcctggtgctggtggggatcgtcacgctctacctgggcgtgatggtgcaggccgactccgggtgcgtcgtgagctggaagaacaaggagctgaagtgcggctccggcatcttcgtgaccgacaacgtccacacctggaccgagcagtacaagttccagcccgagagccccagcaagctcgcctccgcgatccagaaggcccacgaggaggggatctgcggcatccgcagcgtgacgcggctggagaacctgatgtggaagcagatcacctccgagctcaaccacatcctgagcgagaacgaggtgaagctgaccatcatgaccggggacatcaagggcatcatgcaggtcgggaagcgctccctccggccccagccgacggagctgcgctacagctggaagacctggggcaaggccaagatgctgtccaccgagctccacaaccagaccttcctgatcgacggccccgagacggccgagtgccccaacaccaaccgggcctggaacagcctggaggtggaggactacgggttcggcgtgttcaccaccaacatctggctccgcctgcgggagaagcaggacgtcttctgcgactccaagctgatgagcgcggccatcaaggacaaccgcgccgtgcacgccgacatggggtactggatcgagtccgccctcaacgacacctggaagatcgagaaggcgagcttcatcgaggtgaagtcctgccactggcccaagtcccacacgctgtggtccaacggcgtcctggagagcgagatgatcatccccaagaacttcgccggccccgtgtcccagcacaacaaccggcccgggtaccacacccagaccgccggcccgtggcacctcgggaagctggagatggacttcgacttctgcgagggcaccacggtggtcgtgaccgaggagtgcgggaaccgcggccccagcctgcggaccaccacggccagcggcaagctcatcaccgagtggtgctgccgctcctgcaccctgccgcccctgcggtaccgcggggaggacggctgctggtacgggatggagatccggccgctcaaggagaaggaggagaacctggtgagctccctggtcaccgccggccacgggcagatcgacaacttcagcctcggcatcctgggcatggcgctgttcctcgaggagatgctgcgcacgcgggtggggaccaagcacgccatcctgctcgtggccgtctccttcgtgaccctgatcaccggcaacatgagcttccgcgacctggggcgcgtgatggtcatggtgggcgccacgatgaccgacgacatcgggatgggcgtgacctacctcgcgctgctggccgccttcaaggtccggcccaccttcgccgccggcctcctgctgcgcaagctcacgtccaaggagctgatgatgaccaccatcgggatcgtgctgctcagccagtccagcatccccgagaccatcctggagctgacggacgcgctcgccctgggcatgatggtgctgaagatggtccggaacatggagaagtaccagctcgccgtgaccatcatggccatcctgtgcgtgcccaacgccgtcatcctgcagaacgcgtggaaggtgtcctgcaccatcctcgccgtcgtgagcgtgtccccgctgctgctcaccagctcccagcagaaggccgactggatccccctggccctgacgatcaaggggctcaaccccaccgccatcttcctgaccaccctgagccgcacgtccaagaagcggagctggcccctcaacgaggcgatcatggccgtcggcatggtgtccatcctggccagcagcctgctcaagaacgacatcccgatgaccggccccctggtggccgggggcctgctcaccgtctgctacgtgctgaccgggcgctccgcggacctggagctcgagcgggccacggacgtgaagtgggacgaccaggccgagatcagcggctccagccccatcctgtccatcaccatcagcgaggacgggtccatgagcatcaagaacgaggaggaggagcagaccctgaccatcctcatccgcaccggcctgctggtcatctccggcctcttccccgtgagcatcccgatcacggccgccgcgtggtacctgtgggaggtgaagaagcagcgggccggggtcctgtgggacgtgcccagcccgccgcccgtgggcaaggccgagctcgaggacggggcctaccgcatcaagcagaagggcatcctggggtacagccagatcggcgccggcgtctacaaggaggggaccttccacaccatgtggcacgtgacccggggcgcggtgctgatgcacaaggggaagcgcatcgagccctcctgggccgacgtcaagaaggacctcatcagctacggcgggggctggaagctggagggcgagtggaaggagggggaggaggtccaggtgctggccctcgagcccggcaagaacccccgggccgtccagacgaagcccgggctgttccgcaccaacaccggcaccatcggggccgtgtccctggacttcagccccggcacgtccggcagccccatcgtggacaagaaggggaaggtcgtgggcctctacgggaacggcgtggtcacccggtccggcgcgtacgtgagcgccatcgcccagaccgagaagtccatcgaggacaacccggagatcgaggacgacatcttccgcaagcggcgcctgaccatcatggacctgcaccccggggccggcaagacgaagaagtacctgcccgccatcgtgcgggaggcgatcaagcgcgggctccggaccctgatcctggcccccacccgcgtcgtggccgccgagatggaggaggcgctccgcggcctgccgatccggtaccagacccccgccatccgcgccgagcacacggggcgggagatcgtggacctgatgtgccacgccaccttcaccatgcgcctcctgagccccatccgggtccccaactacaacctgatcatcatggacgaggcccacttcaccgacccggcgagcatcgccgcccgcggctacatctccacgcgggtggagatgggcgaggccgccgggatcttcatgaccgcgacgccgcccggcagccgcgaccccttcccgcagtccaacgcccccatcatggacgaggagcgggagatccccgagcgcagctggaactccgggcacgagtgggtgaccgacttcaagggcaagacggtctggttcgtgcccagcatcaagaccgggaacgacatcgccgcctgcctccggaagaacggcaagcgcgtgatccagctgtcccggaagaccttcgacagcgagtacgtcaagacccgcacgaacgactgggacttcgtggtgaccaccgacatctccgagatgggcgccaacttcaaggcggagcgggtcatcgacccgcgccggtgcatgaagcccgtgatcctgaccgacggggaggagcgcgtgatcctcgccggccccatgcccgtcacgcacagctccgccgcccagcggcgcgggcgcatcggccggaacccgcgcaacgagaacgaccagtacatctacatgggggagcccctggagaacgacgaggactgcgcgcactggaaggaggccaagatgctgctcgacaacatcaacacccccgagggcatcatccccagcatgttcgagccggagcgggagaaggtggacgccatcgacggcgagtaccgcctgcgcggggaggcccgcaagaccttcgtggacctgatgcggcgcggcgacctccccgtctggctggcctacaaggtggcgtccgaggggatcaactacgccgaccggcgctggtgcttcgacggcacccggaacaaccagatcctggaggagaacgtggaggtcgagatctggacgaaggagggggagcgcaagaagctcaagccccggtggctggacgcccgcatctacagcgacccgctggccctcaaggagttcaaggagttcgccgcgggccggaagtccctgaccctgaacctcatcaccgagatgggccgcctgcccaccttcatgacgcagaaggcccgggacgccctggacaacctcgccgtgctgcacaccgccgaggccggcgggaaggcctacaaccacgccctgagcgagctccccgagaccctggagaccctgctcctgctgaccctcctggccacggtcaccggcgggatcttcctgttcctcatgtccgggcgcgggatcggcaagatgaccctggggatgtgctgcatcatcaccgcgagcatcctgctctggtacgcccagatccagccccactggatcgccgccagcatcatcctggagttcttcctgatcgtgctcctgatcccggagcccgagaagcagcggacgccccaggacaaccagctgacctacgtgatcatcgccatcctcaccgtcgtggcggccaccatggccaacgagatgggcttcctggagaagacgaagaaggacctggggctcggccacatcgccacccagcagcccgagtccaacatcctggacatcgacctgcgcccggccagcgcgtggaccctctacgccgtggccaccacgttcatcacccccatgctgcggcactccatcgagaacagctccgtcaacgtgagcctgaccgccatcgccaaccaggcgaccgtgctcatgggcctggggaagggctggcccctgtccaagatggacatcggggtccccctcctggccatcggctgctacagccaggtgaacccgatcacgctgaccgccgccctcctgctgctcgtggcccactacgcgatcatcgggcccggcctgcaggccaaggccacccgcgaggcccagaagcgcgcggccgccggcatcatgaagaaccccaccgtcgacgggatcacggtgatcgacctggaccccatcccgtacgaccccaagttcgagaagcagctcggccaggtgatgctgctggtcctctgcgtgacccaggtgctgatgatgcggaccacctgggccctgtgcgaggccctcacgctggcgaccgggcccgtctccaccctgtgggagggcaaccccgggcgcttctggaacaccacgatcgccgtgagcatggccaacatcttccggggctcctacctcgccggcgccgggctgctgttcagcatcatgaagaacaccacctccacccgccggggcacggggaacatcggcgagaccctcggcgagaagtggaagtcccgcctgaacgcgctggggaagtccgagttccagatctacaagaagtccggcatccaggaggtggaccggaccctcgccaaggaggggatcaagcgcggcgagaccgaccaccacgccgtctcccgggggagcgccaagctgcgctggttcgtggagcggaacctggtgacgccggagggcaaggtcgtggacctcggctgcgggcgcggcgggtggtcctactactgcggcgggctgaagaacgtgcgggaggtcaagggcctgaccaagggcgggcccggccacgaggagcccatccccatgagcacctacgggtggaacctcgtgcgcctgcagagcggcgtggacgtcttcttcgtgccgcccgagcggtgcgacaccctgctctgcgacatcggggagtccagccccaaccccaccgtggaggccggccgcacgctgcgggtcctgaacctcgtggagaactggctgaacaacaacacccagttctgcgtgaaggtcctgaacccgtacatgccctccgtgatcgagcgcatggagaccctgcagcggaagtacggcggggcgctcgtgcgcaaccccctgagccgcaactccacccacgagatgtactgggtcagcaacgcctccggcaacatcgtgagctccgtgaacatgatcagccggatgctgatcaaccgcttcacgatgcggcacaagaaggccacctacgagccggacgtcgacctcgggtccggcacccgcaacatcgggatcgagagcgagacccccaacctggacatcatcggcaagcggatcgagaagatcaagcaggagcacgaggcctcctggcactacgaccaggaccacccctacaagacgtgggcgtaccacggcagctacgagaccaagcagaccgggtccgccagctccatggtgaacggcgtggtccgcctgctcaccaagccctgggacgtggtgccgatggtcacgcagatggccatgaccgacaccacccccttcgggcagcagcgggtgttcaaggagaaggtggacacgcgcacccaggagcccaaggagggcaccaagaagctgatgaagatcaccgccgagtggctgtggaaggagctcggcaaggagaagacgccccggatgtgcacccgcgaggagttcaccaagaaggtccggagcaacgccgcgctgggggccatcttcaccgacgagaacaagtggaagtccgcccgcgaggccgtggaggacaaccggttctgggagctggtcgacaaggagcgcaacctccacctggagggcaagtgcgagacgtgcgtgtacaacatgatggggaagcgggagaagaagctgggcgagttcgggaaggccaagggcagccgcgcgatctggtacatgtggctcggcgcccggttcctggagttcgaggccctggggttcctcaacgaggaccactggttcagccgcgagaactccctgagcggcgtggagggggagggcctgcacaagctcgggtacatcctgcgggaggtctccaagaaggagggcggcgccatgtacgccgacgacaccgcggggtgggacacccgcatcaccatcgaggacctgaagaacgaggagatgatcacgaaccacatggccggcgagcacaagaagctcgccgaggccatcttcaagctgacctaccagaacaaggtggtgcgggtccagcgcccgacgccccgcgggaccgtgatggacatcatcagccggcgcgaccagcggggctccggccaggtgggcacctacggcctgaacaccttcaccaacatggaggcgcagctcatccgccagatggagggggagggcatcttcaagagcatccagcacctgaccgcctccgaggagatcgccgtccaggactggctggtgcgggtggggcgcgagcggctcagccgcatggccatctccggcgacgactgcgtcgtgaagcccctggacgaccggttcgcccgcgcgctgacggccctcaacgacatgggcaaggtgcggaaggacatccagcagtgggagcccagccgcgggtggaacgactggacccaggtcccgttctgctcccaccacttccacgagctgatcatgaaggacggccggaccctggtggtgccctgccgcaaccaggacgagctcatcgggcgggcccgcatcagccagggcgccgggtggtccctgcgggagaccgcctgcctgggcaagagctacgcgcagatgtggtccctcatgtacttccaccgccgggacctgcgcctggccgccaacgccatctgcagcgccgtcccctcccactgggtgcccaccagccgcacgacctggagcatccacgcgtcccacgagtggatgaccaccgaggacatgctcacggtgtggaaccgggtctggatcctggagaacccgtggatggaggacaagacccccgtggagagctgggaggagatcccctacctgggcaagcgcgaggaccagtggtgcgggtccctcatcggcctgaccagccgggccacctgggccaagaacatccagacggccatcaaccaggtgcgctccctgatcgggaacgaggagtacaccgactacatgcccagcatgaagcggttccgccgggaggaggaggaggccggcgtcctctggtga

SEQ ID NO: 9132 - RNA, 9876 nt, synthetic construct
  misc_feature 1..9876: note = derived and/or modified CDS sequence (opt1) from DENV-2__FJ906966__SS-prME
  source 1..9876: mol_type = other RNA
accgccgggatgatcatcatgctgatccccaccgtgatggccttccacctcaccacccggaacggggagccccacatgatcgtcagccggcaggagaagggcaagagcctgctgttcaagaccgaggacggggtgaacatgtgcaccctcatggcgatggacctgggcgagctgtgcgaggacaccatcacctacaagtgccccttcctcaagcagaacgagcccgaggacatcgactgctggtgcaacagcaccagcacctgggtgacctacgggacctgcaccaccacgggcgagcaccggcgggagaagcgcagcgtcgccctggtgccccacgtgggcatggggctggagacccggaccgagacctggatgtccagcgagggcgcctggaagcacgcccagcgcatcgagacgtggatcctccggcaccccgggttcaccatcatggccgcgatcctggcctacaccatcggcaccacgcacttccagcgcgccctgatcttcatcctcctgaccgccgtcgcgccctccatgaccatgcggtgcatcgggatcagcaaccgcgacttcgtggagggcgtgtccggcgggagctgggtcgacatcgtgctggagcacggctcctgcgtgaccacgatggccaagaacaagcccaccctcgacttcgagctgatcaagaccgaggccaagcagcccgccaccctgcggaagtactgcatcgaggccaagctcacgaacaccaccaccgacagccgctgcccgacgcagggggagccctccctgaacgaggagcaggacaagcggttcgtctgcaagcacagcatggtggaccgcggctggggcaacgggtgcggcctgttcgggaagggcgggatcgtgacctgcgcgatgttcacgtgcaagaagaacatggagggcaaggtcgtgcagcccgagaacctcgagtacaccatcgtgatcacgccccactccggcgaggagcacgccgtcgggaacgacaccggcaagcacgggaaggagatcaagatcaccccgcagagctccatcaccgaggccgagctgaccggctacgggacggtgaccatggagtgcagcccccggaccggcctggacttcaacgagatggtgctcctgcagatggagaacaaggcctggctggtccaccgccagtggttcctcgacctgcccctgccctggctcccgggcgccgacacccaggggctgaactggatccagaaggagacgctggtgaccttcaagaacccccacgcgaagaagcaggacgtggtcgtgctcggctcccaggagggggccatgcacaccgccctgaccggcgccacggagatccagatgagcagcgggaacctcctgttcaccggccacctgaagtgccggctgcgcatggacaagctccagctgaagggcatgtcctacagcatgtgcaccgggaagttcaaggtcgtgaaggagatcgccgagacccagcacggcacgatcgtgatccgggtccagtacgagggggacggctccccctgcaagatccccttcgagatcatggacctggagaagcgccacgtgctcggccggctgatcaccgtgaacccgatcgtcaccgagaaggacagccccgtgaacatcgaggcggagccgcccttcggggactcctacatcatcatcggcgtggagccggggcagctgaagctcaactggttcaagaagggcagctccatcgggcagatgatcgagaccacgatgcgcggcgccaagcgcatggccatcctgggcgacaccgcctgggacttcgggagcctgggcggggtcttcacctccatcggcaaggccctccaccaggtgttcggggcgatctacggcgccgccttcagcggcgtgtcctggatcatgaagatcctgatcggggtcatcatcacctggatcggcatgaacagccggtccacgagcctgtccgtgagcctggtgctcgtcggggtggtgaccctgtacctgggcgtcatggtgcaggccgactccgggtgcgtggtcagctggaagaacaaggagctcaagtgcggctccggcatcttcatcaccgacaacgtgcacacctggacggagcagtacaagttccagcccgagagccccagcaagctggcgtccgccatccagaaggcccacgaggaggggatctgcggcatccgcagcgtgacccggctggagaacctcatgtggaagcagatcacccccgagctgaaccacatcctgtccgagaacgaggtcaagctcaccatcatgacgggggacatcaagggcatcatgcaggccgggaagcgcagcctgcagccgcagcccaccgagctgaagtactcctggaagacctggggcaaggccaagatgctcagcaccgagtcccacaaccagacgttcctgatcgacggccccgagaccgcggagtgcccgaacaccaaccgggcctggaacagcctggaggtggaggactacgggttcggcgtgttcaccacgaacatctggctcaagctgcgcgagaagcaggacgtcttctgcgactccaagctgatgagcgccgccatcaaggacaaccgggccgtgcacgcggacatggggtactggatcgagtccgccctcaacgacacctggaagatcgagaaggccagcttcatcgaggtgaagtcctgccactggcccaagagccacaccctgtggtccaacggcgtcctggagagcgagatgatcatccccaagaacttcgccggccccgtgtcccagcacaactaccgcccggggtaccacacccagaccgccggcccctggcacctcgggaagctggagatggacttcgacttctgcgagggcacgaccgtggtcgtgaccgaggactgcgggaaccggggccccagcctgcgcaccacgaccgcgagcggcaagctcatcaccgagtggtgctgccggtcctgcaccctgcccccgctgcgctaccgcggggaggacggctgctggtacgggatggagatccgccccctcaaggagaaggaggagaacctggtgaacagcctggtcacggccggccacgggcagatcgacaacttctccctcggcgtgctgggcatggccctgttcctcgaggagatgctgcggacccgcgtggggaccaagcacgccatcctgctcgtcgcggtgagcttcgtgaccctgatcacgggcaacatgtccttccgggacctggggcgcgtcatggtgatggtgggcgccaccatgaccgacgacatcgggatgggcgtcacctacctcgccctgctggccgccttcaaggtgcggcccacgttcgcggccggcctcctgctgcgcaagctcaccagcaaggagctgatgatgaccaccatcgggatcgtgctgctctcccagagcacgatccccgagaccatcctggagctgaccgacgccctcgccctgggcatgatggtcctgaagatggtgcgcaagatggagaagtaccagctcgccgtgaccatcatggcgatcctgtgcgtcccgaacgccgtgatcctgcagaacgcctggaaggtctcctgcacgatcctcgccgtggtgagcgtcagccccctgttcctgaccagctcccagcagaaggccgactggatccccctcgcgctgaccatcaaggggctgaaccccaccgccatcttcctcacgaccctgagccggaccaacaagaagcgctcctggccgctgaacgaggccatcatggccgtgggcatggtgagcatcctcgcgtccagcctgctgaagaacgacatccccatgaccggccccctcgtcgccgggggcctgctgacggtgtgctacgtgctcaccgggcggtccgccgacctggagctggagcgcgccgccgacgtcaagtgggaggaccaggcggagatcagcggcagctcccccatcctcagcatcaccatctccgaggacgggagcatgtccatcaagaacgaggaggaggagcagaccctgacgatcctgatccggaccggcctcctggtgatcagcggcctgttcccggtgtccatccccatcaccgccgccgcctggtacctctgggaggtcaagaagcagcgcgccggggtgctgtgggacgtgccctccccgccgcccgtcggcaaggcggagctggaggacggggcctaccggatcaagcagaagggcatcctcgggtactcccagatcggcgccggcgtgtacaaggaggggaccttccacaccatgtggcacgtgacgcgcggcgccgtcctgatgcacaaggggaagcggatcgagcccagctgggccgacgtgaagaaggacctgatctcctacggcgggggctggaagctcgagggcgagtggaaggagggggaggaggtgcaggtcctggcgctggagcccggcaagaacccccgcgccgtgcagaccaagcccggcctgttcaagaccaacgccggcaccatcggggccgtgagcctggacttctcccccggcacgagcggctcccccatcatcgacaagaaggggaaggtcgtgggcctgtacgggaacggcgtggtcacccggagcggcgcctacgtgtccgcgatcgcccagaccgagaagtccatcgaggacaaccccgagatcgaggacgacatcttccgcaagcggaagctcaccatcatggacctgcaccccggggccggcaagacgaagcgctacctgcccgccatcgtgcgggaggcgatcaagcgcgggctgcggaccctcatcctggccccgacccgcgtcgtggccgccgagatggaggaggccctgcggggcctccccatccgctaccagacccccgcgatccgggccgagcacacggggcgcgagatcgtggacctgatgtgccacgccaccttcaccatgcgcctgctctcccccgtccgggtgccgaactacaacctgatcatcatggacgaggcccacttcaccgaccccgccagcatcgcggcccgcggctacatcagcacgcgggtggagatgggcgaggccgccgggatcttcatgaccgccacgccgcccggctcccgcgacccgttcccccagagcaacgcgcccatcatggacgaggagcgggagatccccgagcgctcctggagctccgggcacgagtgggtcaccgacttcaagggcaagacggtgtggttcgtgccgagcatcaaggccgggaacgacatcgccgcctgcctgcggaagaacggcaagaaggtcatccagctctcccgcaagaccttcgacagcgagtacgtgaagacccggaccaacgactgggacttcgtggtcacgaccgacatctccgagatgggcgcgaacttcaaggccgagcgcgtgatcgacccccggcgctgcatgaagcccgtgatcctgaccgacggggaggagcgggtcatcctggccggccccatgccggtgacccacagctccgccgcccagcgccgggggcgcatcggccggaaccccaagaacgagaacgaccagtacatctacatgggggagcccctcgagaacgacgaggactgcgcgcactggaaggaggccaagatgctgctggacaacatcaacacgcccgagggcatcatcccgagcatgttcgagcccgagcgcgagaaggtggacgccatcgacggcgagtaccggctccgcggggaggcccgcaagaccttcgtcgacctgatgcggcgcggcgacctgcccgtgtggctcgcctaccgggtggcggccgaggggatcaactacgccgaccgccggtggtgcttcgacggcatcaagaacaaccagatcctggaggagaacgtcgaggtggagatctggaccaaggagggggagcgcaagaagctgaagccgcggtggctcgacgcccgcatctactccgaccccctggccctgaaggagttcaaggagttcgcggccggccgcaagagcctcaccctgaacctgatcacggagatgggccgcctccccaccttcatgacccagaaggcccgggacgccctggacaacctggcggtcctccacaccgccgaggccgggggccgcgcctacaaccacgccctgtccgagctgcccgagacgctcgagaccctgctgctcctgaccctgctcgcgaccgtgaccggcgggatcttcctgttcctgatgagcgggcgggggatcggcaagatgaccctcgggatgtgctgcatcatcaccgcctccatcctgctgtggtacgcccagatccagccgcactggatcgccgccagcatcatcctcgagttcttcctgatcgtgctgctcatccccgagcccgagaagcagcgcacgccccaggacaaccagctgacctacgtcgtgatcgcgatcctgacggtggtcgccgccaccatggccaacgagatgggcttcctcgagaagaccaagaaggacctggggctgggctccatcaccacgcagcagccggagagcaacatcctcgacatcgacctgcggcccgccagcgcgtggaccctgtacgccgtggccaccaccttcgtgacgcccatgctccgccactccatcgagaacagctccgtcaacgtgagcctgaccgccatcgccaaccaggcgaccgtgctgatgggcctcgggaagggctggcccctgtccaagatggacatcggggtcccgctgctcgccatcggctgctacagccaggtgaaccccatcaccctgacggccgccctgttcctcctggtggcgcactacgccatcatcgggcccggcctgcaggccaaggccacccgggaggcccagaagcgcgcggccgccggcatcatgaagaaccccaccgtcgacgggatcaccgtgatcgacctcgacccgatcccctacgaccccaagttcgagaagcagctgggccaggtgatgctgctcgtcctgtgcgtgacccaggtgctgatgatgcggaccacctgggccctctgcgaggccctgaccctggcgacggggcccatctccaccctctgggagggcaacccggggcgcttctggaacaccaccatcgccgtcagcatggccaacatcttccggggctcctacctggccggcgccgggctcctcttcagcatcatgaagaacacgaccaacacccgccgcggcaccgggaacatcggcgagacgctgggcgagaagtggaagtcccggctgaacgcgctcggcaagagcgagttccagatctacaagaagtccggcatccaggaggtggaccgcaccctggccaaggaggggatcaagcggggcgagaccgaccaccacgccgtgagccgcgggtccgccaagctgcggtggttcgtcgagcgcaacatggtgacccccgagggcaaggtggtcgacctcggctgcgggcggggcgggtggagctactactgcggcgggctgaagaacgtgcgcgaggtgaagggcctgacgaagggcgggcccggccacgaggagcccatcccgatgtccacctacgggtggaacctcgtccggctgcagagcggcgtggacgtgttcttcacgccgcccgagaagtgcgacaccctgctctgcgacatcggggagtccagccccaacccgacggtcgaggcgggccgcaccctgcgggtgctgaacctcgtggagaactggctgaacaacaacacccagttctgcatcaaggtcctgaacccctacatgcccagcgtgatcgagaagatggaggccctccagcgcaagtacggcggggccctggtgcggaacccgctgtcccgcaacagcacccacgagatgtactgggtctccaacgccagcggcaacatcgtgtccagcgtgaacatgatctcccggatgctgatcaaccgcttcaccatgcggcacaagaaggccacgtacgagcccgacgtcgacctcgggagcggcacccgcaacatcgggatcgagtccgagatccccaacctggacatcatcggcaagcggatcgagaagatcaagcaggagcacgagaccagctggcactacgaccaggaccacccctacaagacctgggcgtaccacggctcctacgagacgaagcagaccgggagcgcctccagcatggtgaacggcgtggtccgcctgctcaccaagccgtgggacgtggtgcccatggtcacccagatggccatgacggacaccacccccttcgggcagcagcgcgtgttcaaggagaaggtggacacccggacgcaggagcccaaggagggcaccaagaagctgatgaagatcaccgccgagtggctgtggaaggagctcggcaagaagaagaccccgcgcatgtgcacgcggcaggagttcacccgcaaggtccggtccaacgccgcgctgggggccatcttcaccgacgagaacaagtggaagtccgcccgcgaggccgtggaggactcccggttctgggagctggtcgacaaggagcgcaacctccacctggagggcaagtgcgagacctgcgtgtacaacatgatggggaagcgggagaagaagctgggcgagttcgggaaggccaagggcagccgcgcgatctggtacatgtggctcggcgcccggttcctggagttcgaggccctggggttcctcaacgaggaccactggttctcccgcgagaacagcctgagcggcgtggagggggagggcctgcacaagctcgggtacatcctgcgggacgtctccaagaaggagggcggcgccatgtacgcggacgacacggccgggtgggacacccgcatcaccctggaggacctcaagaacgaggagatggtgaccaaccacatggagggcgagcacaagaagctggccgaggccatcttcaagctgacgtaccagaacaaggtggtccgggtgcagcgccccacgccccgggggaccgtgatggacatcatcagccgccgggaccagcgcggctccgggcaggtcggcacctacggcctcaacacgttcaccaacatggaggcccagctgatccggcagatggagggggagggcgtgttcaagagcatccagcacctgaccgtgaccgaggagatcgcggtccagaactggctcgcccgcgtggggcgcgagcggctgtcccgcatggccatcagcggcgacgactgcgtggtcaagcccctggacgaccggttcgcctccgccctcacggcgctgaacgacatgggcaaggtgcgcaaggacatccagcagtgggagccgagccgggggtggaacgactggacccaggtgcccttctgctcccaccacttccacgagctgatcatgaaggacggccgcgtcctcgtggtgccctgccggaaccaggacgagctgatcgggcgcgcccggatcagccagggcgccgggtggtccctgcgcgagaccgcctgcctcggcaagagctacgcccagatgtggtccctgatgtacttccaccggcgcgacctgcggctcgcggccaacgccatctgcagcgccgtcccctcccactgggtgccgaccagccgcacgacctggtccatccacgccaagcacgagtggatgaccaccgaggacatgctgaccgtgtggaaccgggtctggatccaggagaacccctggatggaggacaagacgcccgtggagagctgggaggagatcccctacctgggcaagcgcgaggaccagtggtgcgggagcctcatcggcctgacctcccgggcgacctgggccaagaacatccagaccgccatcaaccaggtgcgcagcctgatcgggaacgaggagtacacggactacatgccgtccatgaagcggttccgccgcgaggaggaggaggccggcgtcctctggtga

SEQ ID NO: 9133 - RNA, 9876 nt, synthetic construct
  misc_feature 1..9876: note = derived and/or modified CDS sequence (opt1) from DENV-2__FJ906968__SS-prME
  source 1..9876: mol_type = other RNA
accgccggcatgatcatcatgctgatccccaccgtgatggccttccacctcaccacccggaacggggagccccacatgatcgtcagccggcaggagaagggcaagtccctgctgttcaagaccgaggacggggtgaacatgtgcaccctcatggcgatggacctgggcgagctgtgcgaggacaccatcacctacaagtgccccttcctcaagcagaacgagcccgaggacatcgactgctggtgcaacagcacctccacctgggtgacctacgggacctgcaccaccacgggcgagcaccgccgggagaagcggagcgtcgccctggtgccccacgtgggcatggggctggagacccggaccgagacctggatgtccagcgagggcgcctggaagcacgcccagcgcatcgagacgtggatcctccggcacccggggttcaccatcatggccgcgatcctggcctacaccatcggcaccacgcacttccagcgcgccctgatcttcatcctcctgaccgccgtcgcgccctccatgaccatgcggtgcatcgggatcagcaaccgcgacttcgtggagggcgtgtccggcgggagctgggtcgacatcgtgctggagcacggctcctgcgtgaccacgatggccaagaacaagcccaccctcgacttcgagctgatcaagaccgaggccaagcagcccgccaccctgcggaagtactgcatcgaggccaagctcacgaacaccaccaccgacagccgctgcccgacgcagggggagccctccctgaacgaggagcaggacaagcggttcgtctgcaagcacagcatggtggaccgcggctggggcaacgggtgcggcctgttcgggaagggcgggatcgtgacctgcgcgatgttcacgtgcaagaagaacatgaagggcaaggtcgtgcagcccgagaacctcgagtacaccatcgtgatcacgccccactccggcgaggagcacgccgtcgggaacgacaccggcaagcacgggaaggagatcaagatcaccccgcagagctccatcaccgaggccgagctgaccggctacgggacggtgaccatggagtgcagcccccggaccggcctggacttcaacgagatggtgctcctgcagatggagaacaaggcctggctggtccaccgccagtggttcctcgacctgcccctgccctggctcccgggcgccgacacccaggggtccaactggatccagaaggagacgctggtgaccttcaagaacccccacgcgaagaagcaggacgtggtcgtgctgggcagccaggagggggccatgcacaccgccctcaccggcgccacggagatccagatgagctccgggaacctgctgttcaccggccacctcaagtgccggctgcgcatggacaagctgcagctcaagggcatgagctactccatgtgcaccgggaagttcaaggtcgtgaaggagatcgccgagacccagcacggcacgatcgtgatccgggtccagtacgagggggacggcagcccctgcaagatccccttcgagatcatggacctggagaagcgccacgtgctgggccggctcatcaccgtgaacccgatcgtcaccgagaaggactcccccgtgaacatcgaggcggagccgcccttcggggacagctacatcatcatcggcgtggagccggggcagctgaagctgaactggttcaagaagggctccagcatcgggcagatgatcgagaccacgatgcgcggcgccaagcgcatggccatcctcggcgacaccgcctgggacttcgggtccctgggcggggtcttcaccagcatcggcaaggccctgcaccaggtgttcggggcgatctacggcgccgccttctccggcgtgagctggatcatgaagatcctcatcggggtcatcatcacctggatcggcatgaactcccggagcacgtccctgagcgtgtccctggtgctggtcggggtggtgaccctctacctgggcgtcatggtgcaggccgacagcgggtgcgtggtctcctggaagaacaaggagctgaagtgcggcagcggcatcttcatcaccgacaacgtgcacacctggacggagcagtacaagttccagcccgagagcccctccaagctcgcgagcgccatccagaaggcccacgaggaggggatctgcggcatccgctccgtgacccggctggagaacctgatgtggaagcagatcacccccgagctcaaccacatcctgagcgagaacgaggtcaagctgaccatcatgacgggggacatcaagggcatcatgcaggccgggaagcgctccctccagccgcagcccaccgagctgaagtacagctggaagacctggggcaaggccaagatgctgtccaccgagagccacaaccagacgttcctcatcgacggccccgagaccgcggagtgcccgaacaccaaccgggcctggaactccctggaggtggaggactacgggttcggcgtgttcaccacgaacatctggctgaagctccgcgagaagcaggacgtcttctgcgacagcaagctgatgtccgccgccatcaaggacaaccgggccgtgcacgcggacatggggtactggatcgagagcgccctgaacgacacctggaagatcgagaaggcctccttcatcgaggtcaagagctgccactggcccaagtcccacaccctctggagcaacgaggtgctggagtccgagatgatcatccccaagaacttcgccggccccgtgagccagcacaactaccgcccgggctaccacacccagaccgccgggccctggcacctgggcaagctcgagatggacttcgacttctgcgaggggacgaccgtggtcgtgaccgaggactgcggcaaccgggggcccagcctgcgcaccacgaccgcgtccggcaagctgatcaccgagtggtgctgccggagctgcaccctcccgcccctgcgctaccggggcgaggacgggtgctggtacggcatggagatccgccccctgaaggagaaggaggagaacctcgtgaactccctggtcacggccgggcacggccagatcgacaacttcagcctgggggtgctcggcatggccctgttcctggaggagatgctccggacccgcgtgggcaccaagcacgccatcctgctggtcgcggtgtccttcgtgaccctcatcacggggaacatgagcttccgggacctgggccgcgtcatggtgatggtgggggccaccatgaccgacgacatcggcatgggggtcacctacctggccctcctggccgccttcaaggtgcggcccacgttcgcggccggcctgctcctgcgcaagctgacctccaaggagctcatgatgaccaccatcggcatcgtgctgctgagccagtccacgatccccgagaccatcctcgagctgaccgacgccctggccctcgggatgatggtcctgaagatggtgcgcaagatggagaagtaccagctggccgtgaccatcatggcgatcctctgcgtccccaacgccgtgatcctgcagaacgcctggaaggtcagctgcacgatcctggccgtggtgtccgtcagccccctcttcctgacctccagccagcagaaggccgactggatccccctggcgctcaccatcaagggcctgaaccccaccgccatcttcctgacgaccctctcccggaccaacaagaagcgcagctggccgctgaacgaggccatcatggccgtggggatggtgtccatcctggcgagctccctcctgaagaacgacatccccatgaccggccccctggtcgccggcgggctcctgacggtgtgctacgtgctgaccggccggagcgccgacctcgagctggagcgcgccgccgacgtcaagtgggaggaccaggcggagatcagcgggtccagccccatcctgtccatcaccatcagcgaggacggctccatgagcatcaagaacgaggaggaggagcagatcctcaccatcctgatccggacggggctgctcgtgatctccggcctgttcccggtgagcatccccatcaccgccgccgcctggtgcctgtgggaggtcaagaagcagcgcgccggcgtgctctgggacgtgcccagcccgccgcccgtcgggaaggcggagctggaggacggcgcctaccggatcaagcagaaggggatcctgggctacagccagatcggggccggcgtgtacaaggagggcaccttccacaccatgtggcacgtgacccgcggggccgtcctcatgcacaagggcaagcggatcgagccctcctgggccgacgtgaagaaggacctgatcagctacgggggcgggtggaagctggagggcgagtggaaggagggcgaggaggtgcaggtcctcgcgctggagcccgggaagaacccccgcgccgtgcagacgaagcccggcctgttcaagaccaacgccgggaccatcggcgccgtgtccctcgacttcagccccgggacctccggcagccccatcatcgacaagaagggcaaggtcgtggggctgtacggcaacggggtggtcacgcggtccggcgcctacgtgagcgcgatcgcccagaccgagaagtccatcgaggacaaccccgagatcgaggacgacatcttccgcaagcggaagctgaccatcatggacctccaccccggcgccgggaagaccaagcgctacctgcccgccatcgtgcgggaggcgatcaagcgcggcctgcggacgctgatcctcgccccgacccgcgtcgtggccgccgagatggaggaggccctgcgggggctgcccatccgctaccagacccccgcgatccgggccgagcacaccggccgcgagatcgtggacctcatgtgccacgccacgttcaccatgcgcctgctgagccccgtccgggtgccgaactacaacctcatcatcatggacgaggcccacttcaccgaccccgccagcatcgcggcccgcgggtacatctccacccgggtggagatgggcgaggccgccggcatcttcatgacggccacgccgcccgggagccgcgacccgttcccccagtccaacgcgcccatcatggacgaggagcgggagatccccgagcgcagctggtccagcggccacgagtgggtcaccgacttcaaggggaagaccgtgtggttcgtgccgtccatcaaggccggcaacgacatcgccgcctgcctgcggaagaacgggaagaaggtcatccagctgagccgcaagacgttcgactccgagtacgtgaagacccggaccaacgactgggacttcgtggtcaccacggacatcagcgagatgggcgcgaacttcaaggccgagcgcgtgatcgacccccggcgctgcatgaagcccgtgatcctcaccgacggcgaggagcgggtcatcctggccgggcccatgccggtgacccactccagcgccgcccagcgccggggccgcatcgggcggaaccccaagaacgagaacgaccagtacatctacatgggcgagcccctggagaacgacgaggactgcgcgcactggaaggaggccaagatgctcctggacaacatcaacacccccgaggggatcatcccgtccatgttcgagcccgagcgcgagaaggtggacgccatcgacggcgagtaccggctgcgcggcgaggcccgcaagacgttcgtcgacctcatgcggcgcggggacctgcccgtgtggctggcctaccgggtggcggccgagggcatcaactacgccgaccgccggtggtgcttcgacgggatcaagaacaaccagatcctcgaggagaacgtcgaggtggagatctggaccaaggagggcgagcgcaagaagctgaagccgcggtggctggacgcccgcatctacagcgaccccctcgccctgaaggagttcaaggagttcgcggccgggcggaagtccctgaccctcaacctgatcaccgagatgggccgcctgcccacgttcatgacccagaaggcccgggacgccctcgacaacctggcggtcctgcacaccgccgaggccggcgggcgcgcctacaaccacgccctcagcgagctgcccgagaccctggagacgctcctgctgctcaccctgctggcgaccgtgaccggcgggatcttcctcttcctgatgtccggccggggcatcgggaagatgacgctgggcatgtgctgcatcatcaccgccagcatcctcctgtggtacgcccagatccagccgcactggatcgccgcctccatcatcctggagttcttcctcatcgtgctgctgatccccgagcccgagaagcagcgcacgccccaggacaaccagctcacctacgtcgtgatcgcgatcctgaccgtggtcgccgccacgatggccaacgagatggggttcctggagaagaccaagaaggacctcggcctggggagcatcaccacccagcagccggagagcaacatcctggacatcgacctccggcccgcctccgcgtggacgctgtacgccgtggccaccaccttcgtgacccccatgctgcgccacagcatcgagaactccagcgtcaacgtgtccctcacggccatcgccaaccaggcgaccgtgctgatgggcctgggcaaggggtggcccctcagcaagatggacatcggcgtcccgctgctggccatcgggtgctactcccaggtgaaccccatcaccctcaccgccgccctgttcctgctcgtggcgcactacgccatcatcggccccgggctgcaggccaaggccacgcgggaggcccagaagcgcgcggccgccggcatcatgaagaaccccaccgtcgacggcatcaccgtgatcgacctggacccgatcccctacgaccccaagttcgagaagcagctcggccaggtgatgctgctggtcctctgcgtgacccaggtgctgatgatgcggacgacctgggccctgtgcgaggccctcaccctggcgaccggccccatcagcacgctgtgggaggggaacccgggccgcttctggaacaccaccatcgccgtctccatggccaacatcttccgggggagctacctcgccggcgccggcctgctgttctccatcatgaagaacaccacgaacacccgccgcgggaccggcaacatcggggagaccctcggcgagaagtggaagtcccggctgaacgcgctgggcaagagcgagttccagatctacaagaagtccgggatccaggaggtggaccgcacgctcgccaaggagggcatcaagcgcggggagaccgaccaccacgccgtgtcccgcggcagcgccaagctgcggtggttcgtcgagcgcaacatggtgacccccgaggggaaggtggtcgacctgggctgcggccgcggcgggtggtcctactactgcggcgggctcaagaacgtgcgcgaggtgaaggggctgaccaagggcgggcccgggcacgaggagcccatcccgatgagcacgtacggctggaacctggtccggctccagtccggggtggacgtgttcttcacgccgcccgagaagtgcgacaccctgctgtgcgacatcggcgagagcagccccaacccgaccgtcgaggcggggcgcacgctccgggtgctgaacctggtggagaactggctcaacaacaacacccagttctgcatcaaggtcctgaacccctacatgccctccgtgatcgagaagatggaggccctgcagcgcaagtacggcggcgccctcgtgcggaacccgctgagccgcaactccacccacgagatgtactgggtcagcaacgcctccgggaacatcgtgagctccgtgaacatgatcagccggatgctgatcaaccgcttcaccatgcggcacaagaaggccacctacgagcccgacgtcgacctgggctccgggacgcgcaacatcggcatcgagagcgagatccccaacctcgacatcatcgggaagcggatcgagaagatcaagcaggagcacgagacctcctggcactacgaccaggaccacccctacaagacctgggcgtaccacggcagctacgagaccaagcagacgggctccgccagctccatggtgaacggggtggtccgcctgctgaccaagccgtgggacgtggtgcccatggtcacccagatggccatgaccgacacgacccccttcggccagcagcgcgtgttcaaggagaaggtggacacccggacccaggagcccaaggaggggacgaagaagctcatgaagatcaccgccgagtggctgtggaaggagctgggcaagaagaagaccccgcgcatgtgcacccgggaggagttcacgcgcaaggtccggagcaacgccgcgctcggcgccatcttcaccgacgagaacaagtggaagtccgcccgcgaggccgtggaggacagccggttctgggagctggtcgacaaggagcgcaacctgcacctcgaggggaagtgcgagacctgcgtgtacaacatgatgggcaagcgggagaagaagctgggggagttcggcaaggccaaggggtcccgcgcgatctggtacatgtggctgggcgcccggttcctcgagttcgaggccctgggcttcctgaacgaggaccactggttcagccgcgagaacagcctctccggggtggagggcgaggggctgcacaagctgggctacatcctccgggacgtcagcaagaaggagggcggggccatgtacgcggacgacaccgccggctgggacacgcgcatcaccctggaggacctgaagaacgaggagatggtgaccaaccacatggagggggagcacaagaagctcgccgaggccatcttcaagctgacctaccagaacaaggtggtccgggtgcagcgccccacgccccggggcaccgtgatggacatcatctcccgccgggaccagcgcgggagcggccaggtcgggacctacggcctgaacaccttcacgaacatggaggcccagctcatccggcagatggagggcgagggggtgttcaagtccatccagcacctgaccgtgaccgaggagatcgcggtccagaactggctggcccgcgtgggccgcgagcggctcagccgcatggccatctccggggacgactgcgtggtcaagcccctggacgaccggttcgccagcgccctgaccgcgctcaacgacatgggcaaggtgcgcaaggacatccagcagtgggagccgtcccggggctggaacgactggacccaggtgcccttctgcagccaccacttccacgagctgatcatgaaggacgggcgcgtcctggtggtgccctgccggaaccaggacgagctcatcggccgcgcccggatctcccagggggccggctggagcctgcgcgagaccgcctgcctggggaagtcctacgcccagatgtggagcctcatgtacttccaccggcgcgacctgcggctggcggccaacgccatctgctccgccgtccccagccactgggtgccgacctcccgcaccacgtggagcatccacgccaagcacgagtggatgaccaccgaggacatgctcaccgtgtggaaccgggtctggatccaggagaacccctggatggaggacaagacccccgtggagagctgggaggagatcccctacctgggcaagcgcgaggaccagtggtgcggctccctgatcgggctcacgagccgggcgacctgggccaagaacatccagaccgccatcaaccaggtgcgctccctgatcggcaacgaggagtacaccgactacatgccgagcatgaagcggttccgccgcgaggaggaggaggccggggtcctgtggtga

SEQ ID NO: 9134 - RNA, 9876 nt, synthetic construct
  misc_feature 1..9876: note = derived and/or modified CDS sequence (opt1) from DENV-2__FJ906969__SS-prME
  source 1..9876: mol_type = other RNA
accgccggcatgatcatcatgctgatccccaccgtgatggccttccacctcaccacccggaacggggagccccacatgatcgtcagccggcaggagaagggcaagtccctgctgttcaagaccgaggacggggtgaacatgtgcaccctcatggcgatggacctgggcgagctgtgcgaggacaccatcacctacaagtgccccttcctcaagcagaacgagcccgaggacatcgactgctggtgcaacagcacctccacctgggtgacctacgggacctgcaccaccacgggcgagcaccgccgggagaagcgcagcgtcgccctggtgccccacgtgggcatggggctggagacccggaccgagacctggatgtccagcgagggcgcctggaagcacgcccagcgcatcgagacgtggatcctccggcacccggggttcaccatcatggccgcgatcctggcctacaccatcggcaccacgcacttccagcgcgccctgatcttcatcctcctgaccgccgtcgcgccctccatgaccatgcggtgcatcgggatcagcaaccgcgacttcgtggagggcgtgtccggcgggagctgggtcgacatcgtgctggagcacggctcctgcgtgaccacgatggccaagaacaagcccaccctcgacttcgagctgatcaagaccgaggccaagcagcccgccaccctgcggaagtactgcatcgaggccaagctcacgaacaccaccaccgacagccgctgcccgacgcagggggagccctccctgaacgaggagcaggacaagcggttcgtctgcaagcacagcatggtggaccgcggctggggcaacgggtgcggcctgttcgggaagggcgggatcgtgacctgcgcgatgttcacgtgcaagaagaacatgaagggcaaggtcgtgcagcccgagaacctcgagtacaccatcgtgatcacgccccactccggcgaggagcacgccgtcgggaacgacaccggcaagcacgggaaggagatcaagatcaccccgcagagctccatcaccgaggccgagctgaccggctacgggacggtgaccatggagtgcagcccccggaccggcctggacttcaacgagatggtgctcctgcagatggagaacaaggcctggctggtccaccgccagtggttcctcgacctgcccctgccctggctcccgggcgccgacacccaggggtccaactggatccagaaggagacgctggtgaccttcaagaacccccacgcgaagaagcaggacgtggtcgtgctgggcagccaggagggggccatgcacaccgccctcaccggcgccacggagatccagatgagctccgggaacctgctgttcaccggccacctcaagtgccggctgcgcatggacaagctgcagctcaagggcatgagctactccatgtgcaccgggaagttcaaggtcgtgaaggagatcgccgagacccagcacggcacgatcgtgatccgggtccagtacgagggggacggcagcccctgcaagatccccttcgagatcatggacctggagaagcgccacgtgctgggccggctcatcaccgtgaacccgatcgtcaccgagaaggactcccccgtgaacatcgaggcggagccgcccttcggggacagctacatcatcatcggcgtggagccggggcagctgaagctgaactggttcaagaagggctccagcatcgggcagatgttcgagaccacgatgcgcggcgccaagcgcatggccatcctcggcgacaccgcctgggacttcgggtccctgggcggggtcttcaccagcatcggcaaggccctgcaccaggtgttcggggcgatctacggcgccgccttctccggcgtgagctggatcatgaagatcctcatcggggtcatcatcacctggatcggcatgaactcccggagcacgtccctgagcgtgtccctggtgctggtcggggtggtgaccctctacctgggcgtcatggtgcaggccgacagcgggtgcgtggtctcctggaagaacaaggagctgaagtgcggcagcggcatcttcatcaccgacaacgtgcacacctggacggagcagtacaagttccagcccgagagcccctccaagctcgcgagcgccatccagaaggcccacgaggaggggatctgcggcatccgctccgtgacccggctggagaacctgatgtggaagcagatcacccccgagctcaaccacatcctgagcgagaacgaggtcaagctgaccatcatgacgggggacatcaagggcatcatgcaggccgggaagcgctccctccagccgcagcccaccgagctgaagtacagctggaagacctggggcaaggccaagatgctgtccaccgagagccacaaccagacgttcctcatcgacggccccgagaccgcggagtgcccgaacaccaaccgggcctggaactccctggaggtggaggactacgggttcggcgtgttcaccacgaacatctggctgaagctccgcgagaagcaggacgtcttctgcgacagcaagctgatgtccgccgccatcaaggacaaccgggccgtgcacgcggacatggggtactggatcgagagcgccctgaacgacacctggaagatcgagaaggcctccttcatcgaggtcaagagctgccactggcccaagtcccacaccctctggagcaacggcgtgctggagtccgagatgatcatccccaagaacttcgccggccccgtgagccagcacaactaccgcccggggtaccacacccagaccgccggcccctggcacctggggaagctcgagatggacttcgacttctgcgagggcacgaccgtggtcgtgaccgaggactgcgggaaccggggccccagcctgcgcaccacgaccgcgtccggcaagctgatcaccgagtggtgctgccggagctgcaccctcccgcccctgcgctaccgcggggaggacggctgctggtacgggatggagatccgccccctgaaggagaaggaggagaacctcgtgaactccctggtcacggccggccacgggcagatcgacaacttcagcctgggcgtgctcggcatggccctgttcctggaggagatgctccggacccgcgtggggaccaagcacgccatcctgctggtcgcggtgtccttcgtgaccctcatcacgggcaacatgagcttccgggacctggggcgcgtcatggtgatggtgggcgccaccatgaccgacgacatcgggatgggcgtcacctacctggccctcctggccgccttcaaggtgcggcccacgttcgcggccggcctgctcctgcgcaagctgacctccaaggagctcatgatgaccaccatcgggatcgtgctgctgagccagtccacgatccccgagaccatcctcgagctgaccgacgccctggccctcggcatgatggtcctgaagatggtgcgcaagatggagaagtaccagctggccgtgaccatcatggcgatcctctgcgtccccaacgccgtgatcctgcagaacgcctggaaggtcagctgcacgatcctggccgtggtgtccgtcagccccctcttcctgacctccagccagcagaaggccgactggatccccctggcgctcaccatcaaggggctgaaccccaccgccatcttcctgacgaccctctcccggaccaacaagaagcgcagctggccgctgaacgaggccatcatggccgtgggcatggtgtccatcctggcgagctccctcctgaagaacgacatccccatgaccggccccctggtcgccgggggcctcctgacggtgtgctacgtgctgaccgggcggagcgccgacctcgagctggagcgcgccgccgacgtcaagtgggaggaccaggcggagatcagcggctccagccccatcctgtccatcaccatcagcgaggacgggtccatgagcatcaagaacgaggaggaggagcagatcctcaccatcctgatccggacgggcctgctcgtgatctccggcctgttcccggtgagcatccccatcaccgccgccgcctggtgcctgtgggaggtcaagaagcagcgcgccggggtgctctgggacgtgcccagcccgccgcccgtcggcaaggcggagctggaggacggggcctaccggatcaagcagaagggcatcctggggtacagccagatcggcgccggcgtgtacaaggaggggaccttccacaccatgtggcacgtgacccgcggcgccgtcctcatgcacaaggggaagcggatcgagccctcctgggccgacgtgaagaaggacctgatcagctacggcgggggctggaagctggagggcgagtggaaggagggggaggaggtgcaggtcctcgcgctggagcccggcaagaacccccgcgccgtgcagacgaagcccgggctgttcaagaccaacgccggcaccatcggggccgtgtccctcgacttcagccccggcacctccggcagccccatcatcgacaagaaggggaaggtcgtgggcctgtacgggaacggcgtggtcacgcggtccggcgcctacgtgagcgcgatcgcccagaccgagaagtccatcgaggacaaccccgagatcgaggacgacatcttccgcaagcggaagctgaccatcatggacctccaccccggggccggcaagaccaagcgctacctgcccgccatcgtgcgggaggcgatcaagcgcgggctgcggacgctgatcctcgccccgacccgcgtcgtggccgccgagatggaggaggccctgcggggcctgcccatccgctaccagacccccgcgatccgggccgagcacaccgggcgcgagatcgtggacctcatgtgccacgccacgttcaccatgcgcctgctgagccccgtccgggtgccgaactacaacctcatcatcatggacgaggcccacttcaccgaccccgccagcatcgcggcccgcggctacatctccacccgggtggagatgggcgaggccgccgggatcttcatgacggccacgccgcccggcagccgcgacccgttcccccagtccaacgcgcccatcatggacgaggagcgggagatccccgagcgcagctggtccagcgggcacgagtgggtcaccgacttcaagggcaagaccgtgtggttcgtgccgtccatcaaggccgggaacgacatcgccgcctgcctgcggaagaacggcaagaaggtcatccagctgagccgcaagacgttcgactccgagtacgtgaagacccggaccaacgactgggacttcgtggtcaccacggacatcagcgagatgggcgcgaacttcaaggccgagcgcgtgatcgacccccggcgctgcatgaagcccgtgatcctcaccgacggggaggagcgggtcatcctggccggccccatgccggtgacccactccagcgccgcccagcgccgggggcgcatcggccggaaccccaagaacgagaacgaccagtacatctacatgggggagcccctggagaacgacgaggactgcgcgcactggaaggaggccaagatgctcctggacaacatcaacacccccgagggcatcatcccgtccatgttcgagcccgagcgcgagaaggtggacgccatcgacggcgagtaccggctgcgcggggaggcccgcaagacgttcgtcgacctcatgcggcgcggcgacctgcccgtgtggctggcctaccgggtggcggccgaggggatcaactacgccgaccgccggtggtgcttcgacggcatcaagaacaaccagatcctcgaggagaacgtcgaggtggagatctggaccaaggagggggagcgcaagaagctgaagccgcggtggctggacgcccgcatctacagcgaccccctcgccctgaaggagttcaaggagttcgcggccggccggaagtccctgaccctcaacctgatcaccgagatgggccgcctgcccacgttcatgacccagaaggcccgggacgccctcgacaacctggcggtcctgcacaccgccgaggccgggggccgcgcctacaaccacgccctcagcgagctgcccgagaccctggagacgctcctgctgctcaccctgctggcgaccgtgaccgggggcatcttcctcttcctgatgtccggccgggggatcggcaagatgacgctggggatgtgctgcatcatcaccgccagcatcctcctgtggtacgcccagatccagccgcactggatcgccgcctccatcatcctggagttcttcctcatcgtgctgctgatccccgagcccgagaagcagcgcacgccccaggacaaccagctcacctacgtcgtgatcgcgatcctgaccgtggtcgccgccacgatggccaacgagatgggcttcctggagaagaccaagaaggacctcgggctgggcagcatcaccacccagcagccggagagcaacatcctggacatcgacctccggcccgcctccgcgtggacgctgtacgccgtggccaccaccttcgtgacccccatgctgcgccacagcatcgagaactccagcgtcaacgtgtccctcacggccatcgccaaccaggcgaccgtgctgatgggcctggggaagggctggcccctcagcaagatggacatcggggtcccgctgctggccatcggctgctactcccaggtgaaccccatcaccctcaccgccgccctgttcctgctcgtggcgcactacgccatcatcgggcccggcctgcaggccaaggccacgcgggaggcccagaagcgcgcggccgccggcatcatgaagaaccccaccgtcgacgggatcaccgtgatcgacctggacccgatcccctacgaccccaagttcgagaagcagctcggccaggtgatgctgctggtcctctgcgtgacccaggtgctgatgatgcggacgacctgggccctgtgcgaggccctcaccctggcgaccgggcccatcagcacgctgtgggagggcaacccggggcgcttctggaacaccaccatcgccgtctccatggccaacatcttccggggcagctacctcgccggcgccgggctgctgttctccatcatgaagaacaccacgaacacccgccgcggcaccgggaacatcggcgagaccctcggcgagaagtggaagtcccggctgaacgcgctgggcaagagcgagttccagatctacaagaagtccgggatccaggaggtggaccgcacgctcgccaaggaggggatcaagcggggcgagaccgaccaccacgccgtgtcccgcgggagcgccaagctgcggtggttcgtcgagcgcaacatggtgacccccgagggcaaggtggtcgacctgggctgcgggcggggcgggtggtcctactactgcggcgggctcaagaacgtgcgcgaggtgaagggcctgaccaagggcgggcccggccacgaggagcccatcccgatgagcacgtacgggtggaacctggtccggctccagtccggcgtggacgtgttcttcacgccgcccgagaagtgcgacaccctgctgtgcgacatcggggagagcagccccaacccgaccgtcgaggcgggccgcacgctccgggtgctgaacctggtggagaactggctcaacaacaacacccagttctgcatcaaggtcctgaacccctacatgccctccgtgatcgagaagatggaggccctgcagcgcaagtacggcggggccctcgtgcggaacccgctgagccgcaactccacccacgagatgtactgggtcagcaacgcctccggcaacatcgtgagctccgtgaacatgatcagccggatgctgatcaaccgcttcaccatgcggcacaagaaggccacctacgagcccgacgtcgacctggggtccggcacgcgcaacatcgggatcgagagcgagatccccaacctcgacatcatcggcaagcggatcgagaagatcaagcaggagcacgagacctcctggcactacgaccaggaccacccctacaagacctgggcgtaccacggcagctacgagaccaagcagacggggtccgccagctccatggtgaacggcgtggtccgcctgctgaccaagccgtgggacgtggtgcccatggtcacccagatggccatgaccgacacgacccccttcgggcagcagcgcgtgttcaaggagaaggtggacacccggacccaggagcccaaggagggcacgaagaagctcatgaagatcaccgccgagtggctgtggaaggagctgggcaagaagaagaccccgcgcatgtgcacccgggaggagttcacgcgcaaggtccggagcaacgccgcgctcggggccatcttcaccgacgagaacaagtggaagtccgcccgcgaggccgtggaggacagccggttctgggagctggtcgacaaggagcgcaacctgcacctcgagggcaagtgcgagacctgcgtgtacaacatgatggggaagcgggagaagaagctgggcgagttcgggaaggccaagggctcccgcgcgatctggtacatgtggctgggcgcccggttcctcgagttcgaggccctggggttcctgaacgaggaccactggttcagccgcgagaacagcctctccggcgtggagggggagggcctgcacaagctggggtacatcctccgggacgtcagcaagaaggagggcggcgccatgtacgcggacgacaccgccgggtgggacacgcgcatcaccctggaggacctgaagaacgaggagatggtgaccaaccacatggagggcgagcacaagaagctcgccgaggccatcttcaagctgacctaccagaacaaggtggtccgggtgcagcgccccacgccccgggggaccgtgatggacatcatctcccgccgggaccagcgcggcagcgggcaggtcggcacctacggcctgaacaccttcacgaacatggaggcccagctcatccggcagatggagggggagggcgtgttcaagtccatccagcacctgaccgtgaccgaggagatcgcggtccagaactggctggcccgcgtggggcgcgagcggctcagccgcatggccatctccggcgacgactgcgtggtcaagcccctggacgaccggttcgccagcgccctgaccgcgctcaacgacatgggcaaggtgcgcaaggacatccagcagtgggagccgtcccgggggtggaacgactggacccaggtgcccttctgcagccaccacttccacgagctgatcatgaaggacggccgcgtcctggtggtgccctgccggaaccaggacgagctcatcgggcgcgcccggatctcccagggcgccgggtggagcctgcgcgagaccgcctgcctgggcaagtcctacgcccagatgtggagcctcatgtacttccaccggcgcgacctgcggctggcggccaacgccatctgctccgccgtccccagccactgggtgccgacctcccgcaccacgtggagcatccacgccaagcacgagtggatgaccaccgaggacatgctcaccgtgtggaaccgggtctggatccaggagaacccctggatggaggacaagacccccgtggagagctgggaggagatcccctacctgggcaagcgcgaggaccagtggtgcgggtccctgatcggcctcacgagccgggcgacctgggccaagaacatccagaccgccatcaaccaggtgcgctccctgatcgggaacgaggagtacaccgactacatgccgagcatgaagcggttccgccgcgaggaggaggaggccggcgtcctgtggtga

SEQ ID NO: 9135 - RNA, 9876 nt, synthetic construct
  misc_feature 1..9876: note = derived and/or modified CDS sequence (opt1) from DENV-2__FJ898454__SS-prME
  source 1..9876: mol_type = other RNA
accgcgggcgtgatcatcatgctgatccccaccgccatggcgttccacctcaccacccggaacggggagccccacatgatcgtgagccggcaggagaagggcaagagcctgctgttcaagaccgaggacggggtgaacatgtgcaccctcatggccatggacctgggcgagctgtgcgaggacaccatcacctacaactgccccctcctgcggcagaacgagcccgaggacatcgactgctggtgcaacagcacctccacctgggtgacctacgggacctgcaccgccaccggcgagcaccggcgcgagaagcggagcgtcgccctggtgccccacgtgggcatggggctcgagacccgcaccgagacctggatgtccagcgagggcgcctggaagcacgcgcagcggatcgagacctggatcctgcgccaccccgggttcacgatcatggccgccatcctggcctacaccatcggcaccacctacttccagcgggtcctcatcttcatcctgctgacggcggtggccccctccatgaccatgcgctgcatcgggatcagcaaccgggacttcgtggagggcgtctccggcgggagctgggtggacatcgtgctcgagcacggctcctgcgtcaccaccatggccaagaacaagcccacgctggacttcgagctgatcaagaccgaggccaagcagcccgccaccctccgcaagtactgcatcgaggcgaagctgaccaacacgaccaccgccagccggtgccccacccagggggagccctccctgaacgaggagcaggacaagcgcttcgtgtgcaagcacagcatggtggaccggggctggggcaacgggtgcggcctcttcgggaagggcgggatcgtcacgtgcgccatgttcacgtgcaagaagaacatggagggcaagatcgtgcagcccgagaacctggagtacaccatcgtggtcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctcgacttcaacgagatggtgctgctgcagatggagaacaaggcgtggctcgtgcaccggcagtggttcctggacctgcccctcccctggctgccgggcgccgacacccaggggtccaactggatccagaaggagaccctggtcacgttcaagaacccccacgccaagaagcaggacgtggtcgtgctcggcagccaggagggggccatgcacaccgccctgaccggcgcgaccgagatccagatgagctccgggaacctcctgttcacgggccacctgaagtgccgcctgcggatggacaagctccagctgaagggcatgagctactccatgtgcaccgggaagttcaaggtggtcaaggagatcgccgagacccagcacggcaccatcgtggtgcgcgtccagtacgagggggacggcagcccctgcaagatccccttcgagatcatggacctggagaagcggcacgtgctcggccgcctgatcacggtgaacccgatcgtcaccgagaaggactcccccgtgaacatcgaggccgagccgcccttcggggacagctacatcatcatcggcgtggagccggggcagctgaagctctcctggttcaagaagggcagctccatcgggcagatgttcgagaccaccatgcgcggcgccaagcggatggccatcctgggcgacacggcgtgggacttcgggagcctgggcggggtcttcacctccatcggcaaggccctccaccaggtgttcggggccatctacggcgccgcgttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggccgactccgggtgcgtcgtgagctggaagaacaaggagctcaagtgcggcagcggcatcttcatcaccgacaacgtgcacacctggacggagcagtacaagttccagcccgagtcccccagcaagctggcctccgccatccagaaggcctacgaggaggggatctgcggcatccggagcgtcacccgcctggagaacctcatgtggaagcagatcacccccgagctgaaccacatcctgtccgagaacgaggcgaagctcaccatcatgacgggggacatcaagggcatcatgcaggccgggaagcggagcctgcgcccgcagcccaccgagctgaagtactcctggaagacctggggcaaggccaagatgctcagcaccgagccccacaaccagacgttcctgatcgacggcccggagaccgccgagtgccccaacaccaaccgggcctggaactccctggaggtggaggactacgggttcggcgtgttcaccacgaacatctggctcaagctgaaggagcgccaggacgtcttctgcgacagcaagctgatgtccgcggccatcaagaacaaccgggccgtgcacgccgacatggggtactggatcgagagcgccctcaacgacacctggaagatcgagaaggcgtccttcatcgaggtcaagagctgccactggcccaagtcccacaccctgtggagcaacggcgtgctggagtccgagatgatcatccccaagaacttcgccggcccggtgagccagcacaactaccgccccgggtaccacacccagaccgccggcccctggcacctcgggaagctggagatggacttcgacttctgcgagggcacgaccgtggtcgtgaccgaggactgcgggaaccggggccccagcctgcgcaccacgaccgcctccggcaagctcatcaccgagtggtgctgccggagctgcaccctgccgcccctgcgctaccgcggggaggacggctgctggtacgggatggagatccgccccctcaaggagaaggaggagaacctggtgaactccctggtcacggcgggccacgggcagatcgacaacttcagcctcggcgtgctgggcatggccctgttcctcgaggagatgctgcggacccgcgtggggaccaagcacgccgtcctgctcgtggccgtgtccttcatgaccctgatcacgggcaacatgagcttccgggacctggggcgcgtcatggtgatggtgggcgccgcgatcaccgacgacatcgggatgggcgtcacctacctcgccctgctggccgccttcaaggtgcgccccaccttcgccgcgggcctcctgctgcggaagctcacgtccaaggagctgatgatgaccaccatcgggatcgtgctgctcagccagtccaccatcccggagacgatcctggagctgaccgacgccctcgccctgggcatgatgatcctgaagatcgtccgcaacatggagaagtaccagctcgccgtgaccatcatggccaccctgtgcgtccccaacgcggtgatcctgcagaacgcctggaaggtgagctgcacgatcctcgccgtcgtgtccgtgagccccctgctgctcacctccagccagcagaaggccgactggatccccctggcgctgaccatcaaggggctcaacccgaccgccatcttcctgacgaccctgtcccggaccaacaagaagcgcagctggcccctcaacgaggccatcatggccgtcggcatggtgtccatcctggccagctccctgctcaagaacgacatccccatgaccggccccctggtggccggcgggctgctcacggtctgctacgtgctgaccgggcggagcgccgacctggagctcgagcgcgccgccgacgtgcggtgggaggaccaggccgagatcagcgggtccagcccgatcctgtccatcaccatcagcgaggacgggtccatgagcatcaagaacgaggaggaggagcagaccctgacgatcctcatccgcaccggcctgctggtcatctccggcctcttccccgtgagcatccccatcaccgcggccgcctggtacctgtgggaggtgaagaagcagcgggccggggtcctgtgggacgtgccctccccgccgcccgtgggcaaggccgagctcgaggacggggcgtaccgcatcaagcagaagggcatcctggggtacagccagatcggcgccggcgtctacaaggaggggaccttccacaccatgtggcacgtgacgcggggcgccgtgctgatgcacaaggggaagcgcatcgagccgtcctgggccgacgtccggaaggacctcatcagctacggcgggggctggaagctggagggcgagtggaaggagggggaggaggtccaggtgctggccctcgagcccggcaagaacccccgcgcggtccagaccaagcccgggctgttcaagaccaacaccggcacgatcggggccgtgtccctggacttcagcccgggcacctccggcagccccatcgtggacaagaaggggaaggtcgtgggcctctacgggaacggcgtggtcacccggtccggcacctacgtgagcgccatcgcccagacggagaagtccatcgaggacaaccccgagatcgaggacgacatcttccgcaagaagcggctgaccatcatggacctgcaccccggggcgggcaagaccaagcgctacctgccggccatcgtgcgggaggccatcaagcgcgggctccggaccctgatcctggcccccacgcgcgtcgtggccgcggagatggaggaggccctccgcggcctgcccatccggtaccagacccccgccatccgcgccgagcacaccgggcgggagatcgtggacctgatgtgccacgccaccttcacgatgcgcctcctgagcccggtccgggtgcccaactacaacctgatcatcatggacgaggcgcacttcaccgaccccgccagcatcgccgcccgcggctacatctccacccgggtggagatgggcgaggccgcggggatcttcatgaccgccacgcccccgggcagccgcgaccccttcccccagtccaacgcccccatcatggacgaggagcgggagatcccggagcgcagctggaactccgggcacgagtgggtcaccgacttcaagggcaagaccgtgtggttcgtgcccagcatcaaggccgggaacgacatcgcggcctgcctccggaagaacggcaagaaggtcatccagctgtcccgcaagaccttcgacagcgagtacatcaagacgcggaccaacgactgggacttcgtggtgaccaccgacatctccgagatgggcgccaacttcaaggccgagcgcgtcatcgacccccggcgctgcatgaagcccgtgatcctgacggacggggaggagcgggtgatcctcgccggcccgatgcccgtcacccacagctccgcggcccagcgccgggggcgcatcggccgcaaccccaagaacgagaacgaccagtacatctacatgggggagcccctggagaacgacgaggactgcgcccactggaaggaggccaagatgctgctcgacaacatcaacaccccggagggcatcatccccagcatgttcgagcccgagcgggagaaggtggacgccatcgacggcgagtaccgcctgcgcggggaggcgcgcaagaccttcgtggacctgatgcggcgcggcgacctcccggtctggctggcctaccgggtggccgccgaggggatcaactacgccgaccgccggtggtgcttcgacggcatcaagaacaaccagatcctggaggagaacgtcgaggtggagatctggacgaaggagggggagcgcaagaagctcaagccccggtggctggacgcgcgcatctactccgaccccctggccctcaaggagttcaaggagttcgccgccggccgcaagagcctgaccctgaacctcatcaccgagatgggccgcctgcccaccttcatgacgcagaaggcgcggaacgccctggacaacctcgccgtgctgcacaccgccgaggccgggggccgcgcgtacaaccacgccctgtccgagctcccggagaccctggagaccctgctcctgctgacgctcctggccaccgtcaccgggggcatcttcctgttcctcatgagcggcaaggggatcggcaagatgaccctggggatgtgctgcatcatcaccgcctccatcctgctctggtacgcccagatccagccccactggatcgcggccagcatcatcctggagttcttcctgatcgtgctcctgatccccgagcccgagaagcagcggacgccgcaggacaaccagctgacctacgtggtcatcgccatcctcaccgtggtggccgccaccatggcgaacgagatgggcttcctggagaagacgaagcgcgacttcgggctgggctccatcgccacccagcagcccgagagcaacatcctcgacatcgacctgcggcccgccagcgcctggaccctgtacgccgtcgcgaccacgttcatcacccccatgctccgccactccatcgagaacagctccgtgaacgtgagcctgaccgccatcgccaaccaggccaccgtcctgatgggcctcgggaagggctggccgctgtccaagatggacatcggggtgcccctgctcgcgatcggctgctacagccaggtgaaccccatcacgctgaccgccgccctgctcctgctggtcgcccactacgccatcatcgggcccggcctccaggcgaaggccacccgggaggcccagaagcgcgccgccgcgggcatcatgaagaacccgaccgtggacgggatcacggtgatcgacctggaccccatcccctacgaccccaagttcgagaagcagctgggccaggtcatgctcctggtgctgtgcgtgacccaggtcctcatgatgcgcaccacctgggccctgtgcgaggccctgacgctcgccaccgggccgatctccaccctgtgggagggcaaccccgggcggttctggaacaccacgatcgccgtgagcatggcgaacatcttccgcggctcctacctggccggcgccgggctcctgttcagcatcatgaagaacaccaccaacacccggcgcggcacggggaacaccggcgagaccctgggcgagaagtggaagaaccggctcaactccctgggcaagagcgagttccagatctacaagcgctccggcatccaggaggtggaccggaccctggccaaggaggggatcaagcgcggcgagacggaccaccacgcggtcagccgggggtccgccaagctccgctggttcgtggagcggaacctggtgacccccgagggcaaggtcgtggacctgggctgcgggcgcggcgggtggagctactactgcggcgggctcaagaacgtgcgggaggtcaagggcctgaccaagggcgggcccggccacgaggagccgatccccatgtccacctacgggtggaacctggtgcgcctccagagcggcgtggacgtcttcttcacgccgcccgagaagtgcgacaccctgctgtgcgacatcggggagtccagcccgaaccccaccgtggaggccggccggaccctccgcgtgctgaacctggtcgagaactggctcaacaacaacacccagttctgcatcaaggtgctgaacccctacatgccgagcgtgatcgagaagatggagacgctgcagcggaagtacggcggggccctggtccgcaaccccctctcccggaacagcacccacgagatgtactgggtgtccaacgccagcggcaacatcgtgtccagcgtcaacatgatctcccgcatgctgatcaaccgcttcaccatgcggcacaagaaggcgacctacgagcccgacgtggacctggggagcggcacgcgcaacatcgggatcgagtccgagacccccaacctcgacatcatcggcaagcggatcgagaagatcaagcaggagcacgagaccagctggcactacgaccaggaccacccgtacaagacctgggcctaccacggctcctacgagacgaagcagaccgggagcgcctccagcatggtgaacggcgtcgtgcgcctgctgaccaagccctgggacgtgatccccatggtcacccagatggccatgacggacaccacccccttcgggcagcagcgggtgttcaaggagaaggtggacacccgcacgcaggagccgaaggagggcaccaagaagctcatgaagatcaccgccgagtggctgtggaaggagctgggcaagaagaagacgccccggatgtgcacgcgcgaggagttcacccggaaggtccgctccaacgcggccctcggggccatcttcaccgacgagaacaagtggaagtccgcccgggaggccgtggaggactcccgcttctgggagctggtcgacaaggagcggaacctgcacctcgagggcaagtgcgagacctgcgtgtacaacatgatggggaagcgcgagaagaagatcggcgagttcgggaaggcgaagggcagccgggccatctggtacatgtggctgggcgcccgcttcctggagttcgaggccctcgggttcctgaacgaggaccactggttctcccgggagaacagcctgagcggcgtggagggggagggcctccacaagctggggtacatcctgcgcgaggtctccaagaaggagggcggcgcgatgtacgccgacgacacggccgggtgggacacccggatcaccctcgaggacctgaagaacgaggagatggtgaccaaccacatggagggcgagcacaagaagctggccgaggccatcttcaagctcacgtaccagaacaaggtggtccgcgtgcagcggcccacgccccgggggaccgtgatggacatcatcagccgccgggaccagcgcggctccgggcaggtcggcacctacggcctgaacacgttcaccaacatgggggcgcagctgatccggcagatggagggcgagggggtgttcaagggcatccagcacctcaccgccaccgaggaggtggccgtccaggactggctggcccgcgtgggccgggagcgcctgagccggatggccatctccggggacgactgcgtggtcaagccgctcgacgaccgcttcgcgagcgccctgacggccctgaacgacatgggcaagatccggaaggacatccagcagtgggagccctcccgcgggtggaacgactggacccaggtgcccttctgcagccaccacttccacgagctcatcatgaaggacggccgggtgctggtcgtgccctgccgcaaccaggacgagctgatcgggcgggcccgcatctcccagggcgccggctggagcctccgggagaccgcgtgcctggggaagtcctacgcccagatgtggagcctgatgtacttccaccgccgggacctccgcctggccgccaacgccatctgctccgcggtgccgagccactgggtccccacctcccggaccacgtggagcatccacgcccgccacgagtggatgaccaccgaggacatgctgaccgtgtggaaccgcgtgtggatccaggagaacccctggatggaggacaagacgcccgtcgagtcctgggaggagatcccgtacctcggcaagcgggaggaccagtggtgcgggagcctgatcggcctgaccagccgcgccacctgggccaagaacatccagaccgcgatcaaccaggtgcggtccctcatcgggagcgaggagtacacggactacatgccctccatgaagcgcttccggcgcgaggaggaggaggccggcgtgctgtggtga

SEQ ID NO: 9136 - RNA, 9876 nt, synthetic construct
  misc_feature 1..9876: note = derived and/or modified CDS sequence (opt1) from DENV-2__JQ922551__SS-prME
  source 1..9876: mol_type = other RNA
accgtggggatgatcatcatgctcatccccaccgccatggccttccacctcaccacccggaacggggagccccacatgatcgtcagccggcaggagaagggcaagagcctgctgttcaagaccgaggacggggtgaacatgtgcaccctcatggcgatggacctgggggagctgtgcgaggacaccatcacctacaactgccccctcctgaagcagaacgagcccgaggacatcgactgctggtgcaacagcaccagcacctgggtgacctacgggacctgcaccgccaccggggagcaccggcgggagaagcgcagcgtcgccctggtgccccacgtgggcatggggctcgagacccggaccgagacctggatgagcagcgagggcgcctgcaagcacgcccagcgcatcgagacctggatcctgcggcacccgtccttcacgatcatggcggccatcctggcctacaccatcgggaccacctacttccagcgcgtcgtgttcctcatggtgctgacggccgtcgcgctgagcatgaccatgcggtgcatcggcatctccaaccgcgacttcgtggagggggtgagcggcggctcctgggtcgacatcgtgctcgagcacgggagctgcgtgaccaccatggccaagaacaagcccacgctggacttcgagctgatcaagaccgaggccaagcagcccgccaccctccggaagtactgcatcgaggccaagctgaccaacacgaccaccgcgtcccgctgccccacccagggcgagccgagcctgaacgaggagcaggacaagcggttcgtccgcaagcactccatggtggaccgggggtggggcaacggctgcggcctcttcggcaagggcgggatcgtgacgtgcgccatgttcacgtgcaagaagaacatggaggggaagatcgtccagcccgagaacctggagtacaccctggtgatcacgccccacagcggcgaggagaacgccgtgggcaacgacacggggaaccacggcaaggagatcaaggtcacgccccagtccagcatcaccgaggccgccctcaccgggtacggcaccgtgacgatggagtgctccccgcgcaccgggctgaacttccacgagatggtgagcctgcccatggagaacaaggcgtggatggtccaccggcagtggttcctcgacctgcccctgccctggctcccgggcgccgacacccagggcagcaactggatccagaaggagaccctggtgacgttcaagaacccccacgccaagaagcaggacgtcgtggtgctggggtcccaggagggcgccatgcacaccgccctcaccggggcgaccgagatccagatgagctccggcaacctgctgttcacggggcacctcaagtgccgcctgcggatggacaagctgcagctcaagggcatgagctactccatgtgcaccggcaagttcaaggtcgtgtgggggatcgcccgcacccagcacggcaccatcgtgcaccgggtccagtacgagggggacggcagcccctgcaagatccccctgaacatcatgggcctggagaagcgccacgtgctcgggcgcccgatcacggtgaaccccatcgtcaccggcaaggactcccccgtgaacatcgaggccgagcccccgctgggggacagctacatcatcatcggcgtggagcccgggcaggtcaagctgacctgctcccagaagggcagctccatcggccagatgttcgagaccacgatgcgcggggcgaagcgcatggccatcctcggcgacaccgcgtgggacttcgggagcctgggcggggtgttcacctccatcggcaaggccctgcaccaggtgttcggcgccatctacggggccgcgttcagcggcgtctcctggaccatgaagatcctcatcggggtggtgatcacgtggatcggcatgaacagccggtccaccagcctgtccgtcagcctggtgctggtgggggtcgtgaccctctacctgggcgtgatggtccaggccgacagcggctgcgtggtgtcctggaagaacaaggagctgaagtgcgggagcggcatcttcgtcaccgacaacgtgcacacgtggaccgagcagtacaagttccagcccgagtcccccagcaagctcgcctccgccatccagaaggcccacgaggaggggatctgcggcatccgcagcgtgacccggctggagaacctgatgtggaagcagatcaccccggagctcaaccacatcctgtccgagaacgaggtcaagctgacgatcatgaccggggacatcaagggcatcatgcaggcgggcaagcgcagcctccggccccagcccaccgagctgaagtactcctggaagacctgggggaaggccaagatgctgagcacggagccgcacaaccagaccttcctcatcgacggccccgagaccgccgagtgcccctccaccaaccgcgcctggaacagcctgaagggcggggactacggcttcggggtgttcacgaccaacatctggctgaagctcaaggagcggcaggacgtgtcctgcgacagcaagctgatgtccgccgcgatcaaggacaaccgcgccgtccacgccgacatgggctactggatcgagagcgccctgaacgacacctggaagatcgagaaggcctccttcatcgaggtcaagagctgccactggcccaagagccacaccctctggtccaacggggtgctggagagcgagatgatcatcccgaagaacctggcgggccccgtgtcccagcacaactaccggcccgggtaccacacccagacggccggcccctggcacctcggcaagctggagatggacttcgacctgtgcgaggggaccaccgtggtggtcaccgaggactgcggcaaccgcgggccgagcctccggacgaccaccgcctccggcaagctgatcaccgagtggtgctgccgcagctgcacgctgccgcccctccggtaccgcggggaggacggctgctggtacggcatggagatccggcccctgaaggagaaggaggagaacctggtgaactccctcgtgaccgccgagcacgagcagatcgacaacttcagcctgggggtcctgggcatggccctcttcctggaggagatgctgcgcacccgggtggggaccaagcacgccgtgctcctggtcgccgtgtccttcatgacgctgatcaccggcaacatgagcttccgcgacctcgggcgcgtgatggtcatggtgggcgccgccatgaccgacgacatcggcatgggggtgacctacctggcgctgctcgccgccttcaaggtccggccgacgttcgccgccggcctgctgctccgcaagctgacctccaaggagctgatgatgaccaccatcgggatcgtgctcctgagccagtccacgatccccgagaccatcctggagctcaccgacgcgctggccctgggcatgatgatcctcaagatcgtccggaacatggagaagtaccagctggccgtgaccatcatggccatcctgtgcgtgcccaacgccatgatcctccagaacgcgtggaaggtcagctgcacgatcctggccgtggtgtccgtcagccccctgctcctgacctccagccagcagaaggccgactggatcccgctggccctcaccatcaagggcctgaaccccaccgcgatcttcctgacgaccctctcccgcaccaacaagaagcggagctggcccctgaacgaggccatcatggccgtggggatggtgagcatcctggcctccagcctcctgaagaacgacatccccatgaccggcccgctggtcgccgggggcctcctgacggtgtgctacctgctccccgggcgctccgcggacctggagctggagcgggccgccgacctccgctgggaggaccaggccgagatcagcggctccagccccatcctgtccatcaccatcagcgaggacggctccatgagcatcaagaaccaggaggagaagcagaccctgaccatcctcatcaagacggggctgctggtgatctccgagctgttccccgtccagatcccgatcaccgccgcggcctggtacctgtgggaggtgaagaagcagcgggccggcgtgctgtgggacgtccccagcccgccgcccgtggggaaggccgagctcgaggacggcgcctacgggatcaagcagaagggcatcctgggctactcccagatcggggcgggcgtgtacaaggaggggaccttccacaccatgtggcacgtcacccgcggcgccgtgctgatgcacaaggggaagcggatcgagcccagctgggccgacgtgcgcaaggacctcatctcctacggcggcgggtggaagctggagggcgagtggaaggagggggaggaggtccaggtgctggccctcgagcccggcaagaacccccgggccgtgcagacgcgccccgggctgttcaagaccaacaccggcaccatcggcgcggtcagcctggacttctcccccgggacgagcggctcccccatcgtggacaagaaggggaaggtggtcggcctgtacggcaacggggtggtgacccggagcggcacctacgtcagcgccatcgcccagaccgagaagtccatcgaggacaaccccgagatcgaggacgacatcttccgcaagaagcggctcacgatcatggacctgcaccccggggccggcaagaccaagcgctacctgcccgcgatcgtgcgggaggccatcaagcgcgggctccggaccctgatcctggcccccacccgcgtggtcgccgccgagatggaggaggcgctccgcggcctgccgatccggtaccagacgcccgccatccgcgccgagcacaccggccgggagatcgtggacctgatgtgccacgccaccttcaccatgcgcctcctgagccccgtgcgggtccccaactacaacctgatcatcatggacgaggcccacttcacggacccggcgtccatcgccgcccgcgggtacatcagcacccgggtggagatgggcgaggccgccgggatcttcatgaccgcgacgccgcccggctcccgcgaccccttcccgcagagcaacgcccccatcatggacgaggagcgggagatccccgagcgctcctggaacagcgggcacgagtgggtgacggacttcaagggcaagaccgtctggttcgtgccctccatcaaggccggcaacgacatcgccgcgtgcctccggaagaacgggaagaaggtgatccagctgagccgcaagaccttcgactccgagtacatcaagacccggacgaacgactgggacttcgtcgtgaccaccgacatcagcgagatgggcgccaacttcaaggccgagcgcgtgatcgacccgcggcgctgcatgaagcccgtcatcctgaccgacggggaggagcgggtgatcctcgccggccccatgcccgtgacgcactccagcgccgcgcagcgccgggggcgcatcggccgcaacccgaagaacgagaacgaccagtacatctacatgggcgagcccctggagaacgacgaggactgcgcccactggaaggaggccaagatgctgctcgacaacatcaacacccccgaggggatcatcccgtccatgttcgagcccgagcgggagaaggtcgacgccatcgacggcgagtaccgcctgcgcggggaggcccgcaagaccttcgtggacctgatgcggcgcggcgacctccccgtgtggctggcgtaccgggtcgccgccgaggggatcaactacgccgaccgccggtggtgcttcgacggcatcaagaacaaccagatcctggaggagaacgtggaggtcgagatctggaccaaggagggcgagaagaagaagctcaagccccgctggctggacgcccggatctacagcgacccgctggcgctcaaggagttcaaggagttcgccgccgggcgcaagtccctgacgctgaacctcatcaccgagatgggccggctgcccaccttcatgacccagaaggcccgcaacgcgctggacaacctcgccgtgctgcacacggccgaggccgggggccgggcctacaaccacgcgctgagcgagctccccgagaccctggagaccctgctcctgctgaccctcctggccacggtgaccggcgggatcttcctgttcctcatgtccggcaaggggatcggcaagatgaccctggggatgtgctgcatcatcaccgccagcatcctgctctggtacgcccagatccagccccactggatcgccgcgagcatcatcctggagttcttcctgatcgtcctcctgatcccggagcccgagaagcagcgcacgccccaggacaaccagctgacgtacgtggtgatcgccatcctcaccgccgtcgccgccaccatggcgaacgagatgggcttcctggagaagaccaagaaggacttcggcctggggtccatcgccacgcagcccccggagagcaacatcctcgacatcgacctgcggcccgcctccgcctggaccctgtacgccgtggcgaccaccttcatcacgagcatgctccgccactccatcgagaacagctccgtgaacgtcagcctgaccgccatcgccaaccaggccaccgtgctgatgggcctcgggaagggctggcccctgtccaagatggacatcggggtgcccctgctcgcgatcggctgctacagccaggtcaacccgatcaccctgacggccgccctgctcctgctggtggcccactacgccatcatcggccccgggctccaggcgaaggccacccgggaggcccagaagcgcgccgccgcgggcatcatgaagaaccccaccgtggacgggatcaccgtcatcgacctggaccccatcccgtacgaccccaagttcgagaagcagctgggccaggtgatgctcctggtgctgtgcgtcacccaggtgctcatgatgcggaccacctgggccctgtgcgaggccctgaccctcgccacggggcccatctccaccctgtgggagggcaaccccggccgcttctggaacaccaccatcgccgtgagcatggcgaacatcttccgcgggtcctacctggccggcgccgggctcctgttcagcatcatgaagaacacgaccaacacccggcgcggcaccggcaacacgggggagaccctgggcgagaagtggaagaaccggctcaacgccctggggaagtccgagttccagatctacaagaagtccggcatccaggaggtcgaccgcaccctggcgaaggaggggatcaagcggggcgagaccgaccaccacgccgtgtcccgcggcagcgccaagctccggtggttcgtggagcgcaacctggtcacgccggaggggaaggtggtggacctgggctgcgggcggggcgggtggtcctactactgcggcggcctcaagaacgtccgcgaggtgaaggggctgaccaagggcgggcccggccacgaggagcccatccccatgagcacctacgggtggaacctggtgcggctccagagcggcgtcgacgtgttcttcaccccgcccgagaagtgcgacacgctgctgtgcgacatcggcgagtccagccccaacccgaccgtggaggccgggcgcaccctccgggtcctgaacctggtggagaactggctgaacaacaacacccagttctgcgtgaaggtcctcaacccctacatgccctccgtgatcgagaagatggagaccctgcagcgcaagtacggcggggccctggtgcggaaccccctcagccgcaactccacgcacgagatgtactgggtcagcaacgcgtccggcaacatcgtgagctccgtgaacatgatcagccggatgctgatcaaccgcttcaccatgcggcacaagaaggccacctacgagccggacgtcgacctggggtccggcacccgcaacatcggcatcgagagcgagacgcccaacctcgacatcatcgggaagcgcatcgagaagatcaagcaggagcacgagacctcctggcactacgaccaggaccacccctacaagacctgggcctaccacggcagctacgagaccaagcagacggggtccgccagctccatggtgaacggcgtggtccggctgctgaccaagccctgggacgtgatcccgatggtgacccagatggccatgaccgacacgacccccttcggccagcagcgcgtcttcaaggagaagtccgacacccggacccaggagcccaaggaggggacgaagaagctcatgaagatcacccccaagtggctgtggaaggagctgggcaagaagaagaccccgcgcatgtgcacccgggaggagttcacgcgcaaggtgcggtccaacgcggccctcggggccatcttcaccgacgagaacaagtggaagtccgcccgcgaggccgtggaggacagccggttctgggagctggtcgacaaggagcgcaacctgcacctcgagggcaagtgcgagacctgcgtgtacaacatgatggggaagcgggagaagaagctgggcgagttcggcaaggcgaaggggtcccgcgccatctggtacatgtggctgggcgcccggttcctcgagttcgaggccctggggttcctgaacgaggaccactggttcagccgcgagaactccctcagcggcgtcgagggggagggcctgcacaagctgggctacatcctccgggacgtgtccaagaaggagggcggggcgatgtacgccgacgacaccgccgggtgggacacgcgcatcaccctggaggacctgaagaacgaggagatgggcgccaaccacctcgagggggagcccaagaagctgtacgaggccatcttcaagctgacctaccagaacaagggcgtgcgggtccagcgccccacgccccggggcccgctcatggacatcatcctgcgccgggaccagggcgggagcggccaggtgggcacctacggcctgaacaccttcaccaacatgggggcgcagctcatccgccagatggagggcgagggggtgttcaagggcatccagcacctgatcgccaccgaggagatcgccgtccaggactggctggcccgcgtggggcgggagcgcttctcccggatggccatcagcggcgacgactgcgtggtcaagcccctcgacgaccgcttcgcgtccgccctgacggccctgaacgacatgggcaaggagcggaaggtgctccagcagtgggagcccagccgcgagtggaacgactggacccaggtgcccttctgctcccaccacttccacgagctgatcatgaaggacgggcgggtcctggtggtgccgtgccgcaaccaggacgagctcatcggccgggcccgcatcagccagggggccggctggtccctgcgggagaccgcgtgcctgggcaagagctacgcccagatgtggtcccagatgtacttccaccgccgggacctccgcctggccgccaacgccatctgcagcgcggtcccctcccactgggtgcccaccagccggacgacctggagcatccacgcccgccacgagtggatgaccaccgaggacatgctgaccgtgtggaaccgggtctggatccaggagaacccctggatggaggacaagacgccggtggagtcctgggaggagatcccctacctcggcaagcgcgaggaccagtggtgcggcagcctgatcgggctgacctcccgggccacctgggccaagaacatccagaccgcgatcaaccaggtgcgcagcctcatcggcaacgaggagtacacggactacatgccctccatgaagcgcttccggcgcgaggaggaggaggccggggtcctgtggtga

SEQ ID NO: 9137 - RNA, 9876 nt, synthetic construct
  misc_feature 1..9876: note = derived and/or modified CDS sequence (opt1) from DENV-2__JQ922550__SS-prME
  source 1..9876: mol_type = other RNA
accgtgggcatgatcatcatgctgatccccaccgtgatggccagccacctcaccacccggaacgggggcccccacatgatcgtgatcgggcagcagaagcggaagacctccttcttcaagaccaagaagggccacgacatgtgcaccctgatggccatggcgttcggggagttctgcgagaacaccatcacctacaagtgccccttcctgaagcagaacgagcccgaggacatcgactgctggtgcaacagcacctccacctgggtgacctacgggacctgcaccaccaccggcgagcaccgccgggagaagcggagcgtcgccctcgtgccccacgtggggatgggcctggagacccggaccgagacgtggatgtccagcgagggggcctggaagcacgcccagcgcatcgagacctggatcctgcggcaccccggcttcaccatcatggccgcgatcctcgcctacaccatcgggacgacccacttccagcgcgtcctgatcttcatcctgctcaccgccatcgccccctccatgaccatgcggtgcatcggcatcagcaaccgcgacttcgtggagggcgtgtccgggggcagctgggtcgacatcgtgctggagcacgggtcctgcgtgacgaccatggcgaagaacaagcccaccctggacttcgagctcatcaagaccgaggccaagcagcccgccacgctgcggaagtactgcatcgaggccaagctgaccaacaccaccacggacagccgctgccccacccagggcgagcccaccctcaacgaggagcaggacaagcggttcgtctgcaagcactccatggtggaccgcggctgggggaacggctgcgggctgttcggcaagggcgggatcgtgacctgcgccatgttcacgtgcaagaagaacatgaagggcaagatcgtccagcccgagaacctggagtacaccgtggtgatcacgccccacagcggggaggagcacgcggtcggcaacgacaccgggaagcacggcaaggaggtgaagatcaccccgcagtccagcatcacggaggccgagctcaccgggtacggcaccgtgaccatggagtgcagcccccggacgggcctggacttcaacgagatggtcctgctccagatggaggacaaggcctggctggtgcaccgccagtggttcctggacctccccctgccctggctgccgggggccgacacccagggcagcaactggatccagaaggagaccctcgtgaccttcaagaacccccacgccaagaagcaggacgtcgtggtcctggggtcccaggagggcgcgatgcacacggccctgaccggggccaccgagatccagatgagcagcggcaacctcctgttcaccggccacctgaagtgccggctccgcatggacaagctgcagctgaaggggatgtcctacagcatgtgcacgggcaagttcaaggtggtgaaggagatcgccgagacccagcacgggaccatcgtcatccgggtgcagtacgagggcgacggctccccctgcaagatccccttcgagatcaaggacctcgagaagcgccacgtgctggggcggctgatcaccgtcaacccgatcgtgacggagaaggacagccccgtgaacatcgaggccgagccgcccctgggcgactcctacatcatcatcggggtcgagccgggccagctgaagctggactggttcaagaaggggagctccatcggccagatgttcgagaacaccatgcgcggcgcgaagcgcatggccatcctcggggacaccgcctgggacttcggcagcctcggcggggtgttcacctccatcgggaaggccctgcaccaggtgttcggggccatctacggcgcggccttcagcggggtctcctggacgatgaagatcctcatcggcgtgatcatcacctggatcgggatgaacagccggtccaccagcctgtccgtgagcctggtcctcgtgggcatcgtgaccctgtacctgggggtcatggtgcaggccgactccggctgcggcgggtgcgagcgcaagacgaagaccaagtgcggcagcgggatcttcgtgaccgacaacgtccacacctggacggagcagtacaagttccagcccgagtcccccagcaagctggccagcgcgatccagaaggcccacgaggagggcatctgcgggatccggtccgtgacccgcctcgagaacctgatgtggaagcagatcacccccgagctgaaccacatcctcagcgagaacgaggtgaagctgaccatcatgacgggcgacatcaagggcatcatgcaggccgggaagcggtccctgcgcccgcagcccaccgagctccggtacagctggaagacctggggcaaggccaagatgctgtccaccgagctgcacaaccagacgttcctcatcgacgggcccgagaccgccgagtgcccgaacaccaaccgcgcgtggaacagcctggaggtcgaggactacggcttcggcgtgttcaccaccaacatctggctgcggctccgcgagaagcaggacgtgttctgcgactccaagctgatgagcgccgccatcaaggacaaccgggccgtccacgccgacatggggtactggatcgagtccgcgctgaacgacacgtggaagatcgagaaggccagcttcatcgaggtgaagtcctgccactggcccaagagccacaccctctggggcaacggggtgctggagtccgagatggtcatccccaagaacttcgccggccccgtgagccagcacaacaaccgcccggggtactacacccagaccgccggcccctggcacctgggcaagctcgagatggacttcgacttctgcgaggggacgaccgtggtcgtgaccgaggactgcggcaaccgggggccctccctgcgcaccacgaccgccagcggcaagctgatcaccgagtggtgctgccggtcctgcaccctcccgccgcccaagtaccgcggggaggacggctgctggtacggcatggagatccggcccctgaaggagaaggaggagaacctggtgagcagcctcgtcacggcggggcacggccagatcgacaacttctccctggggatcctgggcatggccctcttcctggaggagatgctgcgcacccgggtggggaccaagcacgccatcctcctggtggccgtcagcttcgtgaccctgatcacgggcaacatgtccttccgcgacctcggccgcgtgatggtcatggtgggggcgaccatgaccgacgacatcggcatgggggtgacctacctggccctgctcgccgccttcaaggtccggcccacgttcgccgcgggcctgctgctccgcaagctgaccagcaaggagctgatgatgaccaccatcggcatcgtgctctccagccagtccagcatccccgagacgatcctggagctgaccgacgccctcgccctggggatgatggtgctgaagatggtccggaacatggagaagtaccagctcgccgtgaccatcatggccatcctgtgcgtgcccaacgcggtcatcctgcagaacgcctggaaggtgtcctgcaccatcctcgccgtcgtgagcgtgagccccctgctgctcacgagctcccagcagaaggccgactggatccccctggccctgaccatcaagggcctcaacccgaccgcgatcttcctgaccacgctgagcgggacctccaagcgccggagctggcccctcaacgaggccatcatggccgtcggcatggtgtccatcctggccagctccctgctcaagaacgacatccccatgaccgggcccctggtggcgggcggcctgctcaccgtctgctacgtgctgacggggcgcagcgccgacctggagctcgagcgggccaccgacgtgaagtgggacgaccaggccgagatcagcggctccagcccgatcctgtccatcaccatcagcgaggacgggtccatgagcatcaagaacgaggaggaggagcagaccctgaccatcctcatccgcacgggcctgctggtcatctccggcctcttccccgtgagcatccccatcaccgccgcggcctggtacctgtgggaggtgaagaagcagcgggccggcgtcctgtgggacgtgccctccccgcccctcgtgggcaaggccgagctggaggacggggcctaccgcatcaagcagaagggcatcctggggtacagccagatcggcgcgggggtctacaaggagggcaccttccacaccatgtggcacgtgacgcggggcgccgtgctcatgcacaaggggaagcgcatcgagccctcctgggccgacgtcaagaaggacctgatcagctacggcgggggctggaagctggagggggagtggaaggagggcgaggaggtccaggtgctcgccctggagccgggcaagaacccccgggccgtccagaccaagcccgggctgttccgcaccaacaccggcacgatcggggcggtgtccctcgacttcagccccggcacctccggcagcccgatcgtggacaagaaggggaaggtcgtgggcctgtacgggaacggcgtggtcacccggtccggggcctacgtgagcgccatcgcccagaccgagaagtccatcgaggacaaccccgagatcgaggacgacatcttccgcaagcggcgcctgacgatcatggacctccaccccggcgccggcaagaccaagcggtacctgcccgcgatcgtgcgcgaggccatcaagcgggggctgcgcaccctcatcctggccccgacccgcgtcgtggccgcggagatggaggaggccctgcggggcctgcccatccgctaccagacgcccgccatccgggccgagcacaccgggcgcgagatcgtggacctcatgtgccacgccaccttcaccatgcggctgctgagccccatccgcgtcccgaactacaacctcatcatcatggacgaggcgcacttcacggaccccgccagcatcgccgcccggggctacatctccacccgcgtggagatgggggaggccgcgggcatcttcatgaccgccacgccgcccggcagccgggacccgttcccccagtccaacgcccccatcatggacgaggagcgcgagatccccgagcggagctggaactccgggcacgagtgggtgacggacttcaagggcaagaccgtctggttcgtgccgagcatcaagaccgggaacgacatcgccgcctgcctgcgcaagaacggcaagcgggtgatccagctgtcccgcaagaccttcgacagcgagtacgtcaagacgcggaccaacgactgggacttcgtggtgaccaccgacatctccgagatgggggcgaacttcaaggccgagcgcgtcatcgacccccggcgctgcatgaagcccgtgatcctcacggacggcgaggagcgggtgatcctggccggccccatgccggtcacccacagctccgccgcgcagcgccgcgggcggatcggccgcaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgggagaaggtggacgccatcgacggggagtaccgcctgcggggcgaggcccgcaagaccctcctggagctgatccggggcgggcccatcccggtgtacctcggctacaagtggcccggggagggcatcaactacgcggactcccgcctgtgcgtcggccggacgcagaacaaccagatcctggaggagaacgtggaggtggagatctggaccaaggaggggaagggcaagaagctcaagccccgctggctggacgcccggatctacagcgaccccctggccctcaaggagttcaaggagttcgccgccgggcgcaagtccctgaccctgaacctcatcaccgagatgggccggctgccgacgttcatgacccagaaggcgcgcgacgccctggacaacctcgccgtcctgcacaccgccgaggccgggggcaaggcgtacaaccacgccctgagcgagctccccgagaccctggagaccctgctcctgctgacgctcctggccaccgtgaccggcgggatcttcctgttcctcatgtccggccgggggatcggcaagatgaccctggggatgtgctgcatcatcacggccagcatcctgctctggtacgcgcagatccagccccactggatcgccgcctccatcatcctggagttcttcctgatcgtcctcctgatccccgagccggagaagcagcgcacgccccaggacaaccagctgacctacgtgatcatcgccatcctcaccgtggtcgccgcgacgatggccaacgagatgggcttcctggagaagaccaagaaggacctgggcctcgggaacatcgccacccagcagcccgagagcaacatcctggacatcgacctgcggcccgccagcgcctggaccctctacgcggtggccacgaccttcatcaccccgatgctgcgccactccatcgagaacagctccgtgaacgtcagcctgaccgccatcgccaaccaggccacggtgctcatgggcctggggaagggctggcccctgtccaagatggacatcggggtgcccctcctggcgatcggctgctacagccaggtcaaccccatcaccctgaccgccgccctcctgctgctcgtggcccactacgccatcatcggcccggggctgcaggcgaaggccacccgggaggcccagaagcgcgccgcggccggcatcatgaagaaccccacggtggacgggatcaccgtcatcgacctggaccccatcccctacgacccgaagttcgagaagcagctcggccaggtgatgctgctggtgctctgcgtcacccaggtgctgatgatgcggaccacgtgggccctgtgcgaggccctcaccctggccaccggccccgtgtccaccctgtgggaggggaaccccggccgcttctggaacacgaccatcctcatccagatggcgaacatcctgcgcgggagctacctggccggcgccgggcccctcttctccatcatggagaacaccaccggcccgcggcgccggacgggccagctggggcgcgagctgctccggcgctggaagtcccggctgaacgccctgggcaagtccgagttccagatctacaagaagtccgggatccaggaggtcgaccgcaccctcgccaaggagggcatcaagcgcggggagaccgaccaccacgcggtgtcccgcggcagcgccaagctgcggtggttcgtggagcgcaacctggtcacccccgagggcaaggtggtggacctcgggtgcggccgcggcgggtggtcctactactgcggcgggctgaagaacgtccgcgaggtgaaggggctgacgaagggcgggcccgggcacgaggagcccatcccgatgagcacctacggctggaacctcgtgcggctgcagtccggggtcgacgtgttcttcatcccgcccgagcgctgcgacaccctgctctgcgacatcggcgagagctccccgaaccccaccgtggaggccggccggaccctgcgcgtcctgaacctcgtggagaactggctgaacaacaacacgcagttctgcatcaaggtgctgaacccctacatgcccagcgtcatcgagaagatggagaccctgcagcggaagtacgggggcgccctcgtgcgcaacccgctgagccgcaactccacccacgagatgtactgggtgagcaacgcctccgggaacatcgtcagctccgtgaacatgatcagccggatgctgatcaaccgcttcaccatgcggcacaagaaggcgacgtacgagcccgacgtggacctcggctccggcacccgcaacatcgggatcgagagcgagatccccaacctggacatcatcggcaagcggatcgagaagatcaagcaggagcacgagacctcctggcactacgaccaggaccacccctacaagacctgggcctaccacgggagctacgagacgaagcagaccggctccgccagctccatggtcaacggggtggtgcgcctgctcaccaagccgtgggacgtcgtgcccatggtgacccagatggccatgacggacaccacccccttcggccagcagcgggtcttcaaggagaaggtggacacccgcatccaggagcccaaggagggcacgaagaagctgatgaagatcatggcggagtggctgtggaaggagctcgggaagaagaagaccccgcggatgtgcacccgcgaggagttcaccaagaaggtgcggagcaacgccgccctgggcgccatcttcacggacgagaacaagtggaagtccgcccgcgaggcggtcgaggacgggcggttctgggagctggtggaccgcgagcggaacctccacctggagggcaagtgcgagacctgcgtgtacaacatgatggggaagcgcgagaagaagctgggcgagttcggcaaggccaaggggagccgggccatctggtacatgtggctcggcgcccgcttcctggagttcgaggccctggggttcctcaacgaggaccactggttctcccgggagaacagcctgtccggcgtcgagggggagggcctgcacaagctcggctacatcctgcgcgaggtgagcaagaaggagggcggcgcgatgtacgccgacgacaccgccgggtgggacacccggatcacgctgggcgccctcaagaacgagcgcaagtgcaccgagcacatggagggcgagccccgcaagcccgggcggggccacttcaagtggcgcaaccagaaccgggtcgtgggggtgcagggccccacccccgggggcaccgtcatggacatcatcagccgcaagaaccagcggggctccggccaggtgggcacgtacgggctgaacaccttcaccaacatggaggcccagctgatccgccagatggagggcgaggggttcttcatcgagcaccagcacctcaccgcgagcgaggagaacgccgtgcaggactggctggcccgggtcggccgcgagaaggtgtcccggatgcccatcagcggcgacgactgcgtggtcaagcccctggacgaccgcttcgcccgggcgctcacggccctgaacgacatggggaaggtgcgcaaggacatccagcagtgggagccctcccggggctggaacgactggacccaggtgccgttctgcagccaccacttccacgagctgatcatgaaggacgggcgcaccctcgtcgtgccctgccggaaccaggacgagctgatcggccgcgcccggatctcccagggggccggctggagcttcggcgagaccgcctgcctggggaagtcctacgcgcagatgtggagcctcatcaacttccgcatccccgacctgcggctggccgccaacgtgatctgctccgtcgtgcccagccactgggtgccgacgtcccgcaccacctggagcatccacgccaaccacgagtggatgaccaccgaggacatgctcacggtctggaaccgcgtgtggatcctggagaacccctggatggaggacaagacccccgtggagtcctgggaggagatcccgtacctggagaagcgggaggaccagtggtgcggcagcctcatcgggctgacgccccagccgccctgggccaagaacatcgagaccgcgatcaaccaggtccgctccctgatcggcaacgaggagtacatcgactacctcccgagcatgaagcggttccgcatcgaggaggaggagagcgggttcctgtggtga

SEQ ID NO: 9138 - RNA, 9876 nt, synthetic construct
  misc_feature 1..9876: note = derived and/or modified CDS sequence (opt1) from DENV-2__JQ922553__SS-prME
  source 1..9876: mol_type = other RNA
accgccggcatgatcatcatgctgatccccaccgtgatggccttccacctcaccacccgcaacgtcgagccgcccatgatcttcagccggcaggagaagggcaagagcttcctgttcaagaccaaggacgggcacgacatgtgcaccttcatggcgatggacctgggggagctctgcgaggacaccatcacctacaagtgccccttcctgaagcagaacgagcccgaggacatcgactgctggtgcaacagcaccagcacctgggtgacctacgggacctgcaccaccaccggggagcaccgccgggagaagcgcagcgtggccctggtcccccacgtgggcatgggcctcgagacccggaccgagacctggatgagcagcgagggggcctggaagcacgtgcagcgcatcgagacctggatcctgcggcaccccggcttcaccatcatggccgccatcctggcgtacaccatcgggaccacgcacttccagcgcgtcctcatcttcatcctgctgaccggcgtggcccccagcatgcggatgcgctgcatcgggatcagcaaccgggacttcgtggagggcgtctccggcgggagctgggtggacatcgtgctcgagcacggctcctgcgtcaccaccatggccaagaacaagcccacgctggacctggagctcatcaagaccgaggccaagcagccggcgaccctgcgcaagtactgcatcgaggccaagctgaccaacacgaccaccgacagccggtgccccacccagggggagcccacgctcaacgaggagcaggacaagcgcttcgtgtgcaagcactccatggtggaccggggctggggcaacgggtgcggcctgttcgggaagggcgccatcgtgacctgcgccatgttcacgtgcaagaagtccatgaaggggaagatcgtgcagcccgagaacctggagtacaccgtggtcatcacgccgcactccggcgaggagtacgccgtgggcaacgacaccgggaagcacggcaaggaggtgaagatcacgccccagagctccatcaccgaggcggagctcaccgggtacggcacggtcaccatggagtgcagcccccgcaccgggctggacttcaacgagatggtgctgctccagatggaggacaaggcctggctggtgcaccggcagtggttcctggacctccccctgccgtggctgcccggcgccgacacccagggctccaactggatccagaaggagacgctcgtcaccttcaagaacccccacgccaagaagcaggacgtggtcgtgctggggagccaggagggcgccatgcacaccgcgctgaccggggccacggagatccagatgagctccggcaacctcctgttcaccgggcacctgaagtgccgcctccggatggacaagctgcagctgaagggcatgagctactccatgtgcaccggcaagttcaaggtggtcaaggagatcgccgagacccagcacgggacgatcgtgatccgcgtgcagtacgagggcgacgggagcccctgcaagatcccgttcgagatcatggacctcgagaagcggcacgtcctgggccgcctgatcaccgtgaaccccatcgtgaccgagaaggactcccccgtcaacatcgaggccgagcccccgttcggcgacagctacatcatcatcggggtggagcccggccagctcaagctggactggttcaagaaggggtccagcatcggccagatgctggagaccacgatgcgcggggccaagcggatggcgatcctcggcgacaccgcctgggacttcggctccctcggcggggtgttcaccagcatcgggaaggccctgcaccaggtcttcggggccatctacggggccgcgttctccggcgtgagctggaccatgaagatcctcatcggcgtgatcatcacgtggatcgggatgaactcccgcagcacctccctgagcgtctccctggtgctggtgggcatcgtcaccctctacctgggggtgatggtgcaggccgacagcggctgcgtcgtgtcctggaagaacaaggagctgaagtgcgggagcggcatcttcgtgaccgacaacgtccacacgtggaccgagcagtacaagttccagcccgagagcccctccaagctcgccagcgccatccagaaggcgcacgaggagggcatctgcgggatccggtccgtgacccgcctggagaacctgatgtggaagcagatcaccctcgagctgaaccacatcctgagcgagaacgaggtgaagctcacgatcatgaccggcgacatcaaggggatcatgcaggtcggcaagcggtccctgcgcccgcagcccaccgagctgcggtacagctggaagacctgggggaaggccaagatgctctccacggagctgcacaaccagaccttcctgatcgacggccccgagaccgccgagtgcccgaacgccaaccgcgcctggaacagcctcgaggtggaggactacggcttccggaagtacaagaccaagatctggcccacgctgaaggagtggcgcaaggtgttctgcgactccaagctgatgagcgcggccatcaaggacaaccgggccgtccacgccgacatggggtactggatcgagtccgccctcaacgacacctggaagatcgagaaggcgagcttcatcgaggtgaagtcctgccactggcccaagagccacaccctgtggggcaacggggtgcaggagtccgagatggtcatccccaagaacttcgccggcccggtgagccagcacaacaaccgccccggctactacacccagaccgccgggccctggcacctgggcaagctcgagatggacttcgacttctgcgaggggacgaccgtggtcgtgaccgaggactgcggcaaccgggggccctccctgcgcaccacgaccgccagcggcaagctgatcaccgagtggtgctgccggagctgcaccctcccgcccctgcgctaccggggcgaggccgggtgctggtactggatggacatccgccccctgaaggagaaggagaagaacctcgtgtccagcctggtcacggcgggccacgggcagatcgacaacttctccctgcggatcctcggcatggccctgttcctggagaagatgctcatgacccgcctggggaccaagcacgccatcctgctcgtggccgtgagcttcgtcaccctgatcacgcgcaacatgtccttcaaggacctgggccgggtgatggtgatggtcggcgcgaccatgaccgacgacatgcgcatgggggtgacctacctcgccctgctgcccgccttcaaggtgcggccgacgttcgccaccggcctcctgctgcgcaagctcaccagcaaggagctgatgatgaccacgatcgggatcgtcctgttctcccagagctccatccccgagaccatcctcgagctgaccgacgccctggcgctcggcatgatggtgctgaagatggtgcggaacatggagaagtaccagctggccgtcaccatcatggccatcctctgcgtgcccaacgccgtcatcctgcagaacgcctggcgcgtgagctgcacgatcctggcggtggtctccgtgagccccctcttcctgacctccagccggcagaaggccgactggatcccgctggccctcaccatcaaggggctgaaccccaccgccatcttcctgacgaccctctcccgcaccagcaagaagcggtcctggcccctgaacgaggccatcatggcggtgggcatggtcagcatcctggcctccagcctcctgaagaacgacatccccatgaccggcccgctggtggccgggggcctcctgacggtgtgctacgtcctgaccgggcgcagcgccgacctcgagctggagcgggcggccgacgtgaagtgggacgaccaggccgagatctccggcagctcccccatcctgagcatcaccatctccgaggacggcagcatgtccatcaagaacgaggaggaggagcagaccctcacgatcctgatccgcaccgggctgctcgtgatcagcggcctgttccccgtctccatccccatcaccgccgccgcgtggtacctgtgggaggtgaagaagcagcgggccggggtgctctgggacgtcccgtccccgccgcccgtgggcaaggccgagctggaggacggggcctaccgcatccagcagaagggcatcttcggctactcccagatcggggccggcgtgtacaaggaggggaccttccccaccatgtggcacgtcacgcggggcgcggtgctgatgcacaaggggaagcgcatcgagcccagctgggccgacgtgaagaaggacctcatctcctacggcggcgggtggaagctggagggcgagtggaaggagggggaggaggtccaggtgctggccctcgagcccggcaagaacccccgggccgtgcagaccaagcccgggctgttcaagaccaacaccggcacgatcggcgccgtcagcctggacttctcccccgggaccagcggctcccccatcgtggacaagaaggggaaggtggtcggcctctacgggaacggcgtggtgacccgcagcggcgcgtacgtctccgccatcgcccagaccgagaagtccatcgaggactacccggaggtggagatggacatcttccggaagaagcgcctgacgatcatggacttccaccccggggccggccggcagaagcgctacttccccgccatcgtgcgcgaggcgatcaagcgggggctgcgcaccctcatcctggcccccacccgggtcgtggccgccgagatggaggaggcgctgcgcggcctgccgatccggtaccagacccccgccatccgcgccgagcacacgggccgggagatcgtggacctcatgtgccacgccaccttcaccatgcgcctgctgagccccatccgggtccccaactacaacctcatcatcatggacgaggcccacttcaccgacccggcgtccatcgccgcccgcgggtacatcagcacgcgggtggagatgggcgaggccgccgggatcttcatgaccgcgacgccgcccggctcccgcgaccccttcccgcagagcaacgcccccatcatggacgaggagcgggagatccccgagcgctcctggaacagcgggcacgagtgggtgaccgacttcaagggcaagatcgtctggttcgtgccctccctgaagacgggcaagtacatcgccgcctgcctgcggaagaacgggaagcgcgtgatccagctcagccggaagaccttcgactccgagtacgtcaagacccgcaccaacgactgggacttcgtggtgacgaccgacatcagcgagatgggcgccaacttcaaggcggagcgggtcatcgacccgcgccgctgcatgaagcccgtgatcctgaccgacggggaggagcgggtgatcctggccggccccatgcccgtcacccactccagcgccgcccagcgccgggggcgcatcggccggaacccgaagaacgagaacgaccagtacatctacatgggcgagcccctcgagaacgacgaggactgcgcgcactggaaggaggccaagatgctgctggacaacatcaacacgcccgaggggatcatcccgtccatgttcgagcccgagcgcgagaaggtggacgccatcgacggcgagtaccggctccgcggggaggcccggaagaccctgctggagctcatccgcggcgggcccatccccgtgtacctgggctacaagtggccgggcgaggggatcaactacgccgacagccggctgtgcttcgacggcatcaagaacaaccagatcctcgaggagaacgtcgaggtggagatctggaccaaggagggggagcgcaaggagctgaagccccggtggctggacgcgcgcatctactccgaccccctcgccctgaaggagttcaaggagttcgccgccggccgcaagagcctgaccctcaacctgatcacggagatggggcgcctgcccaccttcatgacccagaaggcccggggcgcgctcgcctccctgatggtcctgcacaccgccgaggccggcgggcgcgcctacaaccacgcgctcagcgagctgccggagacgctggagaccctcctgctgctcaccctgctggccaccgtgacgggcgggatcttcctcttcctgatgtccggccggggcatcgggaagatgaccctgggcatgtgctgcatcatcaccgccagcatcctcctgtggtacgcccagatccagccccactggatcgcggccagcatcatcctggagttcttcctcaccgtgctgctgatccccgagcccgagaagcagcgcaccccgcaggacaaccagctcacgtacgtcatcatcgccatcctgaccgtggtggccgccaccatggcgaacgagatggggttcctggagaagaccaagaaggacctcggcctggggaacatcgccacgcagcagtcctgcaagaagatcctggacatctacctcggccccgccctgccctggaagctgtacgccggcgggaccaccttcatcacccccatgctccggcacagcatcgagaactccagcgtcaacgtgtccctgacggccatcgcgaaccaggccaccgtgctgatgggcctcgggaagggctggccgctgagcaagatggacatcggggtccccctgctcgccatcggctgctactcccaggtgaaccccatcaccctgaccgccgccctgttcctcctggtggcgcactacgccatcatcggccccgggctgcaggccaagccgacgcgcgaggcccagaagcgcgccgcggccggcatcatgaagaaccccaccgtcgacgggatcaccgtgatcgacctcgaccccatcccctacgacccgaagttcgagaagcagctgggccaggtgatgctgctcgtcctgtgcgtgacccaggtgctgatgatgcggacgacctgggccctctgcgaggccctgaccctggcgaccgggcccgtcagcacgctctgggagggcaaccccggccgcttctggaacaccaccatcgccgtgtccatggccaacatcttccgggggagctacctggccggcgccgggctgctgttctccatcatgaagaacaccacgagcacccgccggggcaccggcaacatcggggagaccctgggcgagaagtggaagtcccgcctgaacgcgctcggcaagagcgagttccagatctacaagaagtccggcatccaggaggtggaccggacgctggccaaggaggggatcaagcgcggcgagaccgaccaccacgccgtcagccggggctccgccaagctgcgctggttcgacgagcggaacctcgtgacccccgaggggaaggtggtcgacctgggctgcgggcgcggcgggtggagcttcttctgcggcggcctgaagaacgtgcgggaggtgaaggccctcaccatcgggggcccggggcacgaggagcccatcctgatgtccacgtacggccgcaacctggtccggagccagagcggggtggtggtcttccacacgccgcccgagaagtgcgacacctccctccgcgacatcggcgagagctcccccaaccccaccgtggaggcgggccggacgctgcgcgtgctgaacctcgtcgagaactggctgaacaacaacacccagttctgcatcaaggtgctgaacccctacatgcccagcgtgatcgagaagatggaggccctccagcggaagtacgggggcgccctggtccgcaaccccctgtcccgcaacagcacccacgagatgtactgggtgtccaacgccagcgggaacatcgtgtccagcgtcaacatgatctcccggatgctgatcaaccgcttcaccatgcggcacaagaaggccacctacgagcccgacgtggacctcggcagcgggacgcgcaacatcggcatcgagtccgagacccccaacctggacatcatcggcaagcggatcgagaagatcaagcaggagcacgagaccagctggcactacgaccaggaccacccgtacaagacctgggggtcccacggcagctacgagacgaagcagaccgggtccgcgagctccatggtgaacggcgtcgtgcgcctgctcaccaagccctgggacgtggtccccatggtgacccagatggccatgacggacaccacccccttcggccagcagcgggtgttcaaggagaaggtcgacacccgcacgcaggagccgaaggaggggaccaagaagctgatgaagatcaccgccgagtggctgtggaaggagctcggcaagaagaagacgccccggatgtgcacgcgcgaggagttcatcaagaaggtgcggagcaacgccgcgctgggggccatcttcaccgacgagaacaagtggaagtccgcccgcgaggccgtggaggacggccggttctgggagctggtcgacaaggagcgcaacctccacctggaggggaagtgcgagacctgcgtgtacaacatgatgggcaagcgggagaagaagctgggcgagttcgggaaggccaagggctcccgcgcgatctggtacatgtggctcggggcccggttcctggagttcgaggccctgggcttcctcaacgaggaccactggttcagccgcgagaactccctgagcggggtcgagggcgagggcctgcacaagctcgggtacatcctgcgggaggtgtccaagaaggagggcggggccatgtacgccgacgacaccgcgggctgggacacgcgcatcaccctggaggacctcaagaacgaggagcggaagaccaaccacatgggcggcgagcaccgcaagctggcccgcggcatcttcaagatgaacctgaccaacaaggtggtccgggtgcagcgccccacgcccgggggcaccctcatggacatcatcagccggaagacccagcgcgggtccgagcaggtcggcacctacggcctgacgaccctgaccaacctcgaggccccgcccatccggcagatggaggggaagggcgtcttcaaggggcaccagcaccgcaccgccagcgaggagaacgccgtgcaggactggctggcgcgggtgggcggggagcgcctgtcccggctcgccatcagcggcgacgactgcgtcgtgaagcccctggacgaccgcttcgcccgggccctgacggcgctcaacgacatgggcaaggtgcgcaaggacatccagcagtgggagccctcccgggggtggaacgactggacccaggtcccgttctgcagccaccacttccacgagctgatcatgaaggacggccgcaccctggtggtgccctgccggaaccaggacgagctcatcgggcgcgcccggatctcccagggcgccgggtggagcctgcgcgagaccgcctgcctgggcaagttctacgcccagcggtggtccctcatgtacttccaccgccgcgacctgcggctggcgcccaacgccatctgcagcgccgtccgcacgcactgggtgcccacctcccggaagacctggccgatccacgccagccacgactggatgaccaccgaggtgatgctcacggtctggaacaagctgtggttccaggagaacccctggatggaggacaagacccccgtgggcttctgggaggagatcccgttcctggagaaggggaaggaccagtggggcgggagcctcatcggcctgacctcccggccgccctgggccaagaacttccagcccgcgatcaaccaggtgcggagcctgctctgcaacgaggagtccgccgacttcatgccgagcatgaagcgcttccggcgcgaggaggaggaggccggggtcctgtggtga

SEQ ID NO: 9139 - RNA, 9876 nt, synthetic construct
  misc_feature 1..9876: note = derived and/or modified CDS sequence (opt1) from DENV-2__JQ922549__SS-prME
  source 1..9876: mol_type = other RNA
accgccggcgtgatcatcatgctgatccccaccgccatggcgttccacctgaccacccgcaacggggagccccacatgatcgtgagccggcaggagaagggcaagagcctgctgttcaagaccgaggacggggtgaacatgtgcaccctcatggccatggacctgggcgagctgtgcgaggacaccatcacctacaactgccccctcctgcgccagaacgagcccgaggacatcgactgctggtgcaacagcaccagcacctgggtgacgtacgggacctgcaccgcccccggcgaccaccggcgcgagaagcggagcgtcgccctggtgccccacgtgggcatggggctcgagacccgcacggagacctggatgagcagcgagggcgcctggaagcacgcgcagcggatcgagacctggatcctgcgccaccccgggttcaccatcatggccgccatcctggcctacacgatcggcaccacctacttccagcgggtcctcatcctgatcctgctcaccgcggtggccccctccatgacgatgcgctgcatcgggatcagcaaccgggacttcgtggagggcgtctccggcgggagctgggtggacatcgtgctggagcacggctcctgcgtcaccaccatggccaagaacaagcccaccctggacttcgagctcatcaagacggaggccaagcagcccgccaccctgaccaagtactgcatcgaggcgaagctgaccaacacgaccaccgccagccgctgccccacccagggggagccctccctcaacgaggagcagcacaagcggttcgtgtgcaagcacagcatggtggaccgcggctggggcaacgggtgcggcctgttcgggaagggcgggatcgtcacgtgcgccatgttcacgtgcaagaagaacatgaagggcaagatcgtgcagcccgagaacctggagtacaccatcgtggtcaccccgcactccggcgaggagaacgccgtggggaacgacacgggcaagcacgggaaggagatcaaggtgcggccccagagctccatcaccgaggccgagctcaccggctacgggaccgtcaccatggagtgcagcccccgcacgggcttcgcgttcaacgagatggtgctgctgcagatggagaacaaggcctggctcgtgcaccggcagtggttcctggacctgcccctcccctggctgcccggcgccgacacccaggggtccaactggatccagaaggagaccctggtcaccttcaagaacccccacgccaagaagcaggacgtggtcgtgctcggcagccaggagggggccatgcacacggcgctgaccggcgccaccgagatccagatgagctccgggaacctgctgttcaccggccacctgaagtgccgcctgcggatggacaagctccagctgaagggcatgagctactccatgtgcacggggaagttcaaggtggtcaaggagatcgccgagacccagcacggcaccatcgtgatccgcgtgcagtacgagggggacggcagcccctgcaagatcccgttcgagatcatggacctggagaagcggctcgtcctgggccgcctgatcaccgtgaaccccatcgtgacggagaaggactcccccgtcaacatcgaggccgagcccccgttcggggacagctacatcatcatcggcgtggagcccgggcagctcaagccctcctggttcaagaagggcagctccatccgccagatgttcgagaccaccatgcgcggggcgaagcgcatggcgatcctgggcgacaccgcctgggacttcggcagcctcgggggcgtgttcacgtccatcgggaaggccctccaccaggtcttcggcgccatctacggggcggccttcagcggcgtgtcctggaccatgaagatcctgatcggcgtggtcatcacctggatcgggaccaacagccggtccacgagcctgtccgtgagcctggtgctcgtcggcgtggtgaccctgtacctgggggtcatggtgcaggccgactccggctgcgtggtcagctggaagaacaaggagctcaagtgcgggagcggcatcttcatcaccgacaacgtgcacacctggacggagcagtacaagttccagcccgagtccccgagcaagctggcctccgccatccagaaggcgcacgaggagggcatctgcgggatccgcagcgtgacccggctggagaacctcatgtggaagcagatcacccccgagctgaaccacatcctgtccgagaacgaggtcaagctcaccatcatgacgggcgacatcaaggggatcatgcaggccggcaagcgcagcctgcggccccagccgaccgagctgaagtactcctggaagacctgggggaaggccaagatgctcagcaccgagccccacaaccagacgttcctgatcggcggccccgagaccgccgagtgccccaacaccaaccgcgcctggaactccctggaggtggaggactacgggttcggcgtgttcaccacgaacatctggctcaagctgaaggagcggcaggacgtcttctgcgacagcaagctgatgtccgcggccatcaaggacaaccgcgccgtgcacgccgacatggggtactggatcgagagcgccctcaacgacacctggaagatcgagaaggcgtccttcatcgaggtcaagagctgccactggccgaagtcccacaccctgtggagcaacggcgtgctggagtccgagatgatcatccccaagaacttcgccggccccgtgagccagcacaactaccggcccgggtaccacacccagaccgccggcccgtggcacctcgggaagctggagatggacttccacttctgcgagggcacgaccgtggtcgtgaccgaggactgcgggaaccgcggccccagcctgcggaccacgaccgcctccggcaagctcatcaccgagtggtgctgccgcagctgcaccctgccgcccctgcggtaccgcggggaggacggctgctggtacgggatggagatccggccgctcgagggcgaggagggggacctggtgcactccctggtcacggcgggccacggccagatcgacaacttcagcctcggggtgctgggcatggccctgttcctcgaggagatgctgcgcacccgggtggggaccaagcacgccgtcctgctcgtggccgtgtccttcatgaccctgatcacgggcaacatgagcttccgcgacctggggcgcgtcatggtgatggtgggcgccgcgatgaccgacgacatcggcatgggggtcacctacctcgccctgctggccgccttcaaggtgcggcccaccttcgccgcgggcctcctgctgcgcaagctcacgtccaaggagctgatgatgaccaccatcgggatcgtgctgctcagccagtccaccatccccgagacgatcctggagctgaccgacgccctcgccctgggccggatgatcctgaagatcgtccgcaacatggagaagtaccagctcgccgtgaccatcatggccatcctgtgcgtccccaacgcggtgatcctgcagaacgcctggaaggtgagctgcaccatcctcgccgtcgtgtccgtgagcccgctgctgctcacgtccagccagcagaaggccgactggatccccctggcgctgaccatcaagggcctcaaccccaccgccatcttcctgaccacgctgtcccggaccaacaagaagcgcagctggcccctcaacgaggccatcatggccgtcgggatggtgtccatcctggccagctccctgctcgagaacgacatcccgatgaccggccccctggtggccgggggcctgctcaccgtctgctacgtgctgacggggcggagcgccgacctggagctcgagcgcgccgccgacgtgcggtgggaggaccaggccgagatcagcggctccagccccatcctgtccatcaccatcagcgaggacggctccatgagcatcaagtacgaggaggaggagcccaccctgaccatcctcatccgcacggggctgctggtcatctccggcctcttcccggtgagcatccccatcaccgcggccgcctggtacctgtgggaggtgaagaagcagcgggccggggtcctgtgggacgtgccctccccgccgcccgtgggcaaggccgagctcgaggacggggcgtaccgcatcaagcagaagggcatcctgggcagctcccagatcggggcccgggtctacaaggagggcaccttccacaccatgtggcacgtgacccgcggggccgtgctgatgcacaagggcaagcggatcgagcccagctgggccgacgtccgcaaggacctcatctcctacgggggcggctggaagctggagggggagtggaaggagggcgaggaggtccaggtgctggccctcgagccggggaagaacccccgggcggtccagacgaagcccggcctgttcaagaccaacaccgggaccatcggcacggtgagcctggacttctcccccggcaccagcgagtccccgatcgtggacaagaaggggaaggtcgtgggcctctacgggaacggcgtggtcacccgcagcggcacctacgtgtccgccatcgcccagacggagaagtccatcgaggacaaccccgagatcgaggacgacatcttccggaagaagcgcctgaccatcatggacctgcaccccggggccggcaagaccaagcggtacctgcccgcgatcgtgcgcgaggccatcaagcgcgggctccggaccctgatcctggccccgacgcgcgtcgtggccgccgagatggaggaggcgctccggggcctgcccatccgctaccagacccccgccatccgggccgagcacaccgggcgcgagatcgtggacctgatgtgccacgccaccttcacgatgcggctcctgagccccgtccgcgtgccgaactacaacctgatcatcatggacgaggcccacttcaccgaccccgcgtccatcgccgcccggggctacatcagcacccgcgtggagatgggcgaggccgccgggatcttcatgaccgcgacgccgcccggctcccgggacccgttcccccagagcaacgcccccatcatggacgaggagcgcgagatccccgagcggtcctggaacagcgggcacgagtgggtcaccgacttcaagggcaagaccgtgtggttcgtgccgtccatcaaggccgggaacgacatcgccgcgtgcctccgcaagaacggcaagaaggtcatccagctgagccggaagaccttcgactccgagtacatcaagacgcgcaccaacgactgggacttcgtggtgaccaccgacatcagcgagatgggcgccaacttcaaggccgagcgggtcatcgacccccgccggtgcatgaagcccgtgatcctgacggacggggaggagcgcgtgatcctcgccggccccatgccggtcacccactccagcgccgcgcagcgccgggggcgcatcggccggaaccccaagaacgagaacgaccagtacatctacatgggggagcccctggagaacgacgaggactgcgcccactggaaggaggccaagatgctgctcgacaacatcaacaccccggagggcatcatcccctccatgttcgagcccgagcgcgagaaggtggacgccatcgacggcgagtaccggctgcgcggggaggcccggaagaccttcgtggacctgatgcgccggggcgacctccccgtctggctggcgtaccgcgtggccgccgaggggatcaactacgccgaccggcgctggtgcttcgacggcatcaagaacaaccagatcctggaggagaacgtcgaggtggagatctggacgaaggagggggagcggaagaagctcaagccgcgctggctggacgcccggatctacagcgaccccctggcgctcaaggagttcaaggagttcgccgccggccgcaagtccctgaccctgaacctcatcaccgagatgggccggctgcccaccttcatgacgcagaaggcccgcaacgcgctggacaacctcgccgtgctgcacaccgccgaggccgggggccgggcctacaaccacgcgctgagcgagctccccgagaccctggagaccctgctcctgctgacgctcctggccaccgtcaccgggggcatcttcctgttcctcatgtccggcaaggggatcggcaagatgaccctggggatgtgctgcatcatcaccgccagcatcctgctctggtacgcccagatccagccgcactggatcgccgcgtccatcatcctggagttcttcctgatcgtgctcctgatccccgagcccgagaagcagcgcacgccccaggacaaccagctgacctacgtggtcatcgccatcctcaccgtggtggccgccaccatggccaacgagatgggcttcctggagaagacgaagaaggacttcgggctgggcagcatcgcgacccagcagccggagagcaacatcctcgacatcgacctgcggcccgcctccgcctggaccctgtacgccgtcgccaccacgttcatcacccccatgctccgccacagcatcgagaactcccccgtgaacgtgagcctgaccgcgatcgccaaccaggccaccgtcctgatgggcctcgggaagggctggccgctgtccaagatggacatcggggtgccgcccctggccatcggctgctacagccaggtgaaccccatcacgctcaccgcggccctgctgctcctggtcgcccactacgccatcatcgggccgggcctccaggtgaaggccacccgcgaggcgcagaagcgggccgccgccggcatcatgaagaaccccaccgtggacgggatcacggtcatcgacctcgaccccatcccctacgacccgaagttcgagaagcagctgggccagatcatgctgcgcgtgctctgcgtgacccaggtcctgatgatgcggaccacctgggccctgtgcgaggcgctcacgctggccaccgggcccatctccaccctgtgggagggcaaccccgggcgcctcggcaacaccacgatcgccgtgagcatggccaacatcttccggggctcctacctggccggggcgggcctcctgttcagcatcatgaagaacaccaccaacacccgccgggggacgtccaacctgggcgagaccctgggcgagaagtggaagaaccgcctcaacagcctggggaagtccgagttccagatctacaagaagtccggcatccaggaggtggaccggaccctggccaaggaggggatcaagaagggcgagaccgaccaccacgccgtctcccgcgggagcgccaagctccggtggttcgtggagcgcaacctggtgacgcccgagggcaaggtcgtggacctgggctgcgggcggggcgggtggtcctactactgcggcgggctcaagaacgtgcgcgaggtcaagggcctgaccaagggcgggccgggccacgaggagcccatccccatgagcacctacgggtggaacctggtgcggctccagtccggcgaggacgtgttcttcaccccgcccgagaagtgcgacacgctgctgtgcgacatcggggagagcagccccaaccccaccgtcgaggcgggccgcaccctccgggtgctgaacatggtggagaactggctgaacaacaacacccagttctgcatcaaggtcctcaacccgtacatgccctccgtgatcgagaagatggaggccctgcagcgcaagtacggcggggccctggtgcggaaccccctgagccgcaactccacccacgagatgtactgggtcagcaacgcctccggcaacatcgtgagctccgtgaacatgatcagccgcatgctcatcaaccggttcacgatgcgccacaagaaggccacctacgagcccgacgtcgacctggggtccggcacccggaacatcgggatcgagagcgagaccccgaacctggacatcatcggcaagcgcatcgagaagatcaagcaggagcacgagacgtcctggcactacgaccaggaccacccctacaagacctgggcgtaccacggcagctacgagaccaagcagaccgggtccgccagctccctcgtgaacggcgtggtccggctgctgacgaagccctgggacgtgatccccatggtgacccagatggccatgaccgacaccacgccgttcgggcagcagcgcgtcttcaaggagaaggtggacacccggacccaggagcccaaggagggcaccaagaagctcatgaagatcacggccgagtggctgtggaaggagctgggcaagaagaagacgccccggatgtgcacccgggaggagttcagccgcaaggtgcggtccaacgccgcgctcggggccatcttcaccgacgagaacaagtggaagtccgcccgcgaggccgtcgaggacggccggttctgggagctggtggacaaggagcgcatcctgcacctcgaggggaagtgcgagacgtgcgtctacaacatgatgggcaagcgggagaagaagatcggggagttcggcaaggccaagggctcccgcgcgatctggtacatgtggctgggggcccggttcctggagttcgaggccctcggcttcctgaacgaggaccactggttcagccgcgagaacagcctgtccggggtggagggcgaggggctccacaagctgggctacatcctgcgggaggtgagcaagaaggagggcggggccatgtacgcggacgacaccgccggctgggacacccgcatcaccctcgaggacctgaagaacgaggagatggtcacgaaccacatggagggggagcacaagaagctggccgaggccatcttcaagctcacctaccagaacaaggtggtgcgggtccagcgccccaccccgcgcggcaccgtgatggacatcatctcccggcgcgaccagcgggggagcggccaggtgggcacgtacgggctgaacaccttcaccaacatgggcgcccagctgatccgccagatggagggggagggcgtcttcaagggcatccagcacctcaccgcgacggaggagatcgccgtgcaggactggctggcccgggtggggcgcgagcggctgtcccgcatggccatcagcggcgacgactgcgtcgtgaagcccctcgacgaccggttcgcctccgcgctgaccgccctgaacgacatggggaaggtgcgcaaggacatccagcagtgggagcccagccggggctggaacgactggacccaggtccccttctgctcccaccacttccacgagctcatcatgaaggacgggcgcgtgctggtggtcccgtgccggaaccaggacgagctgatcggccgcgcccggatcagccagggcgccgggtggtccctccgcgagaccgcctgcctgggcaagagctacgcgcagatgtggtccctgatgtacttccaccggcgcgacctccggctggccgccaacgccatctgcagcgccgtgccctcccactgggtgcccacgagccgcaccacccgctccatccacgcgcggcaggagtggatgaccaccgaggtcatgctgacggtgtggaaccgcgtgtggatccaggagaacccctggatggaggacaagaccccggtcgagagctgggaggagatcccctacctcgggaagcgggaggaccagtggtgcggcagcctgatcgggctgacctcccgcgccacctgggccaagaacatccagacggccatcaaccaggtgcggagcctcatcggctccgaggagtacaccgactacatgcccagcatgaagcgcttccggcgcgaggaggaggaggcgggcgtgctgtggtga

SEQ ID NO: 9140 - RNA, 9876 nt, synthetic construct
  misc_feature 1..9876: note = derived and/or modified CDS sequence (opt1) from DENV-2__JQ922552__SS-prME
  source 1..9876: mol_type = other RNA
accgcgggcatgatcatcatgctgatccccaccgtgatggccttccacctcaccacccggaacggggagccgcccatgatcgtgagccggcaggagaagggcaagagcctgctgttcaagaccgaggacggggtgaacatgtgcgcgctcatggccatggacctgggcgagcgctgcgaggacaccatcacctacaactgccccctgctcaaccagaacgagcccgaggacatcgactgctggtgcaacagcacctccacctgggtgacctacgggacctgcaccaccaccggcgagctgcggcgcgagaagatcagcgtcgccctggtgccccacgtgggcatggggctcgagacccggaccgagacctggatgtccagcgagggcgcctggaagcacgcccagcgcatcgagatctggatcctgcggcaccccgggttcaccatcatggcggccatcctggcctacacgatcggcacctcccacttccagcgcgtcctcatcttcatcctgctgaccgccatcgcgcccagcatgaccatgcggtgcatcgggatctccaaccgcgacttcgtggagggcgtgagcggcgggtcctgggtcgacatcgtgctcgagcacggcagctgcgtgacgaccatggccaagaacaagcccaccctggacttcgagctgatcaagaccgaggccaagcagccggccacgctccggaagtactgcatcgaggccaagctgaccaacaccaccacggactcccgctgccccacccagggggagcccaccctgaacgaggagcaggacaagcggttcgtctgcaagcacagcatggtggaccgcggctggggcaacgggtgcggcctcttcgggaagggcgggatcgtgacctgcgcgatgttcacgtgcaagaagatcatgaagggcaagatcgtccagcccgagaacctggagtacaccgtggtgatcaccccgcactccggcgaggagcacgccgtcgggaacgacaccggcaagcacgggaaggaggtgaagatcacgccccagagctccatcaccgaggccgagctgaccggctacgggaccgtgaccatggagtgcagcccccggacgggcctcgacttcaacgagatggtcctgctgcagatggaggacaaggcctggctcgtgcaccgccagtggttcctggacctgcccctcccgtggctgcccggcgccgacacccaggggtccaactggatccagaaggagaccctggtgaccttcaagaacccccacgcgaagaagcaggacgtcgtggtcctcggcagccaggagggggccatgcacacggccctgaccggcgccaccgagatccagatgagctccgggaacctcctcttcaccggccacctgaagtgccggctgcgcatggacaagctccagctgaagggcatgagctactccatgtgcacggggaagttcaaggtggtgaaggagatcgccgagacccagcacggcaccatcgtcatccgggtgcagtacgagggggacggcagcccctgcaagatcccgttcgagatcatggacctggagaagcgccacgtgctcggccggctgatcaccgtcaaccccatcgtgacggagaaggactcccccgtgaacatcgaggcggagcccccgttcggggacagctacatcatcatcggcgtcgagcccgggcagctgaagctcaactggttcaagaagggctccagcatcgggcagatgctggagaccaccatgcgcggcgccaagcgcatggccatcctgggcgacaccgcctgggacttcgggtccctcggcggggtgttcacgagcatcggcaaggccctgcaccaggtgttcggggcgatctacggcgccgccttctccggcgtcagctggaccatgaagatcctgaccggggtgatcatcacctggatcggcatgaactcccggagcacgtccctgagcgtgtccctcgtcctggtggggatcgtgaccctgtacctcggcgtcatggtgcaggccgacagcgggtgcgtggtctcctggaagaacaaggagctgaagtgcggcagcggcatcttcgtgaccgacaacgtgcacacctggacggagcagtacatgttccagcccgagagcccctccaagctggcgagcgccatccagaaggcccacgaggaggggatctgcggcatccgctccgtcacccggctcgagaacctgatgtggaagcagatcaccccggagctgaaccacatcctcagcgagaacgaggtgaagctgaccatcatgacgggggacatcaagggcatcatgcaggtcgggaagcgctccctgcggccccagcccaccgagctccgctacagctggaagacctggggccagccgaagatgctgtcccccgagctgcaccaccagaccttcctcatcgacggccccgagacggccgagtgccccaacaccaaccggacctgggacagcctggaggtcgaggactacgggttcggcgtgttcaccacgaagatctggctgcgcctccgggagaagcaggacgtgttctgcgactccaagctgatgagcgccgcgatcaaggacaaccgcgccgtccacgccgacatggggtactggatcgagtccgccctgaacgacacctggaagatcgagaaggccagcttcatcgaggtgaagtcctgccactggcccaagagccacaccctctggtccatgggcgtgctggagagcgagatggtcatccccaagaacttcgcgggccccgtgtcccagcacaaccaccggcccgggatcccgacccagaccgccggcccctggcacctggggaagctcgagatggacttcgacttctgcgagggcacgaccgtggtcgtgaccgaggactgcgggaaccgcggccccagcctgcggaccagcacggcctccggcaagctgatcaccgagtggtgctgccgcagctgcaccctgccgcccctgcggtaccgcggggaggacggctgctggtacgggatggagatccggcccctgaaggagaaggaggagaacctcgtgtccagcctggtcaccgccggccacgggcagatcgacaacttctccctgggcatcctcggcatggccctgttcctggaggagatgctccgcacgcgggtggggaccaagcacgcgatcctgctggtggccgtcagcttcgtgaccctcatcaccggcaacatgtccgggcgcgacctgggccgcgtgatggtcatggtgggggccacgatgaccgacgacatcggcatgggcgtgacctacctggccctcctggcggccttcaaggtccggcccaccttcgccgccgggctgctcctgcgcaagctgacgagcaaggagctcatgatgaccaccatcggcatcgtgctgctgtcccagagctccatccccgagaccatcctcgagctgacggacgccctggcgctcgggatgatggtgctgaagatggtccggaacatggagaagtaccagctggccgtgaccatcatggccatcctctgcgtccccaacgccgtgatcctgcagaacgcctggaaggtgagctgcaccatcctggcgctcgtctccgtgagccccctgttcctgacctccagccagcagaaggccgactggatccccctcgccctgacgatcaagggcctgaaccccaccgccatcttcctcaccaccctgtcccgcacgagcaagaagcggtcctggccgctgaacgaggccatcatggcggtgggcatggtcagcatcctcgccagctccctgctgaagaacgacatccccatgaccgggcccctcgtggccggcgggctgctgaccgtgtgctacgtcctcaccggccgcagcgccgacctggagctggagcgggcggccgacgtgaagtgggacgaccaggccgagatctccgggagctcccccatcctcagcatcacgatctccgaggacggcagcatgtccatcaagaacgaggaggaggagcagaccctgaccatcctgatccgcaccgagctcctggtgatcagcggcctgttcccgatctccatccccatcacggccgccgcgtggtacctctgggaggtcaagaagcagcgggccggggtgctgtgggacgtgcccagcccgccgcccgtcggcaaggccgagctggaggacggggcctaccgcatcaagcagaagggcatcctcgggtactcccagatcggcgccggcgtgtacaaggaggggaccttccacaccatgtggcacgtgacccggggcgcggtcctgatgcacaaggggaagcgcatcgagcccagctgggccgacgtgaagaaggacctgatctcctacggcgggggctggaagctcgagggcgagtggaaggagggggaggaggtgcaggtcctggccctggagccgggcaagaacccccgggccgtgcagaccaagcccggcctcttcaagacgaacaccggcaccatcggggccgtgagcctggacttctcccccggcaccagcggctccccgatcgtcgacaagaaggggaaggtggtgggcctgtacgggaacggcgtcgtgacgcgcagcggcgcgtacgtgagcgccatcgcccagaccgagaagtccatcgaggacaaccccgagatcgaggacgacatcttccggcgcaagaagctgaccatcatggacctccaccccggggccggcaagaccaagcggtacctgcccgccatcgtccgcgaggcgatcaagcgggggctgcgcacgctcatcctggccccgacccgggtggtggccgccgagatggaggaggcgctgcgcggcctccccatccgctaccagacccccgccatccgggccgagcacaccgggcgcgagatcgtcgacctgatgtgccacgccacgttcaccatgcggctgctcagccccatccgcgtgccgaactacaacctgatcatcatggacgaggcccacttcaccgaccccgcgtccatcgccgcccggggctacatcagcacccgcgtggagatgggcgaggccgccgggatcttcatgacggcgacgccgcccggctcccgggacccgttcccccagagcaacgcccccatcatggacgaggagcgcgagatccccgagcggtcctggaacagcgggcacgagtgggtcaccgacttcaagggcaagaccgtgtggttcgtgccgtccatcaagacggggaacgacatcgccgcctgcctgcgcaagaacggcaagcgggtcatccagctcagccgcaagaccttcgactccgagtacgtgaagacccggaccaacgactgggacttcgtggtcacgaccgacatcagcgagatgggcgccaacttcaaggcggagcgcgtgatcgacccccggcgctgcatgaagcccgtgatcctgaccgacggggaggagcgggtcatcctggccggccccatgccggtgacccactccagcgccgcccagcgccgggggcgcatcggccgcaaccccaagaacgagaacgaccagtacatctacatgggggagcccctcgagaacgacgaggactgcgcgcactggaaggaggccaagatgctgctggacaacatcaacacgccggagggcatcatcccctccatgttcgagcccgagcgggagaaggtggacgccatcgacggcgagtaccgcctccgcggggaggcccgcaagaccttcgtcgacctgatgcggcgcggcgacctgcccgtgtggctcgcctaccgggggccggcggagggcatcaactacgccgaccgccggtggtgcttcgacgggatcaagaacagccagttcctggaggagaacgtggaggtcgagatctggccctccggcggcgagcgcaaggagctgaagccccggtggctcgacgcccgcatctacagcgaccccctggccctgaaggagttcaaggagttcgccgcggggcggaagtccctcaccctgaacctgatcaccgagatgggccgcctcccgacgttcatgacccagaaggcccggaacgccctggacaacctggccgtgctccacaccgccgaggccggcgggcgcgcctacaaccacgccctgagcgagctgcccgagaccctcgagacgctgctgctcctgaccctgctcgccaccgtcaccggcgggatcttcctgttcctgatgagcgggcgggggatcggcaagatgacgctcgggatgtgctgcatcatcaccgcgtccatcctgctgtggtacgcccagatccagccccactggatcgccgccagcatcatcctcgagttcttcctgatcgtgctgctcatccccgagccggagaagcagcgcacgccccaggacaaccagctgacctacgtgatcatcgccatcctgaccgtcgtggcggccacgatggccaacgagatgggcttcctcgagaagaccaagaaggacctgggcctggggaacatcgtgacccagcagcccgagtccaacatcctcgacatcgacctgcggcccgccagcgcctggaccctgtacgcggccgccacgaccttcatcaccccgatgctccgccactccatcgagaacagctccgtcaacatgagcctgaccgccatcgccaaccaggcgacggtgctgatgggcctcgggaagggctggcccctgtccaagatggacatcggggtgcccctgctcgccatcggctgctacagccaggtcaaccccatcaccctgaccgccgccctgttcctcctggtggcccactacgcgatcaagggcccggggctgcaggccaaggccacccgggaggcccagaagcgcgcggccgccggcatcatgaagaaccccacggtggacgggatcaccgtcatcgacctcgaccccatcccctacgacccgaagttcgagaagcagctgggccaggtgatgctgctcgtgctgtgcgtcacccaggtgctgatgatgcgcaccacgtgggccctctgcgaggccctgaccctggcgaccgggcccgtgtccaccctctgggagggcaaccccggccggttctggaacacgaccatcgccgtcagcatggccaacatcttccgcgggtcctacctggccggcagctcccaggtgtggcccagcatcaacaacctgaagggcgggcggcgcggcaccggggcccagggcgagaccctcggggagaagtggaagcggcagctgaaccagctgtccaagagcgagttcaacacgtacaagcgctccggcatcatggaggtggaccggagcgaggcgaaggaggggctcaagcgcggcgagaccaccaagcacgccgtcagccggggcaccgccaagctgcgctggttcgtggagcggaacctggtgaagccggaggggaaggtcatcgacctcggctgcgggcgcggcgggtggtcctactactgcgccggcctgaagaaggtgacggaggtgaagggctacaccaagggcgggcccgggcacgaggagcccatcccgatggccacctacggctggaacctggtcaagctccacagcgggaaggacgtgttcttcacgccgcccgagaagtgcgacacgctgctgtgcgacatcggcgagtccagccccaacccgaccgtggaggcgggccggaccctccgcgtcctgaacctggtggagaactggctcaacaacaacacccagttctgcatcaaggtgctgaacccctacatgccctccgtcatcgagaagatggagacgctgcagcggaagtacgggggcgccctggtgcgcaaccccctcagccggaactccacccacgagatgtactgggtgagcaacgcctccgggaacatcgtcagctccgtgaacatgatcagccgcatgctgatcaaccggttcaccatgcgccacaagaaggccacctacgagccggacgtggacctgggctccgggacccgcaacatcggcatcgagagcgagacgcccaacctcgacatcatcggcaagcggatcgagaagatcaagcaggagcacgagacctcctggcactacgaccaggaccacccctacaagacctgggcgtaccacgggagctacgagaccaagcagacgggctccgccagctccatggtcaacggggtggtgcgcctgctgaccaagccctgggacgtcgtgccgatggtgacccagatggccatgaccgacacgacccccttcggccagcagcgggtcttcaaggagaaggtggacacccgcacccaggagcccaaggagggcacgaagaagctcatgaagatcaccgccgagtggctgtggaaggagctggggaagaagaagacgccccggatgtgcccgcgcgaggagttcaccaagaaggtgcggagcaacgccgcgctcggcgccatcttcacggacgccaccaagtggaagtccgcccgcgaggccgtcgaggacgggcggttctgggagctggtggacaaggagcgcaacctgcacctcgagggcaagtgcgagacctgcgtgtacaacatgatggggaagcgggagaagaagctgggcgagttcggcaaggcgaaggggtcccgcgccatctggtacatgtggctgggcgcccggttcctcgagttcgaggccctggggttcctgaacgaggaccactggttcagccgcgagaactccctcagcggcgtcgagggggagggcctgcacaagctgggctacatcctccgggaggtgcgcaagaaggagggcggggccatgtacgcggacgactccgccgggtgggacacccggatcacgctggaggacctgaagaacgaggagcgcatcaccaaccacatggaggtcgagcacaagaagctcgccgtgggccacttcatcctgacctaccccaacaaggtggtccgggtgcagcgccccacccccgtggggacggtcatggacatcatcagccggaagtcccagcgcggcagcggccaggtggggacctacggcctgaacaccttcaccaacctcgaggggccgcgcatccggcagatggagggcgaggagtccttcaagagccaccagctgcagacggccaccgagcgcaacgcggtgcaggactggctggcccgggtcggccgcgagcggctctcccgcatggccatcagcggggacgactgcgtggtgaagcccctggacgaccggttcgcccgcgccctgaccgcgctcaacgacatgggcaaggtccggaaggacatccagcagtgggagccctcccgcgggtggaacgactggacccaggtgcccttctgcagccaccacttccacgagctgatcatgaaggacggccggacgctggtggtcccgtgccgcaaccaggacgagctcatcgggcgggcccgcatctcccagggcgccggctggagcctgcgggagaccgcctgcctggggaagtcctacgcccagatgtggagcctcatgtacttccaccgccgggacctgcgcctggcggccaacgccatctgcagcgccgtgccctcccactgggtgcccaccagccggaccacgtggtccatccacgccagccacgagtgggtcgcgaccgaggacatgctcaccgtgtggaaccgcgtgtggatccaggagaacccgtggatggaggacaagacccccgtcgagtcctgggaggagatcccctacctgggcaagcgcgaggaccagtggtgcgggagcctgatcggcctcacctcccgggccacgtgggccaagaacatccagaccgccatcaaccaggtgcgcagcctgatcgggaacgaggagtacaccgactacatgccctccatgaagcggttccgccgggaggaggaggaggccggcgtgctgtggtga

SEQ ID NO: 9141 - RNA, 9876 nt, synthetic construct
  misc_feature 1..9876: note = derived and/or modified CDS sequence (opt1) from DENV-2__GU131896__SS-prME
  source 1..9876: mol_type = other RNA
tccgccgggatgatcatcatgctgatccccaccgtgatggccttccacctcaccacccggaacggggagccgcacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtgggcatgggcctcgagacgcggaccgagacctggatgtccagcgagggggcctggaagcacgcccagcgcatcgagacctggatcctgcggcaccccggcttcacgatcatggccgcgatcctggcctacaccatcgggaccacccacttccagcgcgccctcatcttcatcctgctgacggccgtcgcgccctccatgaccatgcggtgcatcggcatcagcaaccgcgacttcgtggagggcgtgtccgggggcagctgggtcgacatcgtgctcgagcacgggtcctgcgtgaccaccatggccaagaacaagcccacgctggacttcgagctgatcaagaccgaggccaagcagcccgccaccctccggaagtactgcatcgaggccaagctgaccaacacgaccaccgagagccgctgcccgacccagggcgagccctccctgaaggaggagcaggacaagcggttcgtctgcaagcacagcatggtggaccgcggctgggggaacggctgcggcctgttcggcaagggcgggatcgtgacgtgcgcgatgttcacgtgcaagaagaacatggagggcaagatcgtccagcccgagaacctggagtacaccatcgtggtgacgccccactccggggaggagcacgccgtcggcaacgacacggggaagcacggcaaggagatcaaggtgaccccgcagagctccatcaccgaggccgagctgaccgggtacggcaccgtgacgatggagtgcagcccccggaccggcctcgacttcaacgagatggtcctgctgcagatggagaacaaggcctggctcgtgcaccgccagtggttcctggacctgcccctcccctggctgccgggggccgacaagcagggctccaactggatccagaaggagaccctggtgaccttcaagaacccccacgcgaagaagcaggacgtcgtggtcctcgggagccaggagggcgccatgcacacggccctgaccggggccaccgagatccagatgagctccggcaacctcctcttcaccggccacctgaagtgccggctgcgcatggacaagctccagctgaaggggatgagctactccatgtgcacgggcaagttcaaggtggtgaaggagatcgccgagacccagcacgggaccatcgtcatccggctgcagtacgagggcgacggcagcccctgcaagatccccttcgagatcatggacctcgagaagcgctacgtgctggggcggctgatcaccgtgaacccgatcgtcacggagaaggactcccccgtgaacatcgaggcggagccgcccttcggcgacagctacatcatcatcggggtggagccgggccagctcaagctgaactggttcaagaaggggtccagcatcggccagatgttcgagaccaccatgcgcggcgccaagcgcatggccatcctgggggacaccgcctgggacttcggctccctcgggggcgtcttcacgagcgtggggaaggccctgcaccagatcttcggcgcgatctacggcgccgccttctccggggtgagctggaccatgaagatcctgatcggcgtcatcatcacctggatcgggatgaactcccggagcacctccctgagcgtgtccctcgtgctggtcggcatcgtgacgctgtacctcggggtgatggtccaggccgacagcggctgcgtggtgtcctggaagaacaaggagctgaagtgcggcagcgggatcttcatcaccgacaacgtccacacctggaccgagcagtacaagttccagcccgagagcccctccaagctggcgagcgccatccagaaggcccaggaggagggcatctgcgggatccgctccgtgacgcggctcgagaacctgatgtggaagcagatcacccccgagctgaaccacatcctcgccgagaacgaggtgaagctgaccatcatgaccggcgacatcaaggggatcatgcaggccggcaagcgcagcctgcggccgcagcccacggagctcaagtactcctggaagacctggggcaaggcgaagatgctgagcaccgagtcccacaaccagaccttcctgatcgacgggcccgagacggccgagtgcccgaacaccaaccgcgcctggaacagcctcgaggtcgaggactacggcttcggggtgttcaccaccaacatctggctgaagctgaaggagaagcaggacgccttctgcgactccaagctcatgagcgccgcgatcaaggacaaccgggccgtgcacgccgacatgggctactggatcgagtccgccctgaacgacacgtggaagatcgagaaggccagcttcatcgaggtcaagaactgccactggcccaagtcccacaccctgtggagcaacggcgtgctcgagtccgagatgatcatccccaagaacctggcggggcccgtgagccagcacaactaccgcccgggctaccacacccagaccgccgggccctggcacctgggcaagctcgagatggacttcgacttctgcgacgggaccacggtcatcgtgaccgaggactgcggcaaccggggcccctccctgcgcaccaccacggccagcgggaagctgatcaccgagtggtgctgccggagctgcaccctcccgcccctgcgctaccggggcgaggacgggtgctggtacggcatggagatccgccccctgaaggagaaggaggagaacctcgtgaactccctggtcaccgccgggcacggccaggtggacaacttcagcctgggcgtgctcgggatggcgctgttcctggaggagatgctccggacgcgcgtcggcaccaagcacgccatcctgctggtggccgtgtccttcgtcaccctcatcaccgggaacatgagcttcaaggacctgggccgggtggtggtcatggtgggggccacgatgaccgacgacatcggcatgggcgtgacctacctggccctcctggcggccttcaaggtccgccccaccttcgccgccgggctgctcctgcggaagctgacgtccaaggagctcatgatgaccaccatcggcatcgtgctgctgagccagtccaccatccccgagacgatcctcgagctgaccgacgccctggcgctcgggatgatggtgctgaagatcgtccgcgacatggagaagtaccagctggccgtgaccatcatggccatcctctgcgtgcccaacgccgtcatcctgcagaacgcctggaaggtgagctgcaccatcctggcggtcgtgtccgtgagccccctcctgctgacgtccagccagcagaagaccgactggatccccctcgccctgaccatcaagggcctgaaccccaccgccatcttcctcacgaccctgtcccgcaccaacaagaagcggagctggccgctgaacgaggccatcatggcggtcggcatggtgtccatcctcgccagctccctgctgaagaacgacatccccatgaccgggcccctcgtggccggcgggctgctgacggtctgctacgtgctcaccggccgcagcgccgacctggagctggagcgggccaccgacgtgaagtgggaggaccaggcggagatctccgggagcagccccatcctctccatcaccatcagcgaggacggctccatgagcatcaagaacgaggaggaggagcagacgctgaccatcctgatccgcaccggcctcctggtcatctccgggctgttcccggtgagcatccccatcaccgccgccgcctggtacctctgggaggtgaagaagcagcgggccggcgtcctgtgggacgtgcccagcccgccgcccatggggaaggcggagctggaggacggcgcctaccgcatcaagcagaaggggatcctcggctacagccagatcggcgccggggtgtacaaggagggcaccttccacacgatgtggcacgtcacccgcggggccgtgctgatgcacaagggcaagcgcatcgagccctcctgggccgacgtgaagaaggacctgatcagctacgggggcggctggaagctcgagggggagtggaaggagggcgaggaggtccaggtgctggcgctggagcccgggaagaacccccgggccgtgcagaccaagcccggcctcttcaagaccaacacggggaccatcggcgccgtctccctggacttcagccccggcacctccgggagccccatcatcgacaagaagggcaaggtggtggggctgtacggcaacggcgtcgtgacccgctccggggcctacgtgagcgccatcgcgcagacggagaagtccatcgaggacaaccccgagatcgaggacgacatcttccggaagcgccggctgaccatcatggacctccaccccggcgccgggaagaccaagcgctacctgcccgccatcgtccgggaggccatcaagcgcggcctgcggaccctcatcctggcgccgacgcgcgtggtggccgccgagatggaggaggccctgcgggggctccccatccgctaccagacccccgccatccgggcggagcacaccggccgcgagatcgtcgacctgatgtgccacgccaccttcacgatgcgcctgctcagccccgtgcgggtgccgaactacaacctgatcatcatggacgaggcccacttcaccgaccccgcctccatcgccgcgcgcggctacatcagcacccgggtcgagatgggggaggccgccggcatcttcatgaccgccacgccgcccgggagccgcgacccgttcccccagtccaacgcccccatcatcgacgaggagcgggagatccccgagcgcagctggaactccggccacgagtgggtgaccgacttcaaggggaagaccgtgtggttcgtcccgagcatcaaggcgggcaacgacatcgccgcctgcctgcggaagaacggcaagaaggtgatccagctctcccgcaagaccttcgacagcgagtacgtgaagacgcggaccaacgactgggacttcgtcgtgaccaccgacatctccgagatgggggccaacttcaaggcggaccgcgtgatcgacccccggcgctgcatgaagcccgtcatcctgacggacggcgaggagcgggtgatcctggccgggcccatgccggtgacccacagctccgccgcccagcgccggggccgcatcgggcggaaccccaagaacgagaacgaccagtacatctacatgggcgagcccctcgagaacgacgaggactgcgcccactggaaggaggcgaagatgctgctggacaacatcaacacccccgagggcatcatcccgagcatgttcgagcccgagcgcgagaaggtcgacgccatcgacggggagtaccggctccgcggcgaggcccgcaagaccttcgtggacctgatgcggcgcggggacctgcccgtgtggctcgcctacaaggtcgccgcggagggcatcaactacgccgaccggcgctggtgcttcgacgggatcaagaacaaccagatcctggaggagaacgtggaggtggagatctggacgaaggagggcgagcggaagaagctgaagccgcgctggctcgacgcccggatctactccgaccccctggccctgaaggagttcaaggagttcgccgcgggccgcaagagcctcaccctgaacctgatcaccgagatggggcggctccccaccttcatgacgcagaagacccgcgacgccctggacaacctggccgtcctccacaccgccgaggcgggcgggcgggcctacaaccacgccctgtccgagctgcccgagaccctcgagacgctgctgctcctgaccctgctcgccaccgtgaccggcggcatcttcctgttcctgatgagcgggcgcggcatcgggaagatgaccctcggcatgtgctgcatcatcacggcctccatcctgctgtggtacgcgcagatccagccgcactggatcgccgccagcatcatcctcgagttcttcctgatcgtcctgctcatccccgagcccgagaagcagcggacgccccaggacaaccagctgacctacgtggtgatcgccatcctgaccgtcgtggccgcgacgatggccaacgagatggggttcctcgagaagaccaagaaggacctgggcctgggctccatcgccacccagcagccggagagcaacatcctcgacatcgacctgcgccccgcctccgcctggaccctgtacgcggtggccacgaccttcgtcacccccatgctccggcacagcatcgagaacagctccgtgaacgtgagcctgaccgccatcgccaaccaggccacggtcctgatggggctcggcaaggggtggcccctgtccaagatggacatcggcgtgccgctgctcgcgatcgggtgctacagccaggtgaaccccatcaccctgaccgccgccctgctcctgctggtcgcccactacgcgatcatcggccccggcctccaggccaaggccacccgcgaggcccagaagcgggccgcggccgggatcatgaagaaccccacggtggacggcatcaccgtgatcgacctggacccgatcccctacgaccccaagttcgagaagcagctggggcaggtcatgctcctgatcctgtgcgtgacccaggtgctcatgatgcgcaccacgtgggccctgtgcgaggccctgaccctcgccaccggccccatctccaccctgtgggaggggaacccgggccggttctggaacacgaccatcgcggtcagcatggccaacatcttccgcggctcctacctggccggggccggcctcctgttcagcatcatgaagaacaccaccaacacgcggcgcgggaccggcaacatcggcgagaccctgggggagaagtggaagtcccgcctcaacgccctgggcaagagcgagttccagacctacaagaagtccgggatccaggaggtggaccggacgctggcgaaggagggcatcaagcgcggggagaccgaccaccacgccgtgagccggggctccgccaagctccgctggttcgtcgagcggaacatggtgacccccgagggcaaggtggtcgacctggggtgcggccgcgggggctggagctactactgcgggggcctgaagaacgtgcgggaggtgaagggcctcaccaagggcgggcccgggcacgaggagcccatcccgatgtccacgtacggctggaacctggtccgcctgcagagcggggtggacgtgttcttcatcccgcccgagaagtgcgacaccctcctgtgcgacatcggcgagtccagccccaacccgaccgtcgaggccggccggaccctgcgcgtgctcaacctggtggagaactggctgaacaacaacacccagttctgcatcaaggtcctgaacccctacatgccctccgtgatcgagaagatggaggcgctccagcggaagtacgggggcgccctggtgcgcaacccgctgagccggaacagcacgcacgagatgtactgggtctccaacgccagcgggaacatcgtgtccagcgtgaacatgatctcccgcatgctcatcaaccggttcaccatgcgccacaagaaggccacctacgagcccgacgtcgacctgggcagcgggacccggaacatcggcatcgagtccgagatccccaacctggacatcatcggcaagcgcatcgagaagatcaagcaggagcacgagacgagctggcactacgaccaggaccacccctacaagacctgggcctaccacgggtcctacgagaccaagcagaccggcagcgcgtccagcatggtgaacggggtggtccggctcctgacgaagccgtgggacgtgctgcccaccgtgacccagatggccatgaccgacacgacccccttcggccagcagcgcgtcttcaaggagaaggtggacacccgcacccaggagcccaaggagggcacgaagaagctcatgaagatcaccgccgagtggctgtggaaggagctggggaagaagaagaccccgcggatgtgcacccgcgaggagttcacgcggaaggtgcgctccaacgccgccctcggcgcgatcttcaccgacgagaacaagtggaagtccgcccgggaggccgtcgaggacagccgcttctgggagctggtggacaaggagcggaacctgcacctcgaggggaagtgcgagacctgcgtgtacaacatgatgggcaagcgcgagaagaagctgggggagttcggcaaggccaagggcagccgggccatctggtacatgtggctgggggcgcgcttcctcgagttcgaggccctgggcttcctgaacgaggaccactggttctcccgggagaacagcctctccggggtcgagggcgaggggctgcacaagctgggctacatcctccgcgacgtgagcaagaaggagggcggggccatgtacgccgacgacaccgcgggctgggacacgcggatcaccctggaggacctgaagaacgaggagatggtcaccaaccacatggagggggagcacaagaagctcgccgaggccatcttcaagctgacctaccagaacaaggtggtgcgcgtccagcggcccacgccccgcggcaccgtgatggacatcatcagccggcgcgaccagcgggggtccggccaggtgggcacctacgggctgaacaccttcacgaacatggaggcccagctcatccgccagatggagggcgagggggtcttcaagaacatccagcacctgaccgccaccgaggaggtggcggtgcagaactggctggcccgggtcggccgcgagcgcctcagccggatggccatctccggcgacgactgcgtggtgaagcccctggacgaccgcttcgccaacgccctgaccgcgctcaacgacatggggaagatccggaaggacatccagcagtgggagccgagcaagggctggaacgactggacgcaggtccccttctgctcccaccacttccacgagctgatcatgaaggacgggcgcgtgctggtggtcccctgccggaaccaggacgagctcatcggccgcgcccggatcagccagggggccggctggtccctgcgcgagaccgcctgcctgggcaagagctacgcccagatgtggtccctcatgtacttccaccggcgcgacctgcggctggcggccaacgccatctgcagcgccgtgccctcccactgggtgccgaccagccgcaccacctggtccatccacgccaagcacgagtggatgacgaccgaggacatgctcaccgtctggaaccgggtgtggatccgcgagaacccctggatggaggacaagacccccgtggagagctgggaggagatcccctacctggggaagcgggaggaccagtggtgcggctccctgatcgggctcacgagccgcgcgacctgggccaagaacatccaggccgccatcaaccaggtccggtccctgatcggcaacgaggagtacaccgactacatgccgagcatgaagcgcttccggcgcgaggaggaggaggcgggggtgctgtggtga

SEQ ID NO: 9142 - RNA, 9876 nt, synthetic construct
  misc_feature 1..9876: note = derived and/or modified CDS sequence (opt1) from DENV-2__GU131897__SS-prME
  source 1..9876: mol_type = other RNA
agcgcgggcatgatcatcatgctgatccccaccgtgatggccttccacctcaccacccggaacggggagccccacatgatcgtgggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtggccctggtgccccacgtggggatgggcctcgagacgcggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcatggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctgatcaactccctcgtgaccgccggccacggccaggtggacaacttcagcctgggcgtcctgggcatggccctcttcctggaggagatgctgcggacccgcgtggggacgaagcacgcgatcctcctggtggccgtctccttcgtgaccctgatcaccggcaacatgagcttcaaggacctcgggcgggtggtcgtgatggtgggcgccaccatggccgacgacatcgggatgggcgtcacgtacctggccctgctcgcggccttcaaggtgcgccccaccttcgccgccggcctgctgctccggaagctgacctccaaggagctgatgatgaccacgatcgggatcgtgctcctgagccagtccaccatccccgagaccgtcctggagctcaccgacgccctggcgctgggcatgatggtgctcaagatcgtgcgcaacatggagaagtaccagctggccgtcacgatcatggccatcctgtgcgtgccgaacgccgtcatcctccagaacgcctggaaggtgagctgcaccatcctggcggtggtctccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtgggcatggtctccatcctggccagctccctcctgaagaacgacatccccatgaccggccccctggtggccgggggcctcctgaccgtgtgctacgtcctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtgatctccggcctgttcccgatcagcatccccatcaccgccgccgcctggtacctgtgggaggtcaagaagcagcgggccggggtgctctgggacgtgcccagcccgccgcccatgggcaaggcggagctggaggacggggcctaccgcatcaagcagaagggcatcctggggtacagccagatcggcgccggcgtctacaaggaggggaccttccacaccatgtggcacgtgacccggggcgccgtgctcatgcacaaggggaagcgcatcgagccctcctgggccgacgtcaagaaggacctgatcagctacggcgggggctggaagctggagggcgagtggaaggagggggaggaggtccaggtgctcgcgctggagcccggcaagaacccccgggccgtccagacgaagcccgggctgttcaagaccaacaccggcaccatcggggccgtgtccctcgacttcagccccggcacgtccggcagccccatcatcgacaagaaggggaaggtggtcggcctgtacgggaacggcgtggtgacccgctccggcgcctacgtcagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtggtcgccgccgagatggaggaggccctgcggggcctgcccatccgctaccagacccccgccatccgggcggagcacacggggcgcgagatcgtggacctcatgtgccacgccaccttcaccatgcgcctgctgagccccgtgcgggtcccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtgatggacttcaagggcaagaccgtctggttcgtgccgagcatcaaggcggggaacgacatcgccgcctgcctgcggaagaacggcaagaaggtgatccagctgtcccgcaagacgttcgacagcgagtacgtcaagacccggaccaacgactgggacttcgtggtgaccacggacatctccgagatgggcgccaacttcaaggcggagcgcgtcatcgacccccggcgctgcatgaagcccgtgatcctcaccgacggggaggagcgggtgatcctggccggccccatgccggtcacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacccccgagggcatcatcccgagcatgttcgagcccgagcgcgagaaggtggacgccatcgacggcgagtaccggctgcgcggggaggcccgcaagacgttcgtggacctcatgcggcgcggcgacctgcccgtctggctggcctacaaggtggccgcggaggggatcaactacgccgaccggcgctggtgcttcgacggcatcaagaacaaccagatcctcgaggagaacgtggaggtcgagatctggaccaaggagggggagcggaagaagctgaagccgcgctggctggacgcccggatctactccgaccccctcgccctgaaggagttcaaggagttcgccgcgggccgcaagagcctgaccctcaacctgatcaccgagatgggccggctgcccacgttcatgacccagaagacccgcgacgccctcgacaacctggccgtgctgcacaccgccgaggccggcgggcgggcctacaaccacgccctctccgagctgcccgagacgctggagaccctcctgctgctcaccctgctggccaccgtcaccggcgggatcttcctcttcctgatgagcgggcgcgggatcgggaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacctacgtggtcatcgccatcctgacggtggtggccgcgaccatggccaacgagatgggcttcctggagaagaccaagaaggacctcgggctgggctccatcgccacccagcagccggagagcaacatcctggacatcgacctccgccccgcctccgcctggacgctgtacgcggtcgccaccaccttcgtgacccccatgctgcggcacagcatcgagaacagctccgtgaacgtcagcctcacggccatcgccaaccaggccaccgtgctgatgggcctggggaagggctggcccctctccaagatggacatcggggtgccgctgctggcgatcggctgctacagccaggtcaaccccatcaccctcaccgccgccctgctgctcctggtggcccactacgcgatcatcgggcccggcctgcaggccaaggccacgcgcgaggcccagaagcgggccgcggccggcatcatgaagaaccccaccgtggacgggatcaccgtcatcgacctcgacccgatcccctacgaccccaagttcgagaagcagctgggccaggtgatgctgctcatcctgtgcgtgacccaggtcctgatgatgcgcacgacctgggccctctgcgaggccctgaccctggccaccgggcccatctccacgctctgggagggcaacccggggcggttctggaacaccaccatcgcggtgagcatggccaacatcttccgcggctcctacctggccggcgccgggctcctcttcagcatcatgaagaacaccacgaacacccggcgcggcaccgggaacatcggcgagaccctgggcgagaagtggaagtcccgcctgaacgccctcgggaagtccgagttccagatctacaagaagtccggcatccaggaggtggaccggacgctggcgaaggaggggatcaagcgcggcgagaccgaccaccacgccgtcagccgggggtccgccaagctgcgctggttcgtggagcggaacatggtgacccccgagggcaaggtcgtggacctcggctgcgggcgcggcgggtggagctactactgcggcgggctgaagaacgtgcgggaggtcaagggcctgaccaagggcgggcccggccacgaggagcccatcccgatgtccacgtacgggtggaacctcgtgcgcctgcagagcggcgtggacgtcttcttcatcccgcccgagaagtgcgacaccctgctctgcgacatcggggagtccagccccaacccgaccgtggaggccggccggaccctgcgcgtgctgaacctcgtcgagaactggctgaacaacaacacgcagttctgcatcaaggtgctgaacccctacatgccctccgtgatcgagaagatggaggcgctgcagcggaagtacggcggggccctcgtccgcaacccgctgagccggaacagcacccacgagatgtactgggtgtccaacgccagcggcaacatcgtgtccagcgtcaacatgatctcccgcatgctgatcaaccggttcaccatgcgccacaagaaggccacctacgagcccgacgtggacctcgggagcggcacccggaacatcgggatcgagtccgagatccccaacctggacatcatcggcaagcgcatcgagaagatcaaggaggagcacgagacgagctggcactacgaccaggaccacccctacaagacctgggcctaccacggctcctacgagaccaagcagaccgggagcgcgtccagcatggtgaacggcgtcgtgcggctgctcacgaagccgtgggacgtgctgcccaccgtcacccagatggccatgaccgacacgacccccttcgggcagcagcgcgtgttcaaggagaaggtggacacccgcacccaggagcccaaggagggcacgaagaagctgatgaagatcaccgccgagtggctctggaaggagctgggcaagaagaagaccccgcggatgtgcacccgcgaggagttcacgcggaaggtccgctccaacgccgccctgggggcgatcttcaccgacgagaacaagtggaagtccgcccgggaggccgtggaggactcccgcttctgggagctcgtggacaaggagcggaacctgcacctggagggcaagtgcgagacctgcgtctacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtggagggggagggcctccacaagctggggtacatcctgcgcgacgtcagcaagaaggagggcggcgccatgtacgccgacgacaccgcggggtgggacacgcggatcaccctcgaggacctgaagaacgaggagatggtgaccaaccacatggagggcgagcacaagaagctggccgaggccatcttcaagctcacctaccagaacaaggtggtccgcgtgcagcggcccacgccccgcgggaccgtgatggacatcatcagccggcgcgaccagcggggctccgggcaggtcggcacctacggcctgaacaccttcacgaacatggaggcccagctgatccgccagatggagggggagggcgtgttcaagaacatccagcacctcaccgtgaccgaggaggccgcggtccagaactggctggcccgggtggggcgcgagcgcctgagccggatggccatctccggcgacgactgcgtggtcaagcccctcgacgaccgcttcgccaacgccctgaccgcgctgaacgacatgggcaagatccggaaggacatccagcagtgggagccgagcaaggggtggaacgactggacgcaggtccccttctgctcccaccacttccacgagctcatcatgaaggacggccgcgtgctggtcgtgccctgccggaaccaggacgagctgatcgggcgcgcccggatcagccagggcgccgggtggtccctccgcgagaccgcctgcctgggcaagagctacgcccagatgtggtccctgatgtacttccaccggcgcgacctccggctggcggccaacgccatctgcagcgccgtgccctcccactgggtcccgaccagccgcaccacgtggtccatccacgccaagcacgagtggatgaccaccgaggacatgctgaccgtgtggaaccgggtgtggatccgcgagaacccctggatggaggacaagacccccgtcgagagctgggaggagatcccctacctcggcaagcgggaggaccagtggtgcgggtccctgatcggcctgacgagccgcgcgacctgggccaagaacatccaggccgccatcaaccaggtgcggtccctcatcgggaacgaggagtacaccgactacatgccgagcatgaagcgcttccggcgcgaggaggaggaggcgggcgtgctgtggtga

SEQ ID NO: 9143 - RNA, 9876 nt, synthetic construct
  misc_feature 1..9876: note = derived and/or modified CDS sequence (opt1) from DENV-2__GQ868631__SS-prME
  source 1..9876: mol_type = other RNA
agcgccgggatgatcatcatgctgatccccaccgtgatggccttccacctcaccacccgcaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaagggcgagcaccgccgggagaagcgcagcgtcgccctggtgccccacgtggggatgggcctcgagacccggacggagacctggatgtccagcgagggggcctggaagcacgcccagcgcatcgagacctggatcctgcggcacccgggcttcaccatcatggccgcgatcctggcctacacgatcgggaccacccacttccagcgcgtcctcatcttcatcctgctgaccgccgtggccccctccatgacgatgcggtgcatcggcatcagcaaccgcgacttcgtggagggcgtctccgggggcagctgggtggacatcgtgctcgagcacgggtcctgcgtcaccaccatggcgaagaacaagcccaccctggacttcgagctgatcaagacggaggccaagcagcccgccaccctccggaagtactgcatcgaggccaagctgaccaacaccacgaccgagagccgctgccccacccagggcgagccctccctgaaggaggagcaggacaagcggttcgtgtgcaagcacagcatggtggaccgcggctgggggaacggctgcggcctgttcggcaagggcgggatcgtgacctgcgccatgttcacgtgcaagaagaacatggagggcaagatcgtgcagcccgagaacctggagtacaccatcgtggtcacgccccactccggggaggagcacgcggtgggcaacgacaccgggaagcacggcatggagatcaaggtgacgccgcagagctccatcaccgaggccgagctgaccgggtacggcaccgtcaccatggagtgcagcccccggacgggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacaccgccctgacgggcgccaccgagatccagatgagctccgggaacctcctgttcaccggccacctgaagtgccggctgcgcatggacaagctccagctgaagggcatgagctactccatgtgcaccgggaagttcaaggtggtcaaggagatcgccgagacgcagcacggcaccatcgtgatccgggtgcagtacgagggggacggcagcccctgcaagatccccttcgagatcatggacctggagaagcgctacgtcctcggccggctgatcaccgtgaacccgatcgtgaccgagaaggactcccccgtcaacatcgaggccgagccgcccttcggggacagctacatcatcatcggcgtggagccggggcagctgaagctcaactggttcaagaagggctccagcatcgggcagatgttcgagacgaccatgcgcggcgcgaagcgcatggccatcctgggcgacaccgcctgggacttcgggtccctgggcggggtgttcaccagcatcggcaaggccctccaccaggtcttcggggccatctacggcgtggcgttctccggcgtgagctggacgatgaagatcctgatcggggtcatcatcacctggatcggcatgaactcccggagcacctccctgagcgtgtccctggtgctcgtcgggatcgtgaccctgtacctgggcgtgatggtccaggccgacagcgggtgcgtggtgtcctggaagaacaaggagctcaagtgcggcagcggcatcttcatcacggacaacgtccacacctggaccgagcagtacaagttccagcccgagagcccctccaagctggccagcgccatccagaaggcgcaggaggaggggatctgcggcatccgctccgtgacccggctggagaacctcatgtggaagcagatcacgcccgagctgaaccacatcctggccgagaacgaggtgaagctcaccatcatgaccggggacatcaagggcatcatgcaggccgggaagcgcagcctgcggccgcagcccaccgagctgaagtactcctggaagacgtggggcaaggccaagatgctcagcaccgagtcctacaaccagaccttcctgatcgacggccccgagaccgccgagtgcccgaacacgaaccgcgcgtggaacagcctggaggtcgaggactacgggttcggcgtgttcaccaccaacatctggctcaagctgaaggagaagcaggacgccttctgcgactccaagctgatgagcgccgccatcaaggacaaccgggccgtgcacgcggacatggggtactggatcgagtccgccctcaacgacacctggaagatcgagaaggccagcttcatcgaggtcaagaactgccactggcccaagtcccacacgctgtggagcaacggcgtgctggagtccgagatgatcatccccaagaacctcgccggccccgtgagccagcacaactaccgcccggggtaccacacccagatcgccggcccctggcacctggggaagctggagatggacttcgacttctgcgacggcaccaccgtcatcgtgaccgaggactgcgggaaccggggcccctccctccgcacgaccaccgcgagcggcaagctgatcaccgagtggtgctgccggagctgcacgctgcccccgctccgctaccgcggggaggacggctgctggtacgggatggagatccgccccctgaaggagaaggaggagaacctggtgaactccctcgtcaccgccggccacgggcaggtcgacaacttcagcctgggcgtgctgggcatggccctcttcctggaggagatgctgcggacccgcgtcgggaccaagcacgccatcctcctggtggcggtgtccttcgtcacgctgatcaccggcaacatgagcttcaaggacctcgggcgggtggtggtcatggtgggcgccaccatggccgacgacatcgggatgggcgtgacctacctggccctgctcgccgcgttcaaggtccgccccacgttcgccgccggcctgctgctccggaagctgacctccaaggagctgatgatggccaccatcgggatcgtgctcctgagccagtccaccatccccgagacggtgctggagctcaccgacgccctggcgctgggcatgatggccctcaagatcgtccgcaacatggagaagtaccagctggccgtgaccatcatggccatcctgtgcgtcccgaacgccgtgatcctccagaacgcgtggaaggtgagctgcaccatcctggccgtcgtgtccgtgagccccctgctcctgacgtccagccagcagaagaccgactggatccccctggccctcaccatcaaggggctgaaccccaccgccatcttcctgacgaccctctcccgcaccaacaagaagcggagctggccgctgaacgaggcgatcatggccgtcggcatggtgtccatcctggccagctccctcctgaagaacgacatccccatgaccggccccctggtggccgggggcctcctgacggtctgctacgtgctgaccgggcgcagcgccgacctcgagctggagcgggcgaccgacgtgaagtgggaggaccaggccgagatctccggcagcagccccatcctgtccatcaccatcagcgaggacgggtccatgagcatcaagaacgaggaggaggagcagacgctcaccatcctgatccgcaccggcctgctcgtcatctccggcctgttcccgatcagcatccccatcaccgccgccgcctggtacctgtgggaggtgaagaagcagcgggcgggggtgctctgggacgtccccagcccgccgcccatgggcaaggccgagctggaggacggggcctaccgcatcaagcagaagggcatcctggggtacagccagatcggcgccggcgtgtacaaggaggggacgttccacaccatgtggcacgtgacccggggcgccgtcctcatgcacaaggggaagcgcatcgagccctcctgggcggacgtgaagaaggacctgatcagctacggcgggggctggaagctggagggcgagtggaaggagggggaggaggtgcaggtcctcgccctggagcccggcaagaacccccgggccgtgcagaccaagcccgggctgttcaagaccaacacgggcaccatcggggccgtgtccctcgacttcagccccggcacctccggcagccccatcatcgacaagaaggggaaggtcgtgggcctgtacgggaacggcgtggtcacccgctccggcgcctacgtgagcgcgatcgcccagacggagaagtccatcgaggacaaccccgagatcgaggacgacatcttccggaagcgccggctgaccatcatggacctgcaccccggggccggcaagaccaagcgctacctccccgccatcgtgcgggaggcgatcaagcgcgggctgcggaccctgatcctcgccccgacgcgcgtcgtggccgccgagatggaggaggccctgcggggcctgcccatccgctaccagacccccgcgatccgggccgagcacaccgggcgcgagatcgtggacctcatgtgccacgccaccttcacgatgcgcctgctgagccccgtccgggtgccgaactacaacctcatcatcatggacgaggcccacttcaccgaccccgcctccatcgcggcccgcggctacatcagcacccgggtggagatgggcgaggccgccgggatcttcatgaccgccacgccgcccggcagccgcgacccgttcccccagtccaacgcgcccatcatcgacgaggagcgggagatccccgagcgcagctggaactccgggcacgagtgggtcaccgacttcaagggcaagaccgtgtggttcgtgccgagcatcaaggccgggaacgacatcgccgcctgcctgcggaagaacggcaagaaggtcatccagctgtcccgcaagaccttcgacagcgagtacgtgaagacgcggaccaacgactgggacttcgtggtcaccaccgacatctccgagatgggcgcgaacttcaaggccgagcgcgtgatcgacccccggcgctgcatgaagcccgtgatcctcacggacggggaggagcgggtcatcctggccggccccatgccggtgacccacagctccgccgcccagcgccgggggcgcatcggccggaaccccaagaacgagaacgaccagtacatctacatgggggagcccctggagaacgacgaggactgcgcgcactggaaggaggccaagatgctcctggacaacatcaacacccccgagggcatcatcccgagcatgttcgagcccgagcgcgagaaggtggacgccatcgacggcgagtaccggctgcgcggggaggcccgcaagaccttcgtcgacctcatgcggcgcggcgacctgcccgtgtggctggcctacaaggtggcggccgaggggatcaactacgccgaccggcgctggtgcttcgacggcatcaagaacaaccagatcctcgaggagaacgtcgaggtggagatctggacgaaggagggggagcggaagaagctgaagccgcgctggctggacgcccggatctactccgaccccctcgccctgaaggagttcaaggagttcgcggccggccgcaagagcctgaccctcaacctgatcaccgagatgggccggctgcccaccttcatgacgcagaagacccgcgacgccctcgacaacctggccgtcctgcacaccgcggaggccgggggccgggcctacaaccacgccctctccgagctgcccgagaccctggagacgctcctgctgctcaccctgctggccaccgtgaccgggggcatcttcctcttcctgatgagcggccgcgggatcggcaagatgacgctggggatgtgctgcatcatcaccgcgtccatcctcctgtggtacgcccagatccagccgcactggatcgccgccagcatcatcctggagttcttcctcatcgtgctgctgatccccgagcccgagaagcagcggacgccccaggacaaccagctcacctacgtcgtgatcgccatcctgaccgtggtcgcggccacgatggccaacgagatgggcttcctggagaagaccaagaaggacctcgggctgggctccatcgccacccagcagccggagagcaacatcctggacatcgacctccgccccgcctccgcgtggaccctgtacgccgtggccacgaccttcgtgacccccatgctgcggcacagcatcgagaacagctccgtcaacgtgagcctcaccgccatcgccaaccaggcgacggtgctgatgggcctggggaagggctggcccctctccaagatggacatcggggtcccgctgctggccatcggctgctacagccaggtgaaccccatcaccctcaccgccgccctgctgctcctggtggcgcactacgccatcatcgggcccggcctgcaggccaaggccacccgcgaggcccagaagcgggcggccgccggcatcatgaagaaccccacggtcgacgggatcaccgtgatcgacctcgacccgatcccctacgaccccaagttcgagaagcagctgggccaggtgatgctgctcatcctgtgcgtcacccaggtgctgatgatgcgcaccacgtgggccctctgcgaggccctgaccctggcgaccgggcccatctccaccctctgggagggcaacccggggcggttctggaacacgaccatcgccgtgagcatggccaacatcttccgcggctcctacctggccggcgccgggctcctcttcagcatcatgaagaacaccaccaacacgcggcgcggcaccgggaacatcggcgagaccctgggcgagaagtggaagtcccgcctgaacgcgctcgggaagtccgagttccagatctacaagaagtccggcatccaggaggtcgaccggaccctggccaaggaggggatcaagcgcggcgagacggaccaccacgccgtgagccgggggtccgccaagctgcgctggttcgtggagcggaacatggtcacccccgagggcaaggtggtggacctcggctgcgggcgcggcgggtggagctactactgcggcgggctgaagaacgtccgggaggtgaagggcctgaccaagggcgggcccggccacgaggagcccatcccgatgtccacctacgggtggaacctcgtgcgcctgcagagcggcgtcgacgtgttcttcatcccgcccgagaagtgcgacacgctgctctgcgacatcggggagtccagccccaacccgaccgtggaggcgggccggaccctgcgcgtcctgaacctcgtggagaactggctgaacaacaacacccagttctgcatcaaggtgctgaacccctacatgccctccgtcatcgagaagatggaggccatgcagcggaagtacggcggggccctggtgcgcaacccgctcagccggaacagcacgcacgagatgtactgggtgtccaacgccagcggcaacatcgtctccagcgtgaacatgatctcccgcatgctgatcaaccggttcaccatgcgccacaagaaggccacctacgagcccgacgtggacctggggagcggcacccggaacatcgggatcgagtccgagatccccaacctcgacatcatcggcaagcgcatcgagaagatcaaggaggagcacgagaccagctggcactacgaccaggaccacccctacaagacgtgggcgtaccacggctcctacgagaccaagcagaccgggagcgcctccagcatggtcaacggcgtggtgcggctgctgaccaagccgtgggacgtcctccccacggtgacccagatggccatgaccgacaccacgcccttcgggcagcagcgcgtgttcaaggagaaggtcgacacccgcacccaggagcccaaggagggcaccaagaagctgatgaagatcacggccgagtggctgtggaaggagctcggcaagaagaagaccccgcggatgtgcacccgcgaggagttcacccggaaggtgcgctccaacgccgcgctgggggccatcttcacggacgagaacaagtggaagtccgcccgggaggccgtggaggactcccgcttctgggagctggtcgacaaggagcggaacctccacctggagggcaagtgcgagacctgcgtgtacaacatgatggggaagcgcgagaagaagctgggcgagttcgggaaggccaagggcagccgggcgatctggtacatgtggctcggcgcccgcttcctggagttcgaggccctggggttcctcaacgaggaccactggttctcccgggagaacagcctgtccggcgtcgagggggagggcctgcacaagctcgggtacatcctgcgcgacgtgagcaagaaggagggcggcgccatgtacgcggacgacaccgccgggtgggacacccggatcacgctggaggacctcaagaacgaggagatggtgaccaaccacatggagggcgagcacaagaagctggccgaggccatcttcaagctgacctaccagaacaaggtcgtgcgcgtgcagcggcccacgccccgggggacggtcatggacatcatcagccggcgcgaccagcggggctccggccaggtggggacctacggcctcaacaccttcaccaacatggaggcccagctgatccgccagatggagggggagggcgtgttcaagaacatccagcacctgacggtcaccgaggaggcggccgtgcagaactggctcgcccgggtggggcgcgagcgcctgagccggatggccatctccggcgacgactgcgtcgtgaagcccctggacgaccgcttcgccaacgcgctcaccgccctgaacgacatgggcaagatccggaaggacatccagcagtgggagccgagcaaggggtggaacgactggacccaggtgcccttctgctcccaccacttccacgagctgatcatgaaggacggccgcgtcctcgtggtgccctgccggaaccaggacgagctgatcgggcgcgcccggatcagccagggcgccgggtggtccctgcgcgagacggcctgcctcggcaagagctacgcgcagatgtggtccctgatgtacttccaccggcgcgacctgcggctcgccgccaacgccatctgcagcgccgtcccctcccactgggtgccgaccagccgcaccacctggtccatccacgcgaagcacgagtggatgacgaccgaggacatgctgaccgtgtggaaccgggtctggatccgcgagaacccctggatggaggacaagacccccgtggagagctgggaggagatcccctacctgggcaagcgggaggaccagtggtgcgggtccctcatcggcctgaccagccgcgccacgtgggccaagaacatccaggccgcgatcaaccaggtgcggtccctgatcgggaacgaggagtacaccgactacatgccgagcatgaagcgcttccggcgcgaggaggaggaggccggcgtcctctggtga

SEQ ID NO: 9144 - RNA, 9876 nt, synthetic construct
  misc_feature 1..9876: note = derived and/or modified CDS sequence (opt1) from DENV-2__GU131899__SS-prME
  source 1..9876: mol_type = other RNA
agcgcgggcatgatcatcatgctgatccccaccgtgatggccttccacctcaccacccggaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccgtgaccgccgccgcctggtacctgtgggaggtgaagaagcagcgggccggggtcctctgggacgtgcccagcccgccgcccatgggcaaggcggagctggaggacggggcctaccgcatcaagcagaagggcatcctggggtacagccagatcggcgccggcgtgtacaaggaggggaccttccacaccatgtggcacgtcacccggggcgccgtgctcatgcacaaggggaagcgcatcgagccctcctgggccgacgtgaagaaggacctgatcagctacggcgggggctggaagctggagggcgagtggaaggagggggaggaggtccaggtgctcgcgctggagcccggcaagaacccccgggccgtgcagacgaagcccgggctgttcaagaccaacaccggcaccatcggggccgtctccctcgacttcagccccggcacgtccggcagccccatcatcgacaagaaggggaaggtggtgggcctgtacgggaacggcgtcgtgacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtccgggaggccatcaagcgcgggctgcggaccctgatcctcgcgccgacccgcgtggtggccgccgagatggaggaggccctgcggggcctgcccatccgctaccagacccccgccatccgggcggagcacacggggcgcgagatcgtcgacctcatgtgccacgccaccttcaccatgcgcctgctgagccccgtgcgggtgccgaactacaacctcatcatcatggacgaggcccacttcaccgaccccgcctccatcgccgcgcgcggctacatcagcacgcgggtcgagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtgaccgacttcaagggcaagacggtgtggttcgtcccgagcatcaaggcggggaacgacatcgccgcctgcctgcggaagaacggcaagaaggtgatccagctgtcccgcaagaccttcgacagcgagtacgtgaagacccggaccaacgactgggacttcgtcgtgacgaccgacatctccgagatgggcgccaacttcaaggcggagcgcgtgatcgacccccggcgctgcatgaagcccgtcatcctcaccgacggggaggagcgggtgatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtcgacgccatcgacggcgagtaccggctgcgcggggaggcccgcaagaccttcgtggacctcatgcggcgcggcgacctgcccgtgtggctggcctacaaggtcgccgcggaggggatcaactacgccgaccggcgctggtgcttcgacggcatcaagaacaaccagatcctcgaggagaacatggaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtcctgcacacggccgaggccggcgggcgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtcgtgatcgccatcctgaccgtggtcgccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtggccaccaccttcgtgacgcccatgctgcggcacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcaccctcacggccgccctgctgctcctggtggcccactacgcgatcatcgggcccggcctgcaggccaaggccacccgcgaggcccagaagcgggccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcgcaccacctgggccctctgcgaggccctgaccctggccacggggcccatctccaccctctgggagggcaacccggggcggttctggaacaccaccatcgcggtgagcatggccaacatcttccgcggctcctacctggccggcgccgggctcctcttcagcatcatgaagaacacgaccaacacccggcgcggcaccgggaacatgggcgagacgctgggcgagaagtggaagtcccgcctgaacgccctcgggaagtccgagttccagatctacaagcggtccggcatccaggaggtcgaccgcaccctggcgaaggaggggatcaagcggggcgagaccgaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgacgaagggcgggcccggccacgaggagcccatcccgatgtccacctacgggtggaacctcgtgcggctgcagagcggcgtcgacgtgttcttcatcccgcccgagaagtgcgacaccctgctctgcgacatcggggagtccagccccaacccgaccgtggaggccggccgcacgctgcgggtcctgaacctcgtggagaactggctgaacaacaacacccagttctgcatcaaggtgctgaacccctacatgccctccgtcatcgagaagatggaggcgctgcagcgcaagtacggcggggccctcgtgcggaacccgctgagccgcaacagcacccacgagatgtactgggtgtccaacgccagcggcaacatcgtctccagcgtgaacatgatctcccggatgctgatcaaccgcttcaccatgcggcacaagaaggccacctacgagcccgacgtggacctcgggagcggcacgcgcaacatcgggatcgagtccgagatccccaacctggacatcatcggcaagcggatcgagaagatcaagcaggagcacgagaccagctggcactacgaccaggaccacccctacaagacctgggcctaccacggctcctacgagaccaagcagacggggagcgcgtccagcatggtcaacggcgtggtgcgcctgctcaccaagccgtgggacgtcctgcccaccgtgacccagatggccatgacggacaccacccccttcgggcagcagcgcgtgttcaaggagaaggtcgacacccggacgcaggagcccaaggagggcaccaagaagctgatgaagatcaccgccgagtggctctggaaggagctgggcaagaagaagaccccgcgcatgtgcacgcgggaggagttcacccgcaaggtgcggtccaacgccgccctgggggcgatcttcaccgacgagaacaagtggaagtccgcccgcgaggccgtggaggactcccggttctgggagctcgtcgacaaggagcgcaacctgcacctggagggcaagtgcgagacctgcgtgtacaacatgatggggaagcgggagaagaagctcggcgagttcgggaaggccaagggcagccgcgccatctggtacatgtggctgggcgcgcggttcctggagttcgaggccctcgggttcctgaacgaggaccactggttctcccgcgagaacagcctgtccggcgtcgagggggagggcctccacaagctggggtacatcctgcgggacgtgagcaagaaggagggcggcgccatgtacgccgacgacacggcggggtgggacacccgcatcaccctcgaggacctgaagaacgaggagatggtgaccaaccacatgaagggcgagcacaagaagctggccgaggccatcttcaagctcacgtaccagaacaaggtcgtgcgggtgcagcgccccacgccccgggggaccgtcatggacatcatcagccgccgggaccagcgcggctccggccaggtggggacctacggcctgaacacgttcaccaacatggaggcccagctgatccggcagatggagggggagggcgtgttcaagaacatccagcacctcaccgtcaccgaggaggtggccgtgcagaactggctggcgcgcgtcgggcgcgagcggctgagccgcatggccatctccggcgacgactgcgtggtgaagcccctcgacgaccggttcgccaacgccctgacggccctgaacgacatgggcaagatccgcaaggacatccagcagtgggagccgagcaaggggtggaacgactggacccaggtccccttctgctcccaccacttccacgagctcatcatgaaggacggccgggtgctggtggtcccctgccgcaaccaggacgagctgatcgggcgggcgcgcatcagccagggcgccgggtggtccctccgggagaccgcctgcctgggcaagagctacgcccagatgtggtccctgatgtacttccaccgccgggacctccgcctggccgcgaacgccatctgcagcgccgtgccctcccactgggtgccgaccagccggacgacctggtccatccacgccaagcacgagtggatgaccaccgaggacatgctgaccgtctggaaccgcgtgtggatccgggagaacccctggatggaggacaagacgcccgtggagagctgggaggagatcccctacctcggcaagcgcgaggaccagtggtgcgggtccctgatcggcctgaccagccgggccacctgggcgaagaacatccaggccgccatcaaccaggtccgctccctcatcgggaacgaggagtacaccgactacatgccgagcatgaagcggttccgccgcgaggaggaggaggccggcgtgctgtggtga

SEQ ID NO: 9145 - RNA, 9876 nt, synthetic construct
  misc_feature 1..9876: note = derived and/or modified CDS sequence (opt1) from DENV-2__GU131900__SS-prME
  source 1..9876: mol_type = other RNA
agcgcgggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcatggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaaggacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtcgtggccgccgagatggaggaggccctgcggggcctgcccatccgctaccagacccccgccatccgggcggagcacacggggcgcgagatcgtggacctcatgtgccacgccaccttcaccatgcgcctgctgagccccgtccgggtgccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctgcggaagaacggcaagaaggtcatccagctgtcccgcaagaccttcgacagcgagtacgtgaagacccggaccaacgactgggacttcgtggtcacgaccgacatctccgagatgggcgccaacttcaaggcggagcgcgtgatcgacccccggcgctgcatgaagcccgtgatcctcaccgacggggaggagcgggtcatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccgcaagaccttcgtcgacctcatgcggcgcggcgacctgcccgtgtggctggcctacaaggtggccgcggaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtcctgcacacggccgaggccggcgggcgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtcgtgatcgccatcctgaccgtggtcgccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtggccaccaccttcgtgacgcccatgctgcggcacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcaccctcacggccgccctgctgctcctggtggcccactacgcgatcatcgggcccggcctgcaggccaaggccacccgcgaggcccagaagcgggccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcgcaccacctgggccctctgcgaggccctgaccctggccacggggcccatctccaccctctgggagggcaacccggggcggttctggaacaccaccatcgcggtgagcatggccaacatcttccgcggctcctacctggccggcgccgggctcctcttcagcatcatgaagaacacgaccaacacccggcgcggcaccgggaacatcggcgagacgctgggcgagaagtggaagtcccgcctgaacgccctcgggaagtccgagttccagatctacaagaagtccggcatccaggaggtcgaccggaccctggcgaaggaggggatcaagcgcggcgagaccgaccaccacgccgtgagccgggggtccgccaagctgcgctggttcgtggagcggaacatggtcacccccgagggcaaggtggtggacctcggctgcgggcgcggcgggtggagctactactgcggcgggctgaagaacgtccgggaggtgaagggcctgacgaagggcgggcccggccacgaggagcccatcccgatgtccacctacgggtggaacctcgtgcgcctgcagagcggcgtcgacgtgttcttcatcccgcccgagaagtgcgacaccctgctctgcgacatcggggagtccagccccaacccgaccgtggaggccggccggacgctgcgcgtcctgaacctcgtggagaactggctgaacaacaacacccagttctgcatcaaggtgctgaacccctacatgccctccgtcatcgagaagatggaggcgctgcagcggaagtacggcggggccctcgtgcgcaacccgctgagccggaacagcacccacgagatgtactgggtgtccaacgccagcggcaacatcgtctccagcgtgaacatgatctcccgcatgctgatcaaccggttcaccatgcgccacaagaaggccacctacgagcccgacgtggacctcgggagcggcacgcggaacatcgggatcgagtccgagatccccaacctggacatcatcggcaagcgcatcgagaagatcaaggaggagcacgagaccagctggcactacgaccaggaccacccctacaagacctgggcctaccacggctcctacgagaccaagcagacggggagcgcgtccagcatggtcaacggcgtggtgcggctgctcaccaagccgtgggacgtcctgcccaccgtgacccagatggccatgacggacaccacccccttcgggcagcagcgcgtgttcaaggagaaggtcgacacccgcacgcaggagcccaaggagggcaccaagaagctgatgaagatcaccgccgagtggctctggaaggagctgggcaagaagaagaccccgcggatgtgcacgcgcgaggagttcacccggaaggtgcgctccaacgccgccctgggggcgatcttcaccgacgagaacaagtggaagtccgcccgggaggccgtggaggactcccgcttctgggagctcgtcgacaaggagcggaacctgcacctggagggcaagtgcgagacctgcgtgtacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtcgagggggagggcctccacaagctggggtacatcctgcgcgacgtgagcaagaaggagggcggcgccatgtacgccgacgacacggcggggtgggacacccggatcaccctcgaggacctgaagaacgaggagatggtgaccaaccacatggagggcgagcacaagaagctggccgaggccatcttcaagctcacgtaccagaacaaggtcgtgcgcgtgcagcggcccacgccccgggggaccgtcatggacatcatcagccggcgcgaccagcggggctccggccaggtggggacctacggcctgaacacgttcaccaacatggaggcccagctgatccgccagatggagggggagggcgtgttcaagaacatccagcacctcaccgtcaccgaggaggccgcggtgcagaactggctggcccgggtggggcgcgagcgcctgagccggatggccatctccggcgacgactgcgtcgtgaagcccctcgacgaccgcttcgccaacgccctgacggcgctgaacgacatgggcaagatccggaaggacatccagcagtgggagccgagcaaggggtggaacgactggacccaggtgcccttctgctcccaccacttccacgagctcatcatgaaggacggccgcgtcctggtggtgccctgccggaaccaggacgagctgatcgggcgcgcccggatcagccagggcgccgggtggtccctccgcgagaccgcctgcctgggcaagagctacgcccagatgtggtccctgatgtacttccaccggcgcgacctccggctggcggccaacgccatctgcagcgccgtcccctcccactgggtgccgaccagccgcacgacctggtccatccacgccaagcacgagtggatgaccaccgaggacatgctgaccgtgtggaaccgggtctggatccgcgagaacccctggatggaggacaagacgcccgtggagagctgggaggagatcccctacctcggcaagcgggaggaccagtggtgcgggtccctgatcggcctgaccagccgcgcgacctgggccaagaacatccaggccgccatcaaccaggtgcggtccctcatcgggaacgaggagtacaccgactacatgccgagcatgaagcgcttccggcgcgaggaggaggaggcgggcgtcctgtggtga

SEQ ID NO: 9146 - RNA, 9876 nt, synthetic construct
  misc_feature 1..9876: note = derived and/or modified CDS sequence (opt1) from DENV-2__GU131901__SS-prME
  source 1..9876: mol_type = other RNA
agcgcgggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcatggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtcgtggccgccgagatggaggaggccctgcggggcctgcccatccgctaccagacccccgccatccgggcggagcacacggggcgcgagatcgtggacctcatgtgccacgccaccttcaccatgcgcctgctgagccccgtccgggtgccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctgcggaagaacggcaagaaggtcatccagctgtcccgcaagaccttcgacagcgagtacgtgaagacccggaccaacgactgggacttcgtggtcacgaccgacatctccgagatgggcgccaacttcaaggcggagcgcgtgatcgacccccggcgctgcatgaagcccgtgatcctcaccgacggggaggagcgggtcatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccgcaagaccttcgtcgacctcatgcggcgcggcgacctgcccgtgtggctggcctacaaggtggccgcggaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtcctgcacacggccgaggccggcgggcgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtcgtgatcgccatcctgaccgtggtcgccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtggccaccaccttcgtgacgcccatgctgcggcacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcaccctcacggccgccctgctgctcctggtggcccactacgcgatcatcgggcccggcctgcaggccaaggccacccgcgaggcccagaagcgggccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcgcaccacctgggccctctgcgaggccctgaccctggccacggggcccatctccaccctctgggagggcaacccggggcggttctggaacaccaccatcgcggtgagcatggccaacatcttccgcggctcctacctggccggcgccgggctcctcttcagcatcatgaagaacacgaccaacacccggcgcggcaccgggaacgtcggcgagacgctgggcgagaagtggaagtcccgcctgaacgccctcgggaagtccgagttccagatctacaagaagtccggcatccaggaggtggaccggaccctggcgaaggaggggatcaagcgcggcgagaccgaccaccacgccgtgagccgggggtccgccaagctgcgctggttcgtcgagcggaacatggtgacccccgagggcaaggtggtcgacctcggctgcgggcgcggcgggtggagctactactgcggcgggctgaagaacgtgcgggaggtgaagggcctgacgaagggcgggcccggccacgaggagcccatcccgatgtccacctacgggtggaacctcgtccgcctgcagagcggcgtggacgtgttcttcatcccgcccgagaagtgcgacaccctgctctgcgacatcggggagtccagccccaacccgaccgtcgaggccggccggacgctgcgcgtgctgaacctcgtggagaactggctgaacaacaacacccagttctgcatcaaggtcctgaacccctacatgccctccgtgatcgagaagatggaggcgctgcagcggaagtacggcggggccctcgtgcgcaacccgctgagccggaacagcacccacgagatgtactgggtctccaacgccagcggcaacatcgtgtccagcgtgaacatgatctcccgcatgctgatcaaccggttcaccatgcgccacaagaaggccacctacgagcccgacgtcgacctcgggagcggcacgcggaacatcgggatcgagtccgagatccccaacctggacatcatcggcaagcgcatcgagaagatcaaggaggagcacgagaccagctggcactacgaccaggaccacccctacaagacctgggcctaccacggctcctacgagaccaagcagacggggagcgcgtccagcatggtgaacggcgtggtccggctgctcaccaagccgtgggacgtgctgcccaccgtgacccagatggccatgacggacaccacccccttcgggcagcagcgcgtcttcaaggagaaggtggacacccgcacgcaggagcccaaggagggcaccaagaagctgatgaagatcaccgccgagtggctctggaaggagctgggcaagaagaagaccccgcggatgtgcacgcgcgaggagttcacccggaaggtgcgctccaacgccgccctgggggcgatcttcaccgacgagaacaagtggaagtccgcccgggaggccgtcgaggactcccgcttctgggagctcgtggacaaggagcggaacctgcacctggagggcaagtgcgagacctgcgtctacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtggagggggagggcctccacaagctggggtacatcctgcgcgacgtgagcaagaaggagggcggcgccatgtacgccgacgacacggcggggtgggacacccggatcaccctcgaggacctgaagaacgaggagatggtcaccaaccacatggagggcgagcacaagaagctggccgaggccatcttcaagctcacgtaccagaacaaggtggtgcgcgtccagcggcccacgccccgggggaccgtgatggacatcatcagccggcgcgaccagcggggctccggccaggtggggacctacggcctgaacacgttcaccaacatggaggcccagctgatccgccagatggagggggagggcgtcttcaagaacatccagcacctcaccgtgaccgaggaggccgcggtgcagaactggctggcccgggtcgggcgcgagcgcctgagccggatggccatctccggcgacgactgcgtggtgaagcccctcgacgaccgcttcgccaacgccctgacggcgctgaacgacatgggcaagatccggaaggacatccagcagtgggagccgagcaaggggtggaacgactggacccaggtccccttctgctcccaccacttccacgagctcatcatgaaggacggccgcgtgctggtggtcccctgccggaaccaggacgagctgatcgggcgcgcccggatcagccagggcgccgggtggtccctccgcgagaccgcctgcctgggcaagagctacgcccagatgtggtccctgatgtacttccaccggcgcgacctccggctggcggccaacgccatctgcagcgccgtgccctcccactgggtgccgaccagccgcacgacctggtccatccacgccaagcacgagtggatgaccaccgaggacatgctgaccgtctggaaccgggtgtggatccgcgagaacccctggatggaggacaagacgcccgtggagagctgggaggagatcccctacctcggcaagcgggaggaccagtggtgcgggtccctgatcggcctgaccagccgcgcgacctgggccaagaacatccaggccgccatcaaccaggtccggtccctcatcgggaacgaggagtacaccgactacatgccgagcatgaagcgcttccggcgcgaggaggaggaggcgggcgtgctgtggtga

SEQ ID NO: 9147 - RNA, 9876 nt, synthetic construct
  misc_feature 1..9876: note = derived and/or modified CDS sequence (opt1) from DENV-2__GU131902__SS-prME
  source 1..9876: mol_type = other RNA
agcgcgggcatgatcatcatgctgatccccaccgtgatggccttccacctcaccacccggaacggggagccccacatgatcgtcggcatccaggagaagggcaagagcctgctgttcaagaccgaggacggggtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacggcacgtgcaccaccaccggcgagcaccgccgggagaagcgcagcgtcgccctggtgccccacgtggggatgggcctcgagacgcggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcatggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcgccgagtggtgctgccggagctgcacgctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggaccaagcacgccatcctcctggtcgccgtgtccttcgtgacgctgatcaccggcaacatgagcttcaaggacctcgggcgggtcgtggtgatggtcggcgccaccatggccgacgacatcgggatgggcgtgacctacctggcgctgctcgccgccttcaaggtgcgccccacgttcgccgccggcctgctgctccggaagctgacctccaaggagctgatgatgaccaccatcgggatcgtcctcctgagccagtccacgatccccgagaccgtgctggagctcaccgacgcgctggccctgggcatgatggtgctcaagatcgtccgcaacatggagaagtaccagctggccgtgaccatcatggccatcctgtgcgtcccgaacgccgtgatcctccagaacgcgtggaaggtgagctgcacgatcctggccgtcgtgtccgtgagccccctgctcctgacctccagccagcagaagaccgactggatccccctggccctcaccatcaaggggctgaaccccacggccatcttcctgaccaccctctcccgcaccaacaagaagcggagctggccgctgaacgaggcgatcatggccgtcggcatggtgtccatcctggccagctccctcctgaagaacgacatccccatgacgggccccctggtggccgggggcctcctgaccgtctgctacgtgctgaccgggcgcagcgccgacctcgagctggagcgggcgaccgacgtgaagtgggaggaccaggccgagatctccggcagcagccccatcctgtccatcacgatcagcgaggacgggtccatgagcatcaagaacgaggaggaggagcagaccctcaccatcctgatccgcaccggcctgctcgtcatctccggcctgttcccgatcagcatccccatcacggccgccgcctggtacctgtgggaggtgaagaagcagcgggcgggggtgctctgggacgtccccagcccgccgcccatgggcaaggccgagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggcggacgtgaagaaggacctgatcagctacggcgggggctggaagctggagggcgagtggaaggagggggaggaggtgcaggtcctcgccctggagcccggcaagaacccccgggccgtgcagaccaagcccgggctgttcaagacgaacaccggcaccatcggggccgtgtccctcgacttcagccccggcacctccggcagccccatcatcgacaagaaggggaaggtcgtgggcctgtacgggaacggcgtggtcacgcgctccggcgcctacgtgagcgcgatcgcccagaccgagaagtccatcgaggacaaccccgagatcgaggacgacatcttccggaagcgccggctgaccatcatggacctgcaccccggggccggcaagaccaagcgctacctccccgccatcgtgcgggaggcgatcaagcgcgggctgcggacgctgatcctcgccccgacccgcgtcgtggccgccgagatggaggaggccctgcggggcctgcccatccgctaccagacccccgcgatccgggccgagcacaccgggcgcgagatcgtggacctcatgtgccacgccacgttcaccatgcgcctgctgagccccgtccgggtgccgaactacaacctcatcatcatggacgaggcccacttcaccgaccccgcctccatcgcggcccgcggctacatcagcacccgggtggagatgggcgaggccgccgggatcttcatgacggccacgccgcccggcagccgcgacccgttcccccagtccaacgcgcccatcatcgacgaggagcgggagatccccgagcgcagctggaactccgggcacgagtgggtcaccgacttcaagggcaagaccgtgtggttcgtgccgagcatcaaggccgggaacgacatcgccgcctgcctgcggaagaacggcaagaaggtcatccagctgtcccgcaagacgttcgacagcgagtacgtgaagacccggaccaacgactgggacttcgtggtcaccacggacatctccgagatgggcgcgaacttcaaggccgagcgcgtgatcgacccccggcgctgcatgaagcccgtgatcctcaccgacggggaggagcgggtcatcctggccggccccatgccggtgacccacagctccgccgcccagcgccgggggcgcatcggccggaaccccaagaacgagaacgaccagtacatctacatgggggagcccctggagaacgacgaggactgcgcgcactggaaggaggccaagatgctcctggacaacatcaacacccccgagggcatcatcccgagcatgttcgagcccgagcgcgagaaggtggacgccatcgacggcgagtaccggctgcgcggggaggcccgcaagacgttcgtcgacctcatgcggcgcggcgacctgcccgtgtggctggcctacaaggtggcggccgaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgcggccggccgcaagagcctgaccctcaacctgatcaccgagatgggccggctgcccacgttcatgacccagaagacccgcgacgccctcgacaacctggccgtcctgcacaccgcggaggccgggggccgggcctacaaccacgccctctccgagctgcccgagacgctggagaccctcctgctgctcaccctgctggccaccgtgaccggcgggatcttcctcttcctgatgagcgggcgcgggatcggcaagatgaccctggggatgtgctgcatcatcaccgcgtccatcctcctgtggtacgcccagatccagccgcactggatcgccgccagcatcatcctggagttcttcctcatcgtgctgctgatccccgagcccgagaagcagcggacgccccaggacaaccagctcacctacgtcgtgatcgccatcctgacggtggtcgcggccaccatggccaacgagatgggcttcctggagaagaccaagaaggacctcgggctgggctccatcgccacccagcagccggagagcaacatcctggacatcgacctccgccccgcctccgcgtggacgctgtacgccgtggccaccaccttcgtgacccccatgctgcggcacagcatcgagaacagctccgtcaacgtgagcctcacggccatcgccaaccaggcgaccgtgctgatgggcctggggaagggctggcccctctccaagatggacatcggggtcccgctgctggccatcggctgctacagccaggtgaaccccatcaccctcaccgccgccctgctgctcctggtggcgcactacgccatcatcgggcccggcctgcaggccaaggccacgcgcgaggcccagaagcgggcggccgccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcgcacgacctgggccctctgcgaggccctgaccctggcgaccgggcccatctccacgctctgggagggcaacccggggcggttctggaacaccaccatcgccgtgagcatggccaacatcttccgcggctcctacctggccggcgccgggctcctcttcagcatcatgaagaacaccacgaacacccggcgcggcaccgggaacatcggcgagaccctgggcgagaagtggaagtcccgcctgaacgcgctcgggaagtccgagttccagatctacaagaagtccggcatccaggaggtcgaccggacgctggccaaggaggggatcaagcgcggcgagaccgaccaccacgccgtgagccgggggtccgccaagctgcgctggttcgtggagcggaacatggtcacccccgagggcaaggtggtggacctcggctgcgggcgcggcgggtggagctactactgcggcgggctgaagaacgtccgggaggtgaagggcctgaccaagggcgggcccggccacgaggagcccatcccgatgtccacgtacgggtggaacctcgtgcgcctgcagagcggcgtcgacgtgttcttcatcccgcccgagaagtgcgacaccctgctctgcgacatcggggagtccagccccaacccgaccgtggaggcgggccggaccctgcgcgtcctgaacctcgtggagaactggctgaacaacaacacgcagttctgcatcaaggtgctgaacccctacatgccctccgtcatcgagaagatggaggccctgcagcggaagtacggcggggccctcgtgcgcaacccgctgagccggaacagcacccacgagatgtactgggtgtccaacgccagcggcaacatcgtctccagcgtgaacatgatctcccgcatgctgatcaaccggttcaccatgcgccacaagaaggccacctacgagcccgacgtggacctcgggagcggcacccggaacatcgggatcgagtccgagatccccaacctggacatcatcggcaagcgcatcgagaagatcaaggaggagcacgagacgagctggcactacgaccaggaccacccctacaagacctgggcgtaccacggctcctacgagaccaagcagaccgggagcgcctccagcatggtcaacggcgtggtgcggctgctcacgaagccgtgggacgtcctgcccaccgtgacccagatggccatgaccgacacgacccccttcgggcagcagcgcgtgttcaaggagaaggtcgacacccgcacccaggagcccaaggagggcacgaagaagctgatgaagatcaccgccgagtggctctggaaggagctgggcaagaagaagaccccgcggatgtgcacccgcgaggagttcacgcggaaggtgcgctccaacgccgcgctgggggccatcttcaccgacgagaacaagtggaagtccgcccgggaggccgtggaggactcccgcttctgggagctcgtcgacaaggagcggaacctgcacctggagggcaagtgcgagacctgcgtgtacaacatgatggggaagcgcgagaagaagctcggcgagttcgggaaggccaagggcagccgggcgatctggtacatgtggctgggcgcccgcttcctggagttcgaggccctcgggttcctgaacgaggaccactggttctcccgggagaacagcctgtccggcgtcgagggggagggcctccacaagctggggtacatcctgcgcgacgtgagcaagaaggagggcggcgccatgtacgcggacgacaccgccgggtgggacacgcggatcaccctcgaggacctgaagaacgaggagatggtgaccaaccacatggagggcgagcacaagaagctggccgaggccatcttcaagctcacctaccagaacaaggtcgtgcgcgtgcagcggcccacgccccgcgggaccgtcatggacatcatcagccggcgcgaccagcggggctccggccaggtggggacctacggcctgaacaccttcacgaacatggaggcccagctgatccgccagatggagggggagggcgtgttcaagaacatccagcacctcaccgtcaccgaggaggcggccgtgcagaactggctggcccgggtggggcgcgagcgcctgagccggatggccatctccggcgacgactgcgtcgtgaagcccctcgacgaccgcttcgccaacgcgctgaccgccctgaacgacatgggcaagatccggaaggacatccagcagtgggagccgagcaaggggtggaacgactggacccaggtgcccttctgctcccaccacttccacgagctcatcatgaaggacggccgcgtcctggtggtgccctgccggaaccaggacgagctgatcgggcgcgcccggatcagccagggcgccgggtggtccctccgcgagaccgcctgcctgggcaagagctacgcgcagatgtggtccctgatgtacttccaccggcgcgacctccggctggccgccaacgccatctgcagcgccgtcccctcccactgggtgccgaccagccgcaccacgtggtccatccacgcgaagcacgagtggatgaccaccgaggacatgctgaccgtgtggaaccgggtctggatccgcgagaacccctggatggaggacaagacccccgtggagagctgggaggagatcccctacctcggcaagcgggaggaccagtggtgcgggtccctgatcggcctgacgagccgcgccacctgggccaagaacatccaggccgcgatcaaccaggtgcggtccctcatcgggaacgaggagtacaccgactacatgccgagcatgaagcgcttccggcgcgaggaggaggaggccggcgtcctgtggtga

SEQ ID NO: 9148 - RNA, 9876 nt, synthetic construct
  misc_feature 1..9876: note = derived and/or modified CDS sequence (opt1) from DENV-2__GU131924__SS-prME
  source 1..9876: mol_type = other RNA
agcgcgggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcatggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtcgtggccgccgagatggaggaggccctgcggggcctgcccatccgctaccagacccccgccatccgggcggagcacacggggcgcgagatcgtggacctcatgtgccacgccaccttcaccatgcgcctgctgagccccgtccgggtgccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctgcggaagaacggcaagaaggtcatccagctgtcccgcaagaccttcgacagcgagtacgtgaagacccggaccaacgactgggacttcgtggtcacgaccgacatctccgagatgggcgccaacttcaaggcggagcgcgtgatcgacccccggcgctgcatgaagcccgtgatcctcaccgacggggaggagcgggtcatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccgcaagaccttcgtcgacctcatgcggcgcggcgacctgcccgtgtggctggcctacaaggtggccgcggaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtcctgcacacggccgaggccggcgggcgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtcgtgatcgccatcctgaccgtggtcgccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtggccaccaccttcgtgacgcccatgctgcggcacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcaccctcacggccgccctgctgctcctggtggcccactacgcgatcatcgggcccggcctgcaggccaaggccacccgcgaggcccagaagcgggccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcgcaccacctgggccctctgcgaggccctgaccctggccacggggcccatctccaccctctgggagggcaacccggggcggttctggaacaccaccatcgcggtgagcatggccaacatcttccgcggctcctacctggccggcgccgggctcctcttcagcatcaagaagaacacgaccaacacccggcgcggcaccgggaacatcggcgagacgctgggcgagaagtggaagtcccgcctgaacgccctcgggaagtccgagttccagatctacaagaagtccggcatccaggaggtcgaccggaccctggcgaaggaggggatcaagcgcggcgagaccgaccaccacgccgtgagccgggggtccgccaagctgcgctggttcgtggagcggaacatggtcacccccgagggcaaggtggtggacctcggctgcgggcgcggcgggtggagctactactgcggcgggctgaagaacgtccgggaggtgaagggcctgacgaagggcgggcccggccacgaggagcccatcccgatgtccacctacgggtggaacctcgtgcgcctgcagagcggcgtcgacgtgttcttcatcccgcccgagaagtgcgacaccctgctctgcgacatcggggagtccagccccaacccgaccgtggaggccggccggacgctgcgcgtcctgaacctcgtggagaactggctgaacaacaacacccagttctgcatcaaggtgctgaacccctacatgccctccgtcatcgagaagatggaggcgctgcagcggaagtacggcggggccctcgtgcgcaacccgctgagccggaacagcacccacgagatgtactgggtgtccaacgccagcggcaacatcgtctccagcgtgaacatgatctcccgcatgctgatcaaccggttcaccatgcgccacaagaaggccacctacgagcccgacgtggacctcgggagcggcacgcggaacatcgggatcgagtccgagatccccaacctggacatcatcggcaagcgcatcgagaagatcaaggaggagcacgagaccagctggcactacgaccaggaccacccctacaagacctgggcctaccacggctcctacgagaccaagcagacggggagcgcgtccagcatggtcaacggcgtggtgcggctgctcaccaagccgtgggacgtcctgcccaccgtgacccagatggccatgacggacaccacccccttcgggcagcagcgcgtgttcaaggagaaggtcgacacccgcacgcaggagcccaaggagggcaccaagaagctgatgaagatcaccgccgagtggctctggaaggagctgggcaagaagaagaccccgcggatgtgcacgcgcgaggagttcacccggaaggtgcgctccaacgccgccctgggggcgatcttcaccgacgagaacaagtggaagtccgcccgggaggccgtggaggactcccgcttctgggagctcgtcgacaaggagcggaacctgcacctggagggcaagtgcgagacctgcgtgtacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtcgagggggagggcctccacaagctggggtacatcctgcgcgacgtgagcaagaaggagggcggcgccatgtacgccgacgacacggcggggtgggacacccggatcaccctcgaggacctgaagaacgaggagatcgtgaccaaccacatggagggcgagcacaagaagctggccgaggccatcttcaagctcacgtaccagaacaaggtcgtgcgcgtgcagcggcccacgccccgggggaccgtcatggacatcatcagccggcgcgaccagcggggctccggccaggtggggacctacggcctgaacacgttcaccaacatggaggcccagctgatccgccagatggagggggagggcgtgttcaagaacatccagcacctcaccgtcaccgaggaggccgcggtgcagaactggctggcccgggtggggcgcgagcgcctgagccggatggccatctccggcgacgactgcgtcgtgaagcccctcgacgaccgcttcgccaacgccctgacggcgctgaacgacatgggcaagatccggaaggacatccagcagtgggagccgagcaaggggtggaacgactggacccaggtgcccttctgctcccaccacttccacgagctcatcatgaaggacggccgcgtcctggtggtgccctgccggaaccaggacgagctgatcgggcgcgcccggatcagccagggcgccgggtggtccctccgcgagaccgcctgcctgggcaagagctacgcccagatgtggtccctgatgtacttccaccggcgcgacctccggctggcggccaacgccatctgcagcgccgtcccctcccactgggtgccgaccagccgcacgacctggtccatccacgccaagcacgagtggatgaccaccgaggacatgctgaccgtgtggaaccgggtctggatccgcgagaacccctggatggaggacaagacgcccgtggagagctgggaggagatcccctacctcggcaagcgggaggaccagtggtgcgggtccctgatcggcctgaccagccgcgcgacctgggccaagaacatccaggccgccatcaaccaggtgcggtccctcatcgggaacgaggagtacaccgactacatgccgagcatgaagcgcttccggcgcgaggaggaggaggcgggcgtcctgtggtga

SEQ ID NO: 9149 - RNA, 9876 nt, synthetic construct
  misc_feature 1..9876: note = derived and/or modified CDS sequence (opt1) from DENV-2__GQ868638__SS-prME
  source 1..9876: mol_type = other RNA
tccgccgggatgatcatcatgctgatccccaccgtgatggccttccacctcaccacccggaacggggagccgcacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtgggcatgggcctcgagacgcggaccgagacctggatgtccagcgagggggcctggaagcacgcccagcgcatcgagacctggatcctgcggcaccccggcttcacgatcatggccgcgatcctggcctacaccatcgggaccacccacttccagcgcgccctcatcttcatcctgctgacggccgtcgcgccctccatgaccatgcggtgcatcggcatcagcaaccgcgacttcgtggagggcgtgtccgggggcagctgggtcgacatcgtgctcgagcacgggtcctgcgtgaccaccatggccaagaacaagcccacgctggacttcgagctgatcaagaccgaggccaagcagcccgccaccctccggaagtactgcatcgaggccaagctgaccaacacgaccaccgagagccgctgcccgacccagggcgagccctccctgaaggaggagcaggacaagcggttcgtctgcaagcacagcatggtggaccgcggctgggggaacggctgcggcctgttcggcaagggcgggatcgtgacgtgcgcgatgttcacgtgcaagaagaacatggagggcaagatcgtccagcccgagaacctggagtacaccatcgtggtgacgccccactccggggaggagcacgccgtcggcaacgacacggggaagcacggcaaggagatcaaggtgaccccgcagagctccatcaccgaggccgagctgaccgggtacggcaccgtgacgatggagtgcagcccccggaccggcctcgacttcaacgagatggtcctgctgcagatggagaacaaggcctggctcgtgcaccgccagtggttcctggacctgcccctcccctggctgccgggggccgacaagcagggctccaactggatccagaaggagaccctggtgaccttcaagaacccccacgcgaagaagcaggacgtcgtggtcctcgggagccaggagggcgccatgcacacggccctgaccggggccaccgagatccagatgagctccggcaacctcctcttcaccggccacctgaagtgccggctgcgcatggacaagctccagctgaaggggatgagctactccatgtgcacgggcaagttcaaggtggtgaaggagatcgccgagacccagcacgggaccatcgtcatccggctgcagtacgagggcgacggcagcccctgcaagatccccttcgagatcatggacctcgagaagcgctacgtgctggggcggctgatcaccgtgaacccgatcgtcacggagaaggactcccccgtgaacatcgaggcggagccgcccttcggcgacagctacatcatcatcggggtggagccgggccagctcaagctgaactggttcaagaaggggtccagcatcggccagatgttcgagaccaccatgcgcggcgccaagcgcatggccatcctgggggacaccgcctgggacttcggctccctcgggggcgtcttcacgagcgtggggaaggccctgcaccagatcttcggcgcgatctacggcgccgccttctccggggtgagctggaccatgaagatcctgatcggcgtcatcatcacctggatcgggatgaactcccggagcacctccctgagcgtgtccctcgtgctggtcggcatcgtgacgctgtacctcggggtgatggtccaggccgacagcggctgcgtggtgtcctggaagaacaaggagctgaagtgcggcagcgggatcttcatcaccgacaacgtccacacctggaccgagcagtacaagttccagcccgagagcccctccaagctggcgagcgccatccagaaggcccaggaggagggcatctgcgggatccgctccgtgacgcggctcgagaacctgatgtggaagcagatcacccccgagctgaaccacatcctcgccgagaacgaggtgaagctgaccatcatgaccggcgacatcaaggggatcatgcaggccggcaagcgcagcctgcggccgcagcccacggagctcaagtactcctggaagacctggggcaaggcgaagatgctgagcaccgagtcccacaaccagaccttcctgatcgacgggcccgagacggccgagtgcccgaacaccaaccgcgcctggaacagcctcgaggtcgaggactacggcttcggggtgttcaccaccaacatctggctgaagctgaaggagaagcaggacgccttctgcgactccaagctcatgagcgccgcgatcaaggacaaccgggccgtgcacgccgacatgggctactggatcgagtccgccctgaacgacacgtggaagatcgagaaggccagcttcatcgaggtcaagaactgccactggcccaagtcccacaccctgtggagcaacggcgtgctcgagtccgagatgatcatccccaagaacctggcggggcccgtgagccagcacaactaccgcccgggctaccacacccagaccgccgggccctggcacctgggcaagctcgagatggacttcgacttctgcgacgggaccacggtcatcgtgaccgaggactgcggcaaccggggcccctccctgcgcaccaccacggccagcgggaagctgatcaccgagtggtgctgccggagctgcaccctcccgcccctgcgctaccggggcgaggacgggtgctggtacggcatggagatccgccccctgaaggagaaggaggagaacctcgtgaactccctggtcaccgccgggcacggccaggtggacaacttcagcctgggcgtgctcgggatggcgctgttcctggaggagatgctccggacgcgcgtcggcaccaagcacgccatcctgctggtggccgtgtccttcgtcaccctcatcaccgggaacatgagcttcaaggacctgggccgggtggtggtcatggtgggggccacgatgaccgacgacatcggcatgggcgtgacctacctggccctcctggcggccttcaaggtccgccccaccttcgccgccgggctgctcctgcggaagctgacgtccaaggagctcatgatgaccaccatcggcatcgtgctgctgagccagtccaccatccccgagacgatcctcgagctgaccgacgccctggcgctcgggatgatggtgctgaagatcgtccgcgacatggagaagtaccagctggccgtgaccatcatggccatcctctgcgtgcccaacgccgtcatcctgcagaacgcctggaaggtgagctgcaccatcctggcggtcgtgtccgtgagccccctcctgctgacgtccagccagcagaagaccgactggatccccctcgccctgaccatcaagggcctgaaccccaccgccatcttcctcacgaccctgtcccgcaccaacaagaagcggagctggccgctgaacgaggccatcatggcggtcggcatggtgtccatcctcgccagctccctgctgaagaacgacatccccatgaccgggcccctcgtggccggcgggctgctgacggtctgctacgtgctcaccggccgcagcgccgacctggagctggagcgggccaccgacgtgaagtgggaggaccaggcggagatctccgggagcagccccatcctctccatcaccatcagcgaggacggctccatgagcatcaagaacgaggaggaggagcagacgctgaccatcctgatccgcaccggcctcctggtcatctccgggctgttcccggtgagcatccccatcaccgccgccgcctggtacctctgggaggtgaagaagcagcgggccggcgtcctgtgggacgtgcccagcccgccgcccatggggaaggcggagctggaggacggcgcctaccgcatcaagcagaaggggatcctcggctacagccagatcggcgccggggtgtacaaggagggcaccttccacacgatgtggcacgtcacccgcggggccgtgctgatgcacaagggcaagcgcatcgagccctcctgggccgacgtgaagaaggacctgatcagctacgggggcggctggaagctcgagggggagtggaaggagggcgaggaggtccaggtgctggcgctggagcccgggaagaacccccgggccgtgcagaccaagcccggcctcttcaagaccaacacggggaccatcggcgccgtctccctggacttcagccccggcacctccgggagccccatcatcgacaagaagggcaaggtggtggggctgtacggcaacggcgtcgtgacccgctccggggcctacgtgagcgccatcgcgcagacggagaagtccatcgaggacaaccccgagatcgaggacgacatcttccggaagcgccggctgaccatcatggacctccaccccggcgccgggaagaccaagcgctacctgcccgccatcgtccgggaggccatcaagcgcggcctgcggaccctcatcctggcgccgacgcgcgtggtggccgccgagatggaggaggccctgcgggggctccccatccgctaccagacccccgccatccgggcggagcacaccggccgcgagatcgtcgacctgatgtgccacgccaccttcacgatgcgcctgctcagccccgtgcgggtgccgaactacaacctgatcatcatggacgaggcccacttcaccgaccccgcctccatcgccgcgcgcggctacatcagcacccgggtcgagatgggggaggccgccggcatcttcatgaccgccacgccgcccgggagccgcgacccgttcccccagtccaacgcccccatcatcgacgaggagcgggagatccccgagcgcagctggaactccggccacgagtgggtgaccgacttcaaggggaagaccgtgtggttcgtcccgagcatcaaggcgggcaacgacatcgccgcctgcctgcggaagaacggcaagaaggtgatccagctctcccgcaagaccttcgacagcgagtacgtgaagacgcggaccaacgactgggacttcgtcgtgaccaccgacatctccgagatgggggccaacttcaaggcggaccgcgtgatcgacccccggcgctgcatgaagcccgtcatcctgacggacggcgaggagcgggtgatcctggccgggcccatgccggtgacccacagctccgccgcccagcgccggggccgcatcgggcggaaccccaagaacgagaacgaccagtacatctacatgggcgagcccctcgagaacgacgaggactgcgcccactggaaggaggcgaagatgctgctggacaacatcaacacccccgagggcatcatcccgagcatgttcgagcccgagcgcgagaaggtcgacgccatcgacggggagtaccggctccgcggcgaggcccgcaagaccttcgtggacctgatgcggcgcggggacctgcccgtgtggctcgcctacaaggtcgccgcggagggcatcaactacgccgaccggcgctggtgcttcgacgggatcaagaacaaccagatcctggaggagaacgtggaggtggagatctggacgaaggagggcgagcggaagaagctgaagccgcgctggctcgacgcccggatctactccgaccccctggccctgaaggagttcaaggagttcgccgcgggccgcaagagcctcaccctgaacctgatcaccgagatggggcggctccccaccttcatgacgcagaagacccgcgacgccctggacaacctggccgtcctccacaccgccgaggcgggcgggcgggcctacaaccacgccctgtccgagctgcccgagaccctcgagacgctgctgctcctgaccctgctcgccaccgtgaccggcggcatcttcctgttcctgatgagcgggcgcggcatcgggaagatgaccctcggcatgtgctgcatcatcacggcctccatcctgctgtggtacgcgcagatccagccgcactggatcgccgccagcatcatcctcgagttcttcctgatcgtcctgctcatccccgagcccgagaagcagcggacgccccaggacaaccagctgacctacgtggtgatcgccatcctgaccgtcgtggccgcgacgatggccaacgagatggggttcctcgagaagaccaagaaggacctgggcctgggctccatcgccacccagcagccggagagcaacatcctcgacatcgacctgcgccccgcctccgcctggaccctgtacgcggtggccacgaccttcgtcacccccatgctccggcacagcatcgagaacagctccgtgaacgtgagcctgaccgccatcgccaaccaggccacggtcctgatggggctcggcaaggggtggcccctgtccaagatggacatcggcgtgccgctgctcgcgatcgggtgctacagccaggtgaaccccatcaccctgaccgccgccctgctcctgctggtcgcccactacgcgatcatcggccccggcctccaggccaaggccacccgcgaggcccagaagcgggccgcggccgggatcatgaagaaccccacggtggacggcatcaccgtgatcgacctggacccgatcccctacgaccccaagttcgagaagcagctggggcaggtcatgctcctgatcctgtgcgtgacccaggtgctcatgatgcgcaccacgtgggccctgtgcgaggccctgaccctcgccaccggccccatctccaccctgtgggaggggaacccgggccggttctggaacacgaccatcgcggtcagcatggccaacatcttccgcggctcctacctggccggggccggcctcctgttcagcatcatgaagaacaccaccaacacgcggcgcgggaccggcaacatcggcgagaccctgggggagaagtggaagtcccgcctcaacgccctgggcaagagcgagttccagacctacaagaagtccgggatccaggaggtggaccggacgctggcgaaggagggcatcaagcgcggggagaccgaccaccacgccgtgagccggggctccgccaagctccgctggttcgtcgagcggaacatggtgacccccgagggcaaggtggtcgacctggggtgcggccgcgggggctggagctactactgcgggggcctgaagaacgtgcgggaggtgaagggcctcaccaagggcgggcccgggcacgaggagcccatcccgatgtccacgtacggctggaacctggtccgcctgcagagcggggtggacgtgttcttcatcccgcccgagaagtgcgacaccctcctgtgcgacatcggcgagtccagccccaacccgaccgtcgaggccggccggaccctgcgcgtgctcaacctggtggagaactggctgaacaacaacacccagttctgcatcaaggtcctgaacccctacatgccctccgtgatcgagaagatggaggcgctccagcggaagtacgggggcgccctggtgcgcaacccgctgagccggaacagcacgcacgagatgtactgggtctccaacgccagcgggaacatcgtgtccagcgtgaacatgatctcccgcatgctcatcaaccggttcaccatgcgccacaagaaggccacctacgagcccgacgtcgacctgggcagcgggacccggaacatcggcatcgagtccgagatccccaacctggacatcatcggcaagcgcatcgagaagatcaagcaggagcacgagacgagctggcactacgaccaggaccacccctacaagacctgggcctaccacgggtcctacgagaccaagcagaccggcagcgcgtccagcatggtgaacggggtggtccggctcctgacgaagccgtgggacgtgctgcccaccgtgacccagatggccatgaccgacacgacccccttcggccagcagcgcgtcttcaaggagaaggtggacacccgcgcccaggagcccaaggagggcaccaagaagctcatgaagatcacggccgagtggctgtggaaggagctggggaagaagaagaccccgcggatgtgcacccgcgaggagttcacccggaaggtgcgctccaacgccgcgctcggcgccatcttcacggacgagaacaagtggaagtccgcccgggaggccgtcgaggacagccgcttctgggagctggtggacaaggagcggaacctgcacctcgaggggaagtgcgagacctgcgtgtacaacatgatgggcaagcgcgagaagaagctgggggagttcggcaaggccaagggcagccgggcgatctggtacatgtggctgggggcccgcttcctcgagttcgaggccctgggcttcctgaacgaggaccactggttctcccgggagaacagcctctccggggtcgagggcgaggggctgcacaagctgggctacatcctccgcgacgtgagcaagaaggagggcggggccatgtacgcggacgacaccgccggctgggacacccggatcacgctggaggacctgaagaacgaggagatggtcaccaaccacatggagggggagcacaagaagctcgccgaggccatcttcaagctgacctaccagaacaaggtggtgcgcgtccagcggcccacgccccgcggcaccgtgatggacatcatcagccggcgcgaccagcgggggtccggccaggtgggcacctacgggctgaacaccttcaccaacatggaggcccagctcatccgccagatggagggcgagggggtcttccggaacatccagcacctgacggcgaccgaggaggtggccgtgcagaactggctggcccgcgtcggccgcgagcggctcagccgcatggccatctccggcgacgactgcgtggtgaagcccctggacgaccggttcgccaacgcgctgaccgccctcaacgacatggggaagatccgcaaggacatccagcagtgggagccgagcaagggctggaacgactggacccaggtccccttctgctcccaccacttccacgagctgatcatgaaggacgggcgggtgctggtggtcccctgccgcaaccaggacgagctcatcggccgggcccgcatcagccagggggccggctggtccctgcgggagacggcctgcctgggcaagagctacgcgcagatgtggtccctcatgtacttccaccgccgggacctgcgcctggccgccaacgccatctgcagcgccgtgccctcccactgggtgccgaccagccggaccacctggtccatccacgcgaagcacgagtggatgaccacggaggacatgctcaccgtctggaaccgcgtgtggatccgggagaacccctggatggaggacaagacccccgtggagagctgggaggagatcccctacctggggaagcgcgaggaccagtggtgcggctccctgatcgggctcaccagccgggccacgtgggccaagaacatccaggccgcgatcaaccaggtccgctccctgatcggcaacgaggagtacaccgactacatgccgagcatgaagcggttccgccgcgaggaggaggaggccggggtgctgtggtga

SEQ ID NO: 9150 - RNA, 9876 nt, synthetic construct
  misc_feature 1..9876: note = derived and/or modified CDS sequence (opt1) from DENV-2__GU131927__SS-prME
  source 1..9876: mol_type = other RNA
agcgcggggatgatcatcatgctgatccccaccgtgatggccttccacctcaccacccggaacggggagccccacatgatcgtgggcatccaggagaagggcaagagcctgctgttcaagaccgaggacggggtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacggcacgtgcaccaccaccggcgagcaccggcgggagaagcgcagcgtcgccctggtgccccacgtggggatgggcctcgagacgcggaccgagacctggatgagcagcgagggggcctggaagcacgcccagcgcatcgagacctggatcctgcggcacccgggcttcacgatcatggccgcgatcctggcctacaccatcgggaccacccacttccagcgcgccctcatcttcatcctgctgacggccgtcgcgccctccatgaccatgcggtgcatcggcatcagcaaccgcgacttcgtggagggcgtgtccgggggcagctgggtcgacatcgtgctcgagcacgggtcctgcgtgaccaccatggcccggaacaagcccacgctggacttcgagctgatcaagaccgaggccaagcagcccgccaccctccgcaagtactgcatcgaggccaagctgaccaacacgaccaccgagagccggtgccccacccagggcgagccctccctgaaggaggagcaggacaagcgcttcgtctgcaagcacagcatggtggaccggggctgggggaacggctgcggcctgttcggcaagggcgggatcgtgacgtgcgcgatgttcacgtgcaagaagaacatggagggcaagatcgtccagcccgagaacctggagtacaccatcgtggtgacgccccactccggggaggagcacgccgtcggcaacgacacggggaagcacggcaaggagatcaaggtgaccccgcagagctccatcaccgaggccgagctgaccgggtacggcaccgtgacgatggagtgcagcccccgcaccggcctcgacttcaacgagatggtcctgctgcagatggagaacaaggcctggctcgtgcaccggcagtggttcctggacctgcccctcccctggctgccgggggccgacaagcaggagtccaactggatccagaaggagaccctggtgaccttcaagaacccccacgcgaagaagcaggacgtcgtggtcctcggcagccaggagggggccatgcacacggccctgaccggcgccaccgagatccagatgagctccgggaacctcctgttcaccggccacctgaagtgccgcctgcggatggacaagctccagctgaagggcatgagctactccatgtgcacggggaagttcaaggtggtgaaggagatcgccgagacccagcacggcaccatcgtcatccgcgtgcagtacgagggggacggcagcccctgcaagatccccttcgagatcatggacctggagaagcggtacgtgctcggccgcctgatcaccgtcaacccgatcgtgacggagaaggactcccccgtgaacatcgaggcggagccgcccttcggggacagctacatcatcatcggcgtcgagccggggcagctgaagctcaactggttcaagaagggctccagcatcgggcagatgttcgagaccaccatgcgcggcgccaagcggatggccatcctgggcgacaccgcctgggacttcgggtccctgggcggggtgttcacgagcgtgggcaaggccctccaccaggtcttcggggcgatctacggcgccgccttctccggcgtgagctggaccatgaagatcctgatcggggtgatcatcacctggatcggcatgaactcccgcagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggcgagcgccatccagaaggcccaggaggaggggatctgcggcatccggtccgtcacgcgcctggagaacctcatgtggaagcagatcacccccgagctgaaccacatcctggccgagaacgaggtgaagctcaccatcatgaccggggacatcaagggcatcatgcaggccgggcggcgcagcctgcggccgcagcccacggagctgaagtactcctggaagacctggggcaaggcgaagatgctcagcaccgagtcctacaaccagaccttcctgatcgacggccccgagacgaccgagtgcccgaacgccaaccgcgcctggaacagcctggaggtggaggactacgggttcggcgtcttcaccaccaacatctggctcaagctgaaggagaagcaggacgccttctgcgactccaagctgatgagcgccgcgatcaaggacaaccgggccgtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagagcctcgcgggccccgtgtcccagcacaactaccgcccggggtaccacacccagatcgccggcccctggcacctggggaagctggagatggacttcgacttctgcgacggcaccaccgtgatcgtcacggaggactgcgggaaccggggccccagcctccgcaccaccaccgccagcggcaagctgatcacggagtggtgctgccggtcctgcaccctgcccccgctccgctaccgcggggaggacggctgctggtacgggatggagatccgccccctgaaggagaaggaggagaacctggtgaacagcctcgtgaccgccggccacgggcaggtcgacaacttctccctgggcgtgctgggcatggccctcttcctggaggagatgctgcggacccgcgtggggacgaagcacgccatcctcctggtcgccgtgagcttcgtgaccctgatcaccggcaacatgtccttcaaggacctcgggcgggtcgtggtgatggtcggcgccaccatggccgacgacatcgggatgggcgtgacgtacctggcgctgctcgccgccttcaaggtgcgccccaccttcgccgccggcctgctgctccgcaagctgaccagcaaggagctgatgatgaccacgatcgggatcgtcctcctgtcccagagcaccatccccgagaccatcctggagctcaccgacgcgctggccctgggcatgatggtgctcaagatcgtgcggaacatggagaagtaccagctggccgtcacgatcatggccatcctgtgcgtgccgaacgccgtcatcctccagaacgcgtggaaggtgtcctgcaccatcctggccgtggtcagcgtgagccccctgctcctgaccagctcccagcagaagaccgactggatccccctggccctcacgatcaaggggctgaaccccaccgccatcttcctgaccaccctcagccgcacgaacaagaagcggtcctggccgctgaacgaggcgatcatggccgtgggcatggtcagcatcctggcctccagcctcctgaagaacgacatccccatgaccggccccctggtggccgggggcctcctgaccgtgtgctacgtcctgaccgggcgctccgccgacctcgagctggagcgggcgacggacgtgaagtgggaggagcaggccgagatcagcggcagctcccccatcctgagcatcaccatctccgaggacgggagcatgtccatcaagaacgaggaggaggagcagaccctcaccatcctgatccgcacgggcctgctcgtgatcagcggcctgttcccgatctccatccccatcaccgccgccgcctggtacctgtgggaggtcaagaagcagcgggcgggggtgctctgggacgtgccctccccgccgcccatgggcaaggccgagctggaggacggggcctaccgcatcaagcagaagggcatcctggggtactcccagatcggcgccggcgtctacaaggaggggaccttccacaccatgtggcacgtgacccggggcgccgtgctcatgcacaaggggaagcgcatcgagcccagctgggcggacgtcaagaaggacctgatctcctacggcgggggctggaagctggagggcgagtggaaggagggggaggaggtccaggtgctcgccctggagcccggcaagaacccccgggccgtccagacgaagcccgggctgttcaagaccaacaccggcaccatcggggccgtgagcctcgacttctcccccggcacgagcggctcccccatcatcgacaagaaggggaaggtggtcggcctgtacgggaacggcgtggtgacccgcagcggcgcctacgtctccgcgatcgcccagaccgagaagtccaccgaggacaaccccgagatcgaggacgacatcttccggaagcgccggctgacgatcatggacctgcaccccggggccggcaagaccaagcgctacctccccgccatcgtgcgggaggcgatcaagcgcgggctgcggaccctgatcctcgccccgacccgcgtggtcgccgccgagatggaggaggccctgcggggcctgcccatccgctaccagacgcccgcgatccgcgccgagcacaccgggcgggagatcgtggacctcatgtgccacgccaccttcaccatgcgcctgctgtcccccgtgcgggtcccgaactacaacctcatcatcatggacgaggcccacttcacggaccccgccagcatcgcggcccgcggctacatcagcacccgggtggagatgggcgaggccgccgggatcttcatgaccgccacgccgcccggctcccgcgacccgttcccccagagcaacgcgcccatcatcgacgaggagcgggagatccccgagcgctcctggaacagcgggcacgagtgggtgacggacttcaagggcaagaccgtctggttcgtgccgtccatcaaggccgggaacgacatcgccgcctgcctgcggaagaacggcaagaaggtgatccagctgagccgcaagaccttcgactccgagtacgtcaagacccggacgaacgactgggacttcgtggtgaccaccgacatcagcgagatgggcgcgaacttcaaggccgagcgcgtcatcgacccccggcgctgcatgaagcccgtgatcctcaccgacggggaggagcgggtgatcctggccggccccatgccggtcacgcactccagcgccgcccagcgccgggggcgcatcggccggaaccccaagaacgagaacgaccagtacatctacatgggggagcccctggagaacgacgaggactgcgcgcactggaaggaggccaagatgctcctggacaacatcaacacccccgagggcatcatcccgtccatgttcgagcccgagcgcgagaaggtggacgccatcgacggcgagtaccgcctgcgcggggaggcccgcaagaccttcgtggacctcatgcggcgcggcgacctgcccgtctggctggcctacaaggtggcggccgaggggatcaactacgccgaccggcgctggtgcttcgacggcatcaagaacaaccagatcctcgaggagaacgtggaggtcgagatctggaccaaggagggggagcggaagaagctgaagccgcgctggctggacgcccggatctacagcgaccccctcgccctgaaggagttcaaggagttcgcggccggccgcaagtccctgacgctcaacctgatcaccgagatgggccggctgcccaccttcatgacccagaagacgcgcgacgccctcgacaacctggccgtgctgcacaccgcggaggccgggggccgggcctacaaccacgccctcagcgagctgcccgagaccctggagaccctcctgctgctcacgctgctggccaccgtcaccgggggcatcttcctcttcctgatgtccggccgcgggatcggcaagatgaccctggggatgtgctgcatcatcaccgcgagcatcctcctgtggtacgcccagatccagccgcactggatcgccgcctccatcatcctggagttcttcctcatcgtgctgctgatccccgagcccgagaagcagcggacgccccaggacaaccagctcacctacgtggtcatcgccatcctgaccgtggtggcggccaccatggccaacgagatgggcttcctggagaagacgaagaaggacctcgggctgggcagcatcgccacccagcagccggagtccaacatcctggacatcgacctccgccccgccagcgcgtggaccctgtacgccgtcgccaccacgttcatcacccccatgctgcggcacagcatcgagaactccagcgtgaacacctccctcaccgccatcgccaaccaggcgacggtgctgatgggcctggggaagggctggcccctcagcaagatggacatcggggtcccgctgctggccatcggctgctactcccaggtgaaccccatcaccctcaccgccgccctgctgctcctggtggcgcactacgccatcatcgggcccggcctgcaggccaaggccacccgcgaggcccagaagcgggcggccgccggcatcatgaagaaccccacggtcgacgggatcaccgtgatcgacctcgacccgatcccctacgaccccaagttcgagaagcagctgggccaggtgatgctgctcatcctgtgcgtcacccaggtgctgatgatgcgcaccacgtgggccctctgcgaggccctgaccctggcgaccgggcccatcagcaccctctgggagggcaacccggggcggttctggaacacgaccatcgccgtgtccatggccaacatcttccgcggcagctacctggccggcgccgggctcctcttctccatcatgaagaacaccaccaacacgcgccggggcaccgggaacatcggcgagaccctgggcgagaagtggaagtcccgcctgaacgcgctcgggaagtccgagttccagatctacaagaagtccggcatccaggaggtcgaccggaccctggccaaggaggggatcaagcgcggcgagacggaccaccacgccgtgtcccgggggagcgccaagctgcgctggttcgtggagcggaacatggtcacccccgagggcaaggtggtggacctcggctgcgggcgcggcgggtggtcctactactgcggcgggctgaagaacgtcaaggaggtgaagggcctgaccaagggcgggcccggccacgaggagcccatcccgatgagcacctacgggtggaacctcgtgcggctgcagtccggcgtcgacgtgttcttcatcccgcccgagaagtgcgacacgctgctctgcgacatcggggagagctcccccaacccgaccgtggaggcgggccgcaccctgcgggtcctgaacctcgtggagaactggctgaacaacaacacccagttctgcatcaaggtgctgaacccctacatgcccagcgtcatcgagaagatggaggccctgcagcgcaagtacggcggggccctcgtgcggaacccgctgagccgcaactccacccacgagatgtactgggtgagcaacgcctccggcaacatcgtcagctccgtgaacatgatcagccggatgctgatcaaccgcttcacgatgcggcacaagaaggccacctacgagcccgacgtggacctcgggtccggcacccgcaacatcgggatcgagagcgaggtccccaacctggacatcatcggcaagcggatcgagaagatcaagcaggagcacgagacctcctggcactacgaccaggaccacccctacaagacgtgggcgtaccacggcagctacgagaccacccagaccgggtccgccagctccatggtgaacggcgtggtccgcctgctcacgaagccgtgggacgtgctgcccaccgtgacccagatggccatgaccgacacgacccccttcgggcagcagcgcgtcttcaaggagaaggtggacacccggacccaggagcccaaggagggcacgaagaagctgatgaagatcaccgccgagtggctctggaaggagctgggcaagaagaagaccccgcgcatgtgcacccgggaggagttcacgcgcaaggtgcggagcaacgccgcgctgggggccatcttcaccgacgagaacaagtggaagtccgcccgcgaggccgtcgaggacagccggttctgggagctcgtggacaaggagcgcaacctgcacctggagggcaagtgcgagacctgcgtgtacaacatgatggggaagcgggagaagaagctcggcgagttcgggaaggccaagggctcccgcgcgatctggtacatgtggctgggcgcccggttcctggagttcgaggccctcgggttcctgaacgaggaccactggttcagccgcgagaactccctgagcggcgtcgagggggagggcctccacaagctggggtacatcctgcgggacgtgagcaagaaggagggcggcgccatgtacgcggacgacaccgccgggtgggacacgcgcatcaccctcgaggacctgaagaacgaggagatggtcaccaaccacatgaagggcgagcacaagaagctggccgaggccatcttcaagctcacctaccagaacaaggtggtgcgggtccagcgccccacgccccgggggaccgtgatggacatcatctcccgccgggaccagcgcggcagcggccaggtggggacctacggcctgaacaccttcacgaacatggaggcccagctgatccggcagatggagggggagggcgtcttcaagaacatccagcacctcaccgtgaccgaggaggtggcggtccagaactggctggcccgcgtggggcgcgagcggctgtcccgcatggccatcagcggcgacgactgcgtggtcaagcccctcgacgaccggttcgccaacgccctgaccgcgctgaacgacatgggcaagatccgcaaggacatccagcagtgggagccgtccaaggggtggaacgactggacccaggtgcccttctgcagccaccacttccacgagctcatcatgaaggacggccgggtgctggtcgtgccctgccgcaaccaggacgagctgatcgggcgggcccgcatctcccagggcgccgggtggagcctccgggagaccgcctgcctgggcaagtcctacgcccagatgtggagcctgatgtacttccaccgccgggacctccgcctggcggccaacgccatctgctccgccgtgcccagccactgggtcccgacctcccggaccacctggagcatccacgccaagcacgagtggatgacgaccgaggacatgctgaccgtgtggaaccgcgtgtggatccgggagaacccctggatggaggacaagacccccgtcgagtcctgggaggagatcccctacctcggcaagcgcgaggaccagtggtgcgggagcctgatcggcctgacgtcccgggcgacctgggccaagaacatccaggccgccatcaaccaggtgcgcagcctcatcgggaacgaggagtacaccgactacatgccgagcatgaagcggttccgccgcgaggaggaggaggcgggcgtgctgtggtga

SEQ ID NO: 9151 - RNA, 9876 nt, synthetic construct
  misc_feature 1..9876: note = derived and/or modified CDS sequence (opt1) from DENV-2__GU131928__SS-prME
  source 1..9876: mol_type = other RNA
agcgccgggatgatcatcatgctgatccccaccgtgatggccttccacctcaccacccgcaacggggagccccacatgatcgtcgggatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcatggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgtggcgttctccggcgtgagctggaccatgaagatcctgatcggggtcatcatcacctggatcggcatgaactcccggagcacctccctgagcgtgtccctggtgctcgtcgggatcgtgacgctgtacctgggcgtgatggtccaggccgacagcgggtgcgtggtgtcctggaagaacaaggagctcaagtgcggcagcggcatcttcatcaccgacaacgtccacacctggaccgagcagtacaagttccagcccgagagcccctccaagctggccagcgccatccagaaggcgcaggaggaggggatctgcggcatccgctccgtgacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggccgagtgcccgaacaccaaccgcgcgtggaacagcctggaggtcgaggactacgggttcggcgtgttcaccaccaacatctggctcaagctgaaggagaagcaggacgccttctgcgactccaagctgatgagcgccgccatcaaggacaaccgggccgtgcacgcggacatggggtactggatcgagtccgccctcaacgacacgtggaagatcgagaaggccagcttcatcgaggtcaagaactgccactggcccaagtcccacaccctgtggagcaacggcgtgctggagtccgagatgatcatccccaagaacctcgccggccccgtgagccagcacaactaccgcccggggtaccacacccagatcgccggcccctggcacctggggaagctggagatggacttcgacttctgcgacggcaccaccgtcatcgtgacggaggactgcgggaaccggggcccctccctccgcaccaccaccgcgagcggcaagctgatcacggagtggtgctgccggagctgcaccctgcccccgctccgctaccgcggggaggacggctgctggtacgggatggagatccgccccctgaaggagaaggaggagaacctggtgaactccctcgtcaccgccggccacggccaggtggacaacttcagcctgggcgtgctgggcatggccctcttcctggaggagatgctgcggacccgcgtcgggacgaagcacgccatcctcctggtggcggtgtccttcgtcaccctgatcaccggcaacatgagcttcaaggacctcgggcgggtggtggtcatggtgggcgccaccatggccgacgacatcgggatgggcgtgacgtacctggccctgctcgccgcgttcaaggtccgccccaccttcgccgccggcctgctgctccggaagctgacctccaaggagctgatgatgaccacgatcgggatcgtgctcctgagccagtccaccatccccgagaccgtgctggagctcaccgacgccctggccctgggcatgatggtcctcaagatcgtgcgcaacatggagaagtaccagctggcggtcacgatcatggccatcctgtgcgtgccgaacgccgtgatcctccagaacgcctggaaggtcagctgcaccatcctggccgtggtgtccgtcagccccctgctcctgacctccagccagcagaagaccgactggatccccctggcgctcacgatcaaggggctgaaccccaccgccatcttcctgaccaccctctcccgcacgaacaagaagcggagctggccgctgaacgaggccatcatggccgtgggcatggtgtccatcctggcgagctccctcctgaagaacgacatccccatgaccggccccctggtcgccgggggcctcctgaccgtgtgctacgtgctgaccgggcgcagcgccgacctcgagctggagcgggccacggacgtcaagtgggaggaccaggccgagatctccggcagcagccccatcctgtccatcaccatcagcgaggacgggtccatgagcatcaagaacgaggaggaggagcagaccctcaccatcctgatccgcacgggcctgctcgtgatctccggcctgttcccgatcagcatccccatcaccgcggccgcctggtacctgtgggaggtgaagaagcagcgggccggggtcctctgggacgtgcccagcccgccgcccatgggcaaggccgagctggaggacggggcgtaccgcatcaagcagaagggcatcctggggtacagccagatcggcgccggcgtgtacaaggaggggaccttccacaccatgtggcacgtcacccggggcgccgtgctcatgcacaaggggaagcgcatcgagccctcctgggccgacgtgaagaaggacctgatcagctacggcgggggctggaagctggagggcgagtggaaggagggggaggaggtccaggtgctcgccctggagcccggcaagaacccccgggcggtgcagacgaagcccgggctgttcaagaccaacaccggcaccatcggggccgtctccctcgacttcagccccggcacgtccggcagccccatcatcgacaagaaggggaaggtggtgggcctgtacgggaacggcgtcgtgacccgctccggcgcctacgtgagcgccatcgcccagaccgagaagtccatcgaggacaaccccgagatcgaggacgacatcttccggaagcgccggctgaccatcatggacctgcaccccggggcgggcaagacgaagcgctacctccccgccatcgtccgggaggccatcaagcgcgggctgcggaccctgatcctcgccccgacccgcgtggtggcggccgagatggaggaggccctgcggggcctgcccatccgctaccagacccccgccatccgggccgagcacacggggcgcgagatcgtcgacctcatgtgccacgcgaccttcaccatgcgcctgctgagccccgtgcgggtgccgaactacaacctcatcatcatggacgaggcccacttcaccgaccccgcctccatcgccgcccgcggctacatcagcacgcgggtcgagatgggcgaggcggccgggatcttcatgaccgccacgccgcccggcagccgcgacccgttcccccagtccaacgcccccatcatcgacgaggagcgggagatccccgagcgcagctggaactccgggcacgagtgggtgaccgacttcaagggcaagacggtgtggttcgtcccgagcatcaaggccgggaacgacatcgcggcctgcctgcggaagaacggcaagaaggtgatccagctgtcccgcaagaccttcgacagcgagtacgtgaagacccggaccaacgactgggacttcgtcgtgacgaccgacatctccgagatgggcgccaacttcaaggccgagcgcgtgatcgacccccggcgctgcatgaagcccgtcatcctcaccgacggggaggagcgggtgatcctggcgggccccatgccggtgacccacagctccgccgcccagcgccgggggcgcatcggccggaaccccaagaacgagaacgaccagtacatctacatgggggagcccctggagaacgacgaggactgcgcccactggaaggaggccaagatgctcctggacaacatcaacacgcccgagggcatcatcccgagcatgttcgagcccgagcgcgagaaggtcgacgcgatcgacggcgagtaccggctgcgcggggaggcccgcaagaccttcgtggacctcatgcggcgcggcgacctgcccgtgtggctggcctacaaggtcgccgccgaggggatcaactacgcggaccggcgctggtgcttcgacggcatcaagaacaaccagatcctcgaggagaacgtggaggtcgagatctggaccaaggagggggagcggaagaagctgaagccgcgctggctggacgcccggatctactccgaccccctcgccctgaaggagttcaaggagttcgccgccggccgcaagagcctgaccctcaacctgatcacggagatgggccggctgcccaccttcatgacccagaagacccgcgacgcgctcgacaacctggccgtgctgcacacggccgaggccgggggccgggcgtacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcccagatccagccgcactggatcgcggccagcatcatcctggagttcttcctcatcgtcctgctgatccccgagcccgagaagcagcggacgccccaggacaaccagctcacgtacgtggtgatcgccatcctgaccgtcgtggccgccaccatggcgaacgagatgggcttcctggagaagaccaagaaggacctcgggctgggctccatcgccacgcagcagccggagagcaacatcctggacatcgacctccgccccgcctccgcctggaccctgtacgccgtggcgaccaccttcgtcacgcccatgctgcggcacagcatcgagaacagctccgtgaacgtgagcctcaccgccatcgccaaccaggccaccgtcctgatgggcctggggaagggctggcccctctccaagatggacatcggggtgccgctgctggccatcggctgctacagccaggtgaaccccatcaccctcacggcggccctgctgctcctggtcgcccactacgccatcatcgggcccggcctgcaggcgaaggccacccgcgaggcccagaagcgggccgccgcgggcatcatgaagaaccccaccgtggacgggatcaccgtgatcgacctcgacccgatcccctacgaccccaagttcgagaagcagctgggccaggtcatgctgctcatcctgtgcgtgacccaggtgctgatgatgcgcaccacctgggccctctgcgaggccctgaccctggccacggggcccatctccaccctctgggagggcaacccggggcggttctggaacaccaccatcgccgtcagcatggcgaacatcttccgcggctcctacctggccggcgccgggctcctcttcagcatcatgaagaacacgaccaacacccggcgcggcaccgggaacatcggcgagacgctgggcgagaagtggaagtcccgcctgaacgccctcgggaagtccgagttccagatctacaagaagtccggcatccaggaggtggaccggaccctggccaaggaggggatcaagcgcggcgagaccgaccaccacgcggtgagccgggggtccgccaagctgcgctggttcgtcgagcggaacatggtgacccccgagggcaaggtggtcgacctcggctgcgggcgcggcgggtggagctactactgcggcgggctgaagaacgtgcgggaggtgaagggcctgacgaagggcgggcccggccacgaggagcccatcccgatgtccacctacgggtggaacctcgtccgcctgcagagcggcgtggacgtgttcttcatcccgcccgagaagtgcgacaccctgctctgcgacatcggggagtccagccccaacccgaccgtcgaggccggccggacgctgcgcgtgctgaacctcgtggagaactggctgaacaacaacacccagttctgcatcaaggtcctgaacccctacatgccctccgtgatcgagaagatggaggccctgcagcggaagtacggcggggcgctcgtgcgcaacccgctgagccggaacagcacccacgagatgtactgggtctccaacgccagcggcaacatcgtgtccagcgtgaacatgatctcccgcatgctgatcaaccggttcaccatgcgccacaagaaggccacctacgagcccgacgtcgacctcgggagcggcacgcggaacatcgggatcgagtccgagacccccaacctggacatcatcggcaagcgcatcgagaagatcaaggaggagcacgagaccagctggcactacgaccaggaccacccctacaagacctgggcctaccacggctcctacgagacgaagcagaccgggagcgcctccagcatggtgaacggcgtggtccggctgctcaccaagccgtgggacgtgctgcccaccgtgacgcagatggcgatgaccgacaccacccccttcgggcagcagcgcgtcttcaaggagaaggtggacacgcgcacccaggagcccaaggagggcaccaagaagctgatgaagatcaccgccgagtggctctggaaggagctgggcaagaagaagacgccgcggatgtgcacccgcgaggagttcacccggaaggtgcgctccaacgccgccctgggggccatcttcaccgacgagaacaagtggaagtccgcgcgggaggccgtcgaggactcccgcttctgggagctcgtggacaaggagcggaacctgcacctggagggcaagtgcgagacgtgcgtctacaacatgatggggaagcgcgagaagaagctcggcgagttcgggaaggccaagggcagccgggccatctggtacatgtggctgggcgcccgcttcctggagttcgaggcgctcgggttcctgaacgaggaccactggttctcccgggagaacagcctgtccggcgtggagggggagggcctccacaagctggggtacatcctgcgcgacgtgagcaagaaggagggcggcgccatgtacgccgacgacaccgccgggtgggacacccggatcaccctcgaggacctgaagaacgaggagatggtcacgaaccacatggagggcgagcacaagaagctggcggaggccatcttcaagctcacctaccagaacaaggtggtgcgcgtccagcggcccacgccccgggggaccgtgatggacatcatcagccggcgcgaccagcggggctccggccaggtggggacgtacggcctgaacaccttcaccaacatggaggcccagctgatccgccagatggagggggagggcgtcttcaagaacatccagcacctcaccgtgacggaggaggccgccgtgcagaactggctggcgcgggtcgggcgcgagcgcctgagccggatggccatctccggcgacgactgcgtggtgaagcccctcgacgaccgcttcgccaacgccctgaccgccctgaacgacatgggcaagatccggaaggacatccagcagtgggagccgagcaaggggtggaacgactggacccaggtccccttctgctcccaccacttccacgagctcatcatgaaggacggccgcgtgctggtggtcccctgccggaaccaggacgagctgatcgggcgcgcgcggatcagccagggcgccgggtggtccctccgcgagaccgcctgcctgggcaagagctacgcccagatgtggtccctgatgtacttccaccggcgcgacctccggctggccgcgaacgccatctgcagcgccgtgccctcccactgggtgccgacgagccgcaccacctggtccatccacgccaagcacgagtggatgaccaccgaggacatgctgacggtctggaaccgggtgtggatccgcgagaacccctggatggaggacaagacccccgtggagagctgggaggagatcccctacctcggcaagcgggaggaccagtggtgcgggtccctgatcggcctgaccagccgcgccacctgggcgaagaacatccaggccgccatcaaccaggtccggtccctcatcgggaacgaggagtacacggactacatgccgagcatgaagcgcttccggcgcgaggaggaggaggccggcgtgctgtggtga

SEQ ID NO: 9152 - RNA, 9876 nt, synthetic construct
  misc_feature 1..9876: note = derived and/or modified CDS sequence (opt1) from DENV-2__GU131929__SS-prME
  source 1..9876: mol_type = other RNA
agcgccgggatgatcatcatgctgatccccaccgtgatggccttccacctcaccacccgcaacggggagccccacatgatcgtcgggatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgagcagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatccggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcatggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgtggcgttctccggcgtgagctggaccatgaagatcctgatcggggtcatcatcacctggatcggcatgaactcccggagcacctccctgagcgtgtccctggtgctcgtcgggatcgtgacgctgtacctgggcgtgatggtccaggccgacagcgggtgcgtggtgtcctggaagaacaaggagctcaagtgcggcagcggcatcttcatcaccgacaacgtccacacctggaccgagcagtacaagttccagcccgagagcccctccaagctggccagcgccatccagaaggcgcaggaggaggggatctgcggcatccgctccgtgacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctgttcaccgagagctacaaccagaccttcctgatcgacggccccgagacggccgagtgcccgaacaccaaccgcgcgtggaactccctggaggtcgaggactacgggttcggcgtgttcaccaccaacatctggctcaagctgaaggagaagcaggacgccttctgcgacagcaagctgatgtccgccgccatcaaggacaaccgggccgtgcacgcggacatggggtactggatcgagagcgccctcaacgacacgtggaagatcgagaaggcctccttcatcgaggtcaagaactgccactggcccaagagccacaccctgtggtccaacggcgtgctggagagcgagatgatcatccccaagaacctcgccggccccgtgtcccagcacaactaccgcccggggtaccacacccagatcgccggcccctggcacctggggaagctggagatggacttcgacttctgcgacggcaccaccgtcatcgtgacggaggactgcgggaaccggggccccagcctccgcaccaccaccgcgtccggcaagctgatcacggagtggtgctgccggagctgcaccctgcccccgctccgctaccgcggggaggacggctgctggtacgggatggagatccgccccctgaaggagaaggaggagaacctggtgaacagcctcgtcaccgccggccacggccaggtggacaacttctccctgggcgtgctgggcatggccctcttcctggaggagatgctgcggacccgcgtcgggacgaagcacgccatcctcctggtggcggtgagcttcgtcaccctgatcaccggcaacatgtccttcaaggacctcgggcgggtggtggtcatggtgggcgccaccatggccgacgacatcgggatgggcgtgacgtacctggccctgctcgccgcgttcaaggtccgccccaccttcgccgccggcctgctgctccggaagctgaccagcaaggagctgatgatgaccacgatcgggatcgtgctcctgtcccagagcaccatccccgagaccgtgctggagctcaccgacgccctggccctgggcatgatggtcctcaagatcgtgcgcaacatggagaagtaccagctggcggtcacgatcatggccatcctgtgcgtgccgaacgccgtgatcctccagaacgcctggaaggtctcctgcaccatcctggccgtggtgagcgtcagccccctcctcctgaccagctcccagcagaagaccgactggatccccctggcgctcacgatcaaggggctgaaccccaccgccatcttcctgaccaccctcagccgcacgaacaagaagcggtcctggccgctgaacgaggccatcatggccgtgggcatggtgagcatcctggcgtccagcctcctgaagaacgacatccccatgaccggccccctggtcgccgggggcctcctgaccgtgtgctacgtgctgaccgggcgctccgccgacctcgagctggagcgggccacggacgtcaagtgggaggaccaggccgagatcagcggctccagccccatcctgagcatcaccatctccgaggacgggagcatgtccatcaagaacgaggaggaggagcagaccctcaccatcctgatccgcacgggcctgctcgtgatcagcggcctgttcccgatctccatccccatcaccgcggccgcctggtacctgtgggaggtgaagaagcagcgggccggggtcctctgggacgtgccctccccgccgcccatgggcaaggccgagctggaggacggggcgtaccgcatcaagcagaagggcatcctggggtactcccagatcggcgccggcgtgtacaaggaggggaccttccacaccatgtggcacgtcacccggggcgccgtgctcatgcacaaggggaagcgcatcgagcccagctgggccgacgtgaagaaggacctgatctcctacggcgggggctggaagctggagggcgagtggaaggagggggaggaggtccaggtgctcgccctggagcccggcaagaacccccgggcggtgcagacgaagcccgggctgttcaagaccaacaccggcaccatcggggccgtcagcctcgacttctcccccggcacgagcggctcccccatcatcgacaagaaggggaaggtggtgggcctgtacgggaacggcgtcgtgacccgcagcggcgcctacgtgtccgccatcgcccagaccgagaagtccatcgaggacaaccccgagatcgaggacgacatcttccggaagcgccggctgaccatcatggacctgcaccccggggcgggcaagacgaagcgctacctccccgccatcgtccgggaggccatcaagcgcgggctgcggaccctgatcctcgccccgacccgcgtggtggcggccgagatggaggaggccctgcggggcctgcccatccgctaccagacccccgccatccgggccgagcacacggggcgcgagatcgtcgacctcatgtgccacgcgaccttcaccatgcgcctgctgtcccccgtgcgggtgccgaactacaacctcatcatcatggacgaggcccacttcaccgaccccgccagcatcgccgcccgcggctacatctccacgcgggtcgagatgggcgaggcggccgggatcttcatgaccgccacgccgcccggcagccgcgacccgttcccccagagcaacgcccccatcatcgacgaggagcgggagatccccgagcgctcctggaacagcgggcacgagtgggtgaccgacttcaagggcaagacggtgtggttcgtcccgtccatcaaggccgggaacgacatcgcggcctgcctgcggaagaacggcaagaaggtgatccagctgagccgcaagaccttcgactccgagtacgtgaagacccggaccaacgactgggacttcgtcgtgacgaccgacatcagcgagatgggcgccaacttcaaggccgagcgcgtgatcgacccccggcgctgcatgaagcccgtcatcctcaccgacggggaggagcgggtgatcctggcgggccccatgccggtgacccactccagcgccgcccagcgccgggggcgcatcggccggaaccccaagaacgagaacgaccagtacatctacatgggggagcccctggagaacgacgaggactgcgcccactggaaggaggccaagatgctcctggacaacatcaacacgcccgagggcatcatcccgtccatgttcgagcccgagcgcgagaaggtcgacgcgatcgacggcgagtaccggctgcgcggggaggcccgcaagaccttcgtggacctcatgcggcgcggcgacctgcccgtgtggctggcctacaaggtcgccgccgaggggatcaactacgcggaccggcgctggtgcttcgacggcatcaagaacaaccagatcctcgaggagaacgtggaggtcgagatctggaccaaggagggggagcggaagaagctgaagccgcgctggctggacgcccggatctacagcgaccccctcgccctgaaggagttcaaggagttcgccgccggccgcaagtccctgaccctcaacctgatcacggagatgggccggctgcccaccttcatgacccagaagacccgcgacgcgctcgacaacctggccgtgctgcacacggccgaggccgggggccgggcgtacaaccacgccctcagcgagctgcccgagaccctggagaccctcctgctgctcaccctgctggccacggtgaccgggggcatcttcctcttcctgatgtccggccgcgggatcggcaagatgaccctggggatgtgctgcatcatcaccgccagcatcctcctgtggtacgcccagatccagccgcactggatcgcggcctccatcatcctggagttcttcctcatcgtcctgctgatccccgagcccgagaagcagcggacgccccaggacaaccagctcacgtacgtggtgatcgccatcctgaccgtcgtggccgccaccatggcgaacgagatgggcttcctggagaagaccaagaaggacctcgggctgggcagcatcgccacgcagcagccggagtccaacatcctggacatcgacctccgccccgccagcgcctggaccctgtacgccgtggcgaccaccttcgtcacgcccatgctgcggcactccatcgagaacagcagcgtgaacgtgtccctcaccgccatcgccaaccaggccaccgtcctgatgggcctggggaagggctggcccctcagcaagatggacatcggggtgccgctgctggccatcggctgctactcccaggtgaaccccatcaccctcacggcggccctgctgctcctggtcgcccactacgccatcatcgggcccggcctgcaggcgaaggccacccgcgaggcccagaagcgggccgccgcgggcatcatgaagaaccccaccgtggacgggatcaccgtgatcgacctcgacccgatcccctacgaccccaagttcgagaagcagctgggccaggtcatgctgctcatcctgtgcgtgacccaggtgctgatgatgcgcaccacctgggccctctgcgaggccctgaccctggccacggggcccatcagcaccctctgggagggcaacccggggcggttctggaacaccaccatcgccgtctccatggcgaacatcttccgcggcagctacctggccggcgccgggctcctcttctccatcatgaagaacacgaccaacacccggcgcggcaccgggaacatcggcgagacgctgggcgagaagtggaagtcccgcctgaacgccctcgggaagtccgagttccagatctacaagaagtccggcatccaggaggtggaccggaccctggccaaggaggggatcaagcgcggcgagaccgaccaccacgcggtgtcccgggggagcgccaagctgcgctggttcgtcgagcggaacatggtgacccccgagggcaaggtggtcgacctcggctgcgggcgcggcgggtggtcctactactgcggcgggctgaagaacgtgcgggaggtgaagggcctgacgaagggcgggcccggccacgaggagcccatcccgatgagcacctacgggtggaacctcgtccgcctgcagtccggcgtggacgtgttcttcatcccgcccgagaagtgcgacaccctgctctgcgacatcggggagagctcccccaacccgaccgtcgaggccggccggacgctgcgcgtgctgaacctcgtggagaactggctgaacaacaacacccagttctgcatcaaggtcctgaacccctacatgcccagcgtgatcgagaagatggaggccctgcagcggaagtacggcggggcgctcgtgcgcaacccgctgtcccggaacagcacccacgagatgtactgggtcagcaacgcctccggcaacatcgtgagctccgtgaacatgatcagccgcatgctgatcaaccggttcaccatgcgccacaagaaggccacctacgagcccgacgtcgacctcgggtccggcacgcggaacatcgggatcgagagcgagacccccaacctggacatcatcggcaagcgcatcgagaagatcaaggaggagcacgagacctcctggcactacgaccaggaccacccctacaagacctgggcctaccacggcagctacgagacgaagcagaccgggtccgccagctccatggtgaacggcgtggtccggctgctcaccaagccgtgggacgtgctgcccaccgtgacgcagatggcgatgaccgacaccacccccttcgggcagcagcgcgtcttcaaggagaaggtggacacgcgcacccaggagcccaaggagggcaccaagaagctgatgaagatcaccgccgagtggctctggaaggagctgggcaagaagaagacgccgcggatgtgcacccgcgaggagttcacccggaaggtgcgcagcaacgccgccctgggggccatcttcaccgacgagaacaagtggaagtccgcgcgggaggccgtcgaggacagccgcttctgggagctcgtggacaaggagcggaacctgcacctggagggcaagtgcgagacgtgcgtctacaacatgatggggaagcgcgagaagaagctcggcgagttcgggaaggccaagggctcccgggccatctggtacatgtggctgggcgcccgcttcctggagttcgaggcgctcgggttcctgaacgaggaccactggttcagccgggagaactccctgagcggcgtggagggggagggcctccacaagctggggtacatcctgcgcgacgtgtccaagaaggagggcggcgccatgtacgccgacgacaccgccgggtgggacacccggatcaccctcgaggacctgaagaacgaggagatggtcacgaaccacatggagggcgagcacaagaagctggcggaggccatcttcaagctcacctaccagaacaaggtggtgcgcgtccagcggcccacgccccgggggaccgtgatggacatcatcagccggcgcgaccagcggggcagcggccaggtggggacgtacggcctgaacaccttcaccaacatggaggcccagctgatccgccagatggagggggagggcgtcttcaagaacatccagcacctcaccgtgacggaggaggccgccgtgcagaactggctggcgcgggtcgggcgcgagcgcctgtcccggatggccatcagcggcgacgactgcgtggtgaagcccctcgacgaccgcttcgccaacgccctgaccgccctgaacgacatgggcaagatccggaaggacatccagcagtgggagccgtccaaggggtggaacgactggacccaggtccccttctgcagccaccacttccacgagctcatcatgaaggacggccgcgtgctggtggtcccctgccggaaccaggacgagctgatcgggcgcgcgcggatctcccagggcgccgggtggagcctccgcgagaccgcctgcctgggcaagtcctacgcccagatgtggagcctgatgtacttccaccggcgcgacctccggctggccgcgaacgccatctgctccgccgtgcccagccactgggtgccgacgtcccgcaccacctggagcatccacgccaagcacgagtggatgaccaccgaggacatgctgacggtctggaaccgggtgtggatccgcgagaacccctggatggaggacaagacccccgtggagtcctgggaggagatcccctacctcggcaagcgggaggaccagtggtgcgggagcctgatcggcctgacctcccgcgccacctgggcgaagaacatccaggccgccatcaaccaggtccggagcctcatcgggaacgaggagtacacggactacatgccgtccatgaagcgcttccggcgcgaggaggaggaggccggcgtgctgtggtga

SEQ ID NO: 9153 - RNA, 9876 nt, synthetic construct
  misc_feature 1..9876: note = derived and/or modified CDS sequence (opt1) from DENV-2__GU131930__SS-prME
  source 1..9876: mol_type = other RNA
agcgccggcatgatcatcatgctgatccccaccgtgatggccttccacctcaccacccgcaacggggagccccacatgatcgtgggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcaccatcatggccgcgatcctggcctacaccatcgggaccacccacttccagcgcgccctcatcttcatcctgctgacggccgtcgcgccctccatgaccatgcggtgcatcggcatcagcaaccgcgacttcgtggagggcgtgtccgggggcagctgggtcgacatcgtgctcgagcacgggtcctgcgtgaccaccatggccaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtctgcaagcacagcatggtggaccgcggctgggggaacggctgcgggctgttcggcaagggcgggatcgtgacgtgcgcgatgttcacgtgcaagaagaacatggagggcaagatcgtccagcccgagaacctggagtacaccatcgtggtgacgccccactccggggaggagcacgccgtcggcaacgacacggggaagcacggcaaggagatcaaggtgaccccgcagagctccatcaccgaggccgagctgaccgggtacggcaccgtgacgatggagtgcagcccccggaccggcctcgacttcaacgagatggtcctgctgcagatggagtccaaggcctggctcgtgcaccgccagtggttcctggacctgcccctcccctggctgccgggggccgacaagcagggcagcaactggatccagaaggagaccctggtgaccttcaagaacccccacgcgaagaagcaggacgtcgtggtcctcgggagccaggagggcgccatgcacacggccctgaccggggccaccgagatccagatgtccagcggcaacctcctgttcaccggccacctgaagtgccggctgcgcatggacaagctccagctgaaggggatgtcctacagcatgtgcacgggcaagttcaaggtggtgaaggagatcgccgagacccagcacgggaccatcgtcatccgggtgcagtacgagggcgacggctccccctgcaagatccccttcgagatcatggacctggagaagcgctacgtgctcgggcggctgatcaccgtcaacccgatcgtgacggagaaggacagccccgtgaacatcgaggcggagccgcccttcggcgactcctacatcatcatcggggtcgagccgggccagctgaagctcaactggttcaagaaggggagctccatcggccagatgttcgagaccaccatgcgcggcgccaagcgcatggccatcctgggggacaccgcctgggacttcggcagcctcggcggggtgttcacgtccatcgggaaggccctccaccaggtgttcggggcgatctacggcgccgccttcagcggggtctcctggaccatgaagatcctgatcggcgtgatcatcacctggatcgggatgaacagccggtccaccagcctgtccgtgagcctggtcctcgtgggcatcgtgacgctgtacctgggggtcatggtgcaggccgactccggctgcgtggtcagctggaagaacaaggagctcaagtgcggcagcgggatcttcatcaccgacaacgtgcacacctggaccgagcagtacaagttccagcccgagtcccccagcaagctggcgtccgccatccagaaggcccaggaggagggcatctgcgggatccgcagcgtgacgcggctggagaacctcatgtggaagcagatcacccccgagctgaaccacatcctggccgagaacgaggtcaagctcaccatcatgaccggcgacatcaaggggatcatgcaggccggcaagcgctccctgcggccgcagcccacggagctgaagtacagctggaagacctggggcaaggcgaagatgctctccaccgagagccacaaccagaccttcctgatcgacgggcccgagacggccgagtgcccgaacaccaaccgcgcctggaactccctggaggtggaggactacggcttcggggtgttcaccaccaacatctggctcaagctgaaggagaagcaggacgccttctgcgacagcaagctgatgtccgccgcgatcaaggacaaccgggccgtccacgccgacatgggctactggatcgagagcgccctcaacgacacgtggaagatcgagaaggcctccttcatcgaggtgaagaactgccactggcccaagagccacaccctgtggtccaacggcgtgctggagagcgagatgatcatccccaagaacctcgcggggcccgtctcccagcacaactaccgcccgggctaccacacccagaccgccgggccctggcacctgggcaagctggagatggacttcgacttctgcgacgggaccacggtgatcgtgaccgaggactgcggcaaccggggccccagcctccgcaccaccacggccagcgggaagctgatcaccgagtggtgctgccggtcctgcaccctgcccccgctccgctaccggggcgaggacgggtgctggtacggcatggagatccgccccctgaaggagaaggaggagaacctggtcaacagcctcgtgaccgccgggcacggccaggtggacaacttctccctgggcgtcctggggatggccctgttcctggaggagatgctgcggacgcgcgtgggcaccaagcacgccatcctcctggtggccgtcagcttcgtgaccctgatcaccgggaacatgtccttcaaggacctcggccgggtggtcgtgatggtggggacgaccatgaccgacgacatcggcatgggcgtcacctacctggccctgctcgccgcgttcaaggtgcgccccacgttcgccgccgggctgctgctccggaagctgaccagcaaggagctgatgatgaccaccatcggcatcgtgctcctgtcccagagcacgatccccgagaccatcctggagctcaccgacgccctggccctggggatgatggtcctcaagatcgtgcgcgacatggagaagtaccagctggcggtgaccatcatggccatcctgtgcgtcccgaacgccgtgatcctccagaacgcctggaaggtctcctgcacgatcctggccgtggtgagcgtcagccccctgctcctgaccagctcccagcagaagaccgactggatccccctggcgctcaccatcaagggcctgaaccccacggccatcttcctgaccaccctcagccgcaccaacaagaagcggtcctggccgctgaacgaggccatcatggccgtgggcatggtgagcatcctggcgtccagcctcctgaagaacgacatccccatgacggggcccctggtcgccggcgggctcctgaccgtgtgctacgtgctgaccggccgctccgccgacctcgagctggagcgggccaccgacgtcaagtgggaggaccaggccgagatcagcgggagctcccccatcctgagcatcacgatctccgaggacggcagcatgtccatcaagaacgaggaggaggagcagaccctcaccatcctgatccgcaccggcctgctcgtgatcagcgggctgttcccggtgtccatccccatcaccgcggccgcctggtacctgtgggaggtcaagaagcagcgggccggcgtgctctgggacgtgccctccccgccgcccatggggaaggccgagctggaggacggcgcgtaccgcatcaagcagaaggggatcctgggctactcccagatcggcgccggggtctacaaggagggcacgttccacaccatgtggcacgtgacccgcggggcggtgctcatgcacaagggcaagcgcatcgagcccagctgggccgacgtcaagaaggacctgatctcctacgggggcggctggaagctggagggggagtggaaggagggcgaggaggtccaggtgctcgccctggagcccgggaagaacccccgggcggtccagaccaagcccggcctgttcaagacgaacaccgggaccatcggcgccgtgagcctcgacttctcccccggcaccagcgggtcccccatcatcgacaagaagggcaaggtggtcgggctgtacggcaacggcgtggtgacgcgcagcggggcctacgtctccgccatcgcccagaccgagaagtccatcgaggacaaccccgagatcgaggacgacatcttccggaagcgccggctgaccatcatggacctgcaccccggcgcggggaagaccaagcgctacctccccgccatcgtgcgggaggccatcaagcgcggcctgcggacgctgatcctcgccccgacccgcgtggtcgcggccgagatggaggaggccctgcgggggctgcccatccgctaccagacccccgccatccgggccgagcacaccggccgcgagatcgtggacctcatgtgccacgcgacgttcaccatgcgcctgctgtcccccgtgcgggtcccgaactacaacctcatcatcatggacgaggcccacttcaccgaccccgccagcatcgccgcccgcggctacatcagcacccgggtggagatgggggaggcggccggcatcttcatgacggccacgccgcccgggtcccgcgacccgttcccccagagcaacgcccccatcatcgacgaggagcgggagatccccgagcgctcctggaacaccggccacgagtgggtgaccgacttcaaggggaagacggtctggttcgtgccgagcatcaaggccggcaacgacatcgcggcctgcctgcggaagaacggcaagaaggtgatccagctgtcccgcaagaccttcgacagcgagtacgtcaagacccggaccaacgactgggacttcgtggtgacgaccgacatctccgagatgggggccaacttcaaggccgagcgcgtcatcgacccccggcgctgcatgaagcccgtgatcctcaccgacggcgaggagcgggtgatcctggcggggcccatgccggtcacccacagctccgccgcccagcgccggggccgcatcgggcggaaccccaagaacgagaacgaccagtacatctacatgggcgagcccctggagaacgacgaggactgcgcccactggaaggaggccaagatgctcctggacaacatcaacacgcccgagggcatcatcccgagcatgttcgagcccgagcgcgagaaggtggacgcgatcgacggggagtaccggctgcgcggcgaggcccgcaagaccttcgtggacctcatgcggcgcggggacctgcccgtctggctggcctacaaggtggccgccgagggcatcaactacgcggaccggcgctggtgcttcgacgggatcaagaacaaccagatcctcgaggagaacgtggaggtcgagatctggaccaaggagggcgagcggaagaagctgaagccgcgctggctggacgcccggatctactccgaccccctcgccctgaaggagttcaaggagttcgccgccggccgcaagagcctgaccctcaacctgatcacggagatggggcggctgcccaccttcatgacccagaagacccgcgacgcgctcgacaacctggccgtgctgcacacggccgaggccggcgggcgggcgtacaaccacgccctctccgagctgcccgagaccctggagaccctcctgctgctcaccctgctggccaccgtcacgggcggcatcttcctcttcctgatgagcgggcgcggcatcgggaagatgaccctgggcatgtgctgcatcatcaccgcctccatcctcctgtggtacgcccagatccagccgcactggatcgcggccagcatcatcctggagttcttcctcatcgtgctgctgatccccgagcccgagaagcagcggacgccccaggacaaccagctcacgtacgtggtcatcgccatcctgaccgtggtggccgccaccatggcgaacgagatggggttcctggagaagaccaagaaggacctcggcctgggctccatcgccacgcagcagccggagagcaacatcctggacatcgacctccgccccgcctccgcctggaccctgtacgccgtcgcgaccaccttcgtgacgcccatgctgcggcacagcatcgagaacagctccgtgaacgtcagcctcaccgccatcgccaaccaggccaccgtgctgatggggctgggcaaggggtggcccctctccaagatggacatcggcgtgccgctgctggccatcgggtgctacagccaggtcaaccccatcaccctcacggcggccctgctgctcctggtggcccactacgccatcatcggccccggcctgcaggcgaaggccacccgcgaggcccagaagcgggccgccgcggggatcatgaagaaccccaccgtggacggcatcaccgtcatcgacctcgacccgatcccctacgaccccaagttcgagaagcagctgggccaggtgatgctgctcatcctgtgcgtgacgcaggtcctgatgatgcgcaccacctgggccctctgcgaggccctgaccctggccacgggccccatctccaccctctgggaggggaacccgggccggttctggaacaccaccatcgccgtgagcatggcgaacatcttccgcggctcctacctggccggggccggcctcctcttcagcatcatgaagaacacgaccaacacccggcgcgggaccggcaacatcggcgagacgctgggggagaagtggaagtcccgcctgaacgccctcggcaagagcgagttccagacctacaagaagtccgggatccaggaggtggaccggaccctggccaaggagggcatcaagcgcggggagaccgaccaccacgcggtcagccggggctccgccaagctgcgctggttcgtggagcggaacatggtgacgcccgagggcaaggtcgtggacctcgggtgcggccgcgggggctggagctactactgcgggggcctgaagaacgtgcgggaggtcaagggcctgaccaagggcgggcccgggcacgaggagcccatcccgatgtccacctacggctggaacctcgtgcgcctgcagagcggggtggacgtcttcttcatcccgcccgagaagtgcgacaccctgctctgcgacatcggcgagtccagccccaacccgaccgtggaggccggccggacgctgcgcgtgctgaacctcgtcgagaactggctgaacaacaacacccagttctgcatcaaggtgctgaacccctacatgccctccgtgatcgagaagatggaggccctgcagcggaagtacgggggcgcgctcgtccgcaacccgctgagccggaacagcacccacgagatgtactgggtgtccaacgccagcgggaacatcgtgtccagcgtcaacatgatctcccgcatgctgatcaaccggttcaccatgcgccacaagaaggccacgtacgagcccgacgtggacctcggcagcgggacccggaacatcggcatcgagtccgagatccccaacctggacatcatcggcaagcgcatcgagaagatcaagcaggagcacgagaccagctggcactacgaccaggaccacccctacaagacctgggcctaccacgggtcctacgagacgaagcagaccggcagcgcctccagcatggtgaacggggtcgtgcggctgctcaccaagccgtgggacgtgctgcccaccgtcacgcagatggcgatgaccgacaccacccccttcggccagcagcgcgtgttcaaggagaaggtggacacgcgcacccaggagcccaaggagggcaccaagaagctgatgaagatcaccgccgagtggctctggaaggagctggggaagaagaagacgccgcggatgtgcacccgcgaggagttcacccggaaggtccgctccaacgccgccctgggcgccatcttcaccgacgagaacaagtggaagtccgcgcgggaggccgtggaggactcccgcttctgggagctcgtggacaaggagcggaacctgcacctggaggggaagtgcgagacgtgcgtctacaacatgatgggcaagcgcgagaagaagctcggggagttcggcaaggccaagggcagccgggccatctggtacatgtggctgggggcccgcttcctggagttcgaggcgctcggcttcctgaacgaggaccactggttctcccgggagaacagcctgtccggggtggagggcgaggggctccacaagctgggctacatcctgcgcgacgtcagcaagaaggagggcggggccatgtacgccgacgacaccgccggctgggacacccggatcaccctcgaggacctgaagaacgaggagatggtgacgaaccacatggagggggagcacaagaagctggcggaggccatcttcaagctcacctaccagaacaaggtggtccgcgtgcagcggcccacgccccggggcaccgtgatggacatcatcagccggcgcgaccagcgggggtccggccaggtcggcacgtacgggctgaacaccttcaccaacatggaggcccagctgatccgccagatggagggcgagggggtgttcaagaacatccagcacctcaccgccacggaggaggtggccgtcaagaactggctggcgcgggtgggccgcgagcgcctgagccggatggccatctccggcgacgactgcgtggtcaagcccctcgacgaccgcttcgccaacgccctgaccgccctgaacgacatggggaagatccggaaggacatccagcagtgggagccgagcaagggctggaacgactggacccaggtgcccttctgctcccaccacttccacgagctcatcatgaaggacgggcgcgtgctggtcgtgccctgccggaaccaggacgagctgatcggccgcgcgcggatcagccagggggccggctggtccctccgcgagaccgcctgcctgggcaagagctacgcccagatgtggtccctgatgtacttccaccggcgcgacctccggctggccgcgaacgccatctgcagcgccgtgccctcccactgggtcccgaccagccgcacgacctggtccatccacgccaagcacgagtggatgaccaccgaggacatgctgacggtgtggaaccgggtgtggatccgcgagaacccctggatggaggacaagacccccgtcgagagctgggaggagatcccctacctcgggaagcgggaggaccagtggtgcggctccctgatcgggctgaccagccgcgccacctgggcgaagaacatccaggccgccatcaaccaggtgcggtccctcatcggcaacgaggagtacacggactacatgccgagcatgaagcgcttccggcgcgaggaggaggaggccggggtgctgtggtga

SEQ ID NO: 9154 - RNA, 9876 nt, synthetic construct
  misc_feature 1..9876: note = derived and/or modified CDS sequence (opt1) from DENV-2__GU131931__SS-prME
  source 1..9876: mol_type = other RNA
agcgcggggatgatcatcatgctgatccccaccgtgatggccttccacctcaccacccgcaacggggagccccacatgatcgtgggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcaccatcatggccgcgatcctggcccacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcatggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccagatcttcggggccatctacggcgcggccttctccggcgtcagctggaccatgaagatcctgatcggggtgatcatcacctggatcggcatgaactcccggagcacctccctgagcgtgtccctggtcctcgtggggatcgtgacgctgtacctgggcgtcatggtgcaggccgacagcgggtgcgtggtctcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtgacgcggctggagaacctcatgtggaagcagatcacccccgagctgaaccacatcctggccgagaacgaggtcaagctcaccatcatgaccggggacatcaagggcatcatgcaggccgggaagcgcagcctgcggccgcagcccacggagctgaagtactcctggaagacctggggcaaggccaagatgctcagcaccgagtcccacaaccagaccttcctgatcgacggccccgagacggcggagtgcccgaacaccaaccgcgcctggaacagcctggaggtggaggactacgggttcggcgtgttcaccaccaacatctggctcaagctgaaggagaagcaggacgccttctgcgactccaagctgatgagcgccgccatcaaggacaaccgggcggtccacgccgacatggggtactggatcgagtccgccctcaacgacacgtggaagatcgagaaggccagcttcatcgaggtgaagaactgccactggcccaagtcccacaccctgtggagcaacggcgtgctggagtccgagatgatcatccccaagaacctcgccggccccgtcagccagcacaactaccgcccggggtaccacacccagatcgcgggcccctggcacctggggaagctggagatggacttcgacttctgcgacggcaccaccgtgatcgtgacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtcaactccctcgtgaccgccggccacggccaggtggacaacttcagcctgggcgtcctgggcatggccctcttcctggaggagatgctgcggacccgcgtggggacgaagcacgcgatcctcctggtggccgtctccttcgtgaccctgatcaccggcaacatgagcttcaaggacctcgggcgggtggtcgtgatggtgggcgccaccatggccgacgacatcgggatgggcgtcacgtacctggccctgctcgcggccttcaaggtgcgccccaccttcgccgccggcctgctgctccggaagctgacctccaaggagctgatgatgaccacgatcgggatcgtgctcctgagccagtccaccatccccgagaccgtcctggagctcaccgacgccctggcgctgggcatgatggtgctcaagatcgtgcgcaacatggagaagtaccagctggccgtcacgatcatggccatcctgtgcgtgccgaacgccgtcatcctccagaacgcctggaaggtgagctgcaccatcctggcggtggtctccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtgggcatggtctccatcctggccagctccctcctgaagaacgacatccccatgaccggccccctggtggccgggggcctcctgaccgtgtgctacgtcctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtgatctccggcctgttcccgatcagcatccccatcaccgccgccgcctggtacctgtgggaggtcaagaagcagcgggccggggtgctctgggacgtgcccagcccgccgcccatgggcaaggcggagctggaggacggggcctaccgcatcaagcagaagggcatcctggggtacagccagatcggcgccggcgtctacaaggaggggaccttccacaccatgtggcacgtgacccggggcgccgtgctcatgcacaaggggaagcgcatcgagccctcctgggccgacgtcaagaaggacctgatcagctacggcgggggctggaagctggagggcgagtggaaggagggggaggaggtccaggtgctcgcgctggagcccggcaagaacccccgggccgtccagacgaagcccgggctgttcaagaccaacaccggcaccatcggggccgtgtccctcgacttcagccccggcacgtccggcagccccatcatcgacaagaaggggaaggtggtcggcctgtacgggaacggcgtggtgacccgctccggcgcctacgtcagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtggtcgccgccgagatggaggaggccctgcggggcctgcccatccgctaccagacccccgccatccgggcggagcacacggggcgcgagatcgtggacctcatgtgccacgccaccttcaccatgcgcctgctgagccccgtgcgggtcccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtgaccgacttcaagggcaagacggtctggttcgtgccgagcatcaaggcggggaacgacatcgccgcctgcctgcggaagaacggcaagaaggtgatccagctgtcccgcaagaccttcgacagcgagtacgtcaagacccggaccaacgactgggacttcgtggtgacgaccgacatctccgagatgggcgccaacttcaaggcggagcgcgtcatcgacccccggcgctgcatgaagcccgtgatcctcaccgacggggaggagcgggtgatcctggccggccccatgccggtcacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccgcaagaccttcgtggacctcatgcggcgcggcgacctgcccgtctggctggcctacaaggtggccgcggaggggatcaactacgccgaccggcgctggtgcttcgacggcatcaagaacaaccagatcctcgaggagaacgtggaggtcgagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtgctgcacacggccgaggccggcgggcgggcctacaaccacgccctctccgagctgcccgagaccctggagaccctcctgctgctcaccctgctggccacggtcaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtggtcatcgccatcctgaccgtggtggccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtcgccaccaccttcgtgacgcccatgctgcggcacagcatcgagaacagctccgtgaacgtcagcctcaccgccatcgccaaccaggccaccgtgctgatgggcctggggaagggctggcccctctccaagatggacatcggggtgccgctgctggcgatcggctgctacagccaggtcaaccccatcaccctcacggccgccctgctgctcctggtggcccactacgcgatcatcgggcccggcctgcaggccaaggccacccgcgaggcccagaagcgggccgcggccggcatcatgaagaaccccaccgtggacgggatcaccgtcatcgacctcgacccgatcccctacgaccccaagttcgagaagcagctgggccaggtgatgctgctcatcctgtgcgtgacgcaggtcctgatgatgcgcaccacctgggccctctgcgaggccctgaccctggccacggggcccatctccaccctctgggagggcaacccggggcggttctggaacaccaccatcgcggtgagcatggccaacatcttccgcggctcctacctggccggcgccgggctcctcttcagcatcatgaagaacacgaccaacacccggcgcggcaccgggaacatcggcgagacgctgggcgagaagtggaagtcccgcctgaacgccctcgggaagtccgagttccagatctacaagaagtccggcatccaggaggtggaccggaccctggcgaaggaggggatcaagcgcggcgagaccgaccaccacgccgtcagccgggggtccgccaagctgcgctggttcgtggagcggaacatggtgacccccgagggcaaggtcgtggacctcggctgcgggcgcggcgggtggagctactactgcggcgggctgaagaacgtgcgggaggtcaagggcctgacgaagggcgggcccggccacgaggagcccatcccgatgtccacctacgggtggaacctcgtgcgcctgcagagcggcgtggacgtcttcttcatcccgcccgagaagtgcgacaccctgctctgcgacatcggggagtccagccccaacccgaccgtggaggccggccggacgctgcgcgtgctgaacctcgtcgagaactggctgaacaacaacacccagttctgcatcaaggtgctgaacccctacatgccctccgtgatcgagaagatggaggcgctgcagcggaagtacggcggggccctcgtccgcaacccgctgagccggaacagcacccacgagatgtactgggtgtccaacgccagcggcaacatcgtgtccagcgtcaacatgatctcccgcatgctgatcaaccggttcaccatgcgccacaagaaggccacctacgagcccgacgtggacctcgggagcggcacgcggaacatcgggatcgagtccgagatccccaacctggacatcatcggcaagcgcatcgagaagatcaaggaggagcacgagaccagctggcactacgaccaggaccacccctacaagacctgggcctaccacggctcctacgagaccaagcagacggggagcgcgtccagcatggtgaacggcgtcgtgcggctgctcaccaagccgtgggacgtgctgcccaccgtcacccagatggccatgacggacaccacccccttcgggcagcagcgcgtgttcaaggagaaggtggacacccgcacgcaggagcccaaggagggcaccaagaagctgatgaagatcaccgccgagtggctctggaaggagctgggcaagaagaagaccccgcggatgtgcacgcgcgaggagttcacccggaaggtccgctccaacgccgccctgggggcgatcttcaccgacgagaacaagtggaagtccgcccgggaggccgtggaggactcccgcttctgggagctcgtggacaaggagcggaacctgcacctggagggcaagtgcgagacctgcgtctacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtggagggggagggcctccacaagctggggtacatcctgcgcgacgtcagcaagaaggagggcggcgccatgtacgccgacgacacggcggggtgggacacccggatcaccctcgaggacctgaagaacgaggagatggtgaccaaccacatggagggcgagcacaagaagctggccgaggccatcttcaagctcacgtaccagaacaaggtggtccgcgtgcagcggcccacgccccgggggaccgtgatggacatcatcagccggcgcgaccagcggggctccgggcaggtcggcacctacggcctgaacacgttcaccaacatggaggcccagctgatccgccagatggagggggagggcgtgttcaagaacatccagcacctcaccgtgaccgaggaggccgcggtccagaactggctggcccgggtggggcgcgagcgcctgagccggatggccatctccggcgacgactgcgtggtcaagcccctcgacgaccgcttcgccaacgccctgacggcgctgaacgacatgggcaagatccggaaggacatccagcagtgggagccgagcaaggggtggaacgactggacccaggtgcccttctgctcccaccacttccacgagctcatcatgaaggacggccgcgtgctggtcgtgccctgccggaaccaggacgagctgatcgggcgcgcccggatcagccagggcgccgggtggtccctccgcgagaccgcctgcctgggcaagagctacgcccagatgtggtccctgatgtacttccaccggcgcgacctccggctggcggccaacgccatctgcagcgccgtgccctcccactgggtcccgaccagccgcacgacctggtccatccacgccaagcacgagtggatgaccaccgaggacatgctgaccgtgtggaaccgggtgtggatccgcgagaacccctggatggaggacaagacgcccgtcgagagctgggaggagatcccctacctcggcaagcgggaggaccagtggtgcgggtccctgatcggcctgaccagccgcgcgacctgggccaagaacatccaggccgccatcaaccaggtgcggtccctcatcgggaacgaggagtacaccgactacatgccgagcatgaagcgcttccggcgcgaggaggaggaggcgggcgtgctgtggtga

SEQ ID NO: 9155 - RNA, 9876 nt, synthetic construct
  misc_feature 1..9876: note = derived and/or modified CDS sequence (opt1) from DENV-2__GU131932__SS-prME
  source 1..9876: mol_type = other RNA
agcgcgggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcatggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtcgtggccgccgagatggaggaggccctgcggggcctgcccatccgctaccagacccccgccatccgggcggagcacacggggcgcgagatcgtggacctcatgtgccacgccaccttcaccatgcgcctgctgagccccgtccgggtgccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctgcggaagaacggcaagaaggtcatccagctgtcccgcaagaccttcgacagcgagtacgtgaagacccggaccaacgactgggacttcgtggtcacgaccgacatctccgagatgggcgccaacttcaaggcggagcgcgtgatcgacccccggcgctgcatgaagcccgtgatcctcaccgacggggaggagcgggtcatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccgcaagaccttcgtcgacctcatgcggcgcggcgacctgcccgtgtggctggcctacaaggtggccgcggaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtcctgcacacggccgaggccggcgggcgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtcgtgatcgccatcctgaccgtggtcgccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtggccaccaccttcgtgacgcccatgctgcggcacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcaccctcacggccgccctgctgctcctggtggcccactacgcgatcatcgggcccggcctgcaggccaaggccacccgcgaggcccagaagcgggccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcgcaccacctgggccctctgcgaggccctgaccctggccacggggcccatctccaccctctgggagggcaacccggggcggttctggaacaccaccatcgcggtgagcatggccaacatcttccgcggctcctacctggccggcgccgggctcctcttcagcatcatgaagaacacgaccaacacccggcgcggcaccgggaacatcggcgagacgctgggcgagaagtggaagaaccgcctgaacgccctcgggaagtccgagttccagatctacaagaagtccggcatccaggaggtcgaccggaccctggcgaaggaggggatcaagcgcggcgagaccgaccaccacgccgtgtcccgggggagcgccaagctgcgctggttcgtggagcggaacatggtcacccccgagggcaaggtggtggacctcggctgcgggcgcggcgggtggtcctactactgcggcgggctgaagaacgtccgggaggtgaagggcctgacgaagggcgggcccggccacgaggagcccatcccgatgagcacctacgggtggaacctcgtgcgcctgcagtccggcgtcgacgtgttcttcatcccgcccgagaagtgcgacaccctgctctgcgacatcggggagagctcccccaacccgaccgtggaggccggccggacgctgcgcgtcctgaacctcgtggagaactggctgaacaacaacacccagttctgcatcaaggtgctgaacccctacatgcccagcgtcatcgagaagatggaggcgctgcagcggaagtacggcggggccctcgtgcgcaacccgctgtcccggaacagcacccacgagatgtactgggtgagcaacgcctccggcaacatcgtcagctccgtgaacatgatcagccgcatgctgatcaaccggttcaccatgcgccacaagaaggccacctacgagcccgacgtggacctcgggtccggcacgcggaacatcgggatcgagagcgagatccccaacctggacatcatcggcaagcgcatcgagaagatcaaggaggagcacgagacctcctggcactacgaccaggaccacccctacaagacctgggcctaccacggcagctacgagaccaagcagacggggtccgcgagctccatggtcaacggcgtggtgcggctgctcaccaagccgtgggacgtcctgcccaccgtgacccagatggccatgacggacaccacccccttcgggcagcagcgcgtgttcaaggagaaggtcgacacccgcacgcaggagcccaaggagggcaccaagaagctgatgaagatcaccgccgagtggctctggaaggagctgggcaagaagaagaccccgcggatgtgcacgcgcgaggagttcacccggaaggtgcgcagcaacgccgccctgggggcgatcttcaccgacgagaacaagtggaagtccgcccgggaggccgtggaggacagccgcttctgggagctcgtcgacaaggagcggaacctgcacctggagggcaagtgcgagacctgcgtgtacaacatgatggggaagcgcgagaagaagctcggcgagttcgggaaggccaagggctcccgggccatctggtacatgtggctgggcgcgcgcttcctggagttcgaggccctcgggttcctgaacgaggaccactggttcagccgggagaactccctgagcggcgtcgagggggagggcctccacaagctggggtacatcctgcgcgacgtgtccaagaaggagggcggcgccatgtacgccgacgacacggcggggtgggacacccggatcaccctcgaggacctgaagaacgaggagatggtgaccaaccacatggagggcgagcacaagaagctggccgaggccatcttcaagctcacgtaccagaacaaggtcgtgcgcgtgcagcggcccacgccccgggggaccgtcatggacatcatcagccggcgcgaccagcggggcagcggccaggtggggacctacggcctgaacacgttcaccaacatggaggcccagctgatccgccagatggagggggagggcgtgttcaagaacatccagcacctcaccgtcaccgaggaggccgcggtgcagaactggctggcccgggtggggcgcgagcgcctgtcccggatggccatcagcggcgacgactgcgtcgtgaagcccctcgacgaccgcttcgccaacgccctgacggcgctgaacgacatgggcaagatccggaaggacatccagcagtgggagccgtccaaggggtggaacgactggacccaggtgcccttctgcagccaccacttccacgagctcatcatgaaggacggccgcgtcctggtggtgccctgccggaaccaggacgagctgatcgggcgcgcccggatctcccagggcgccgggtggagcctccgcgagaccgcctgcctgggcaagtcctacgcccagatgtggagcctgatgtacttccaccggcgcgacctccggctggcggccaacgccatctgctccgccgtccccagccactgggtgccgacctcccgcacgacctggagcatccacgccaagcacgagtggatgaccaccgaggacatgctgaccgtgtggaaccgggtctggatccgcgagaacccctggatggaggacaagacgcccgtggagtcctgggaggagatcccctacctcggcaagcgggaggaccagtggtgcgggagcctgatcggcctgacctcccgcgcgacctgggccaagaacatccaggccgccatcaaccaggtgcggagcctcatcgggaacgaggagtacaccgactacatgccgtccatgaagcgcttccggcgcgaggaggaggaggcgggcgtcctgtggtga

SEQ ID NO: 9156 - RNA, 9876 nt, synthetic construct
  misc_feature 1..9876: note = derived and/or modified CDS sequence (opt1) from DENV-2__GQ199892__SS-prME
  source 1..9876: mol_type = other RNA
accgccggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccggaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggcgcgccctgcaagatccccttcgagatcaccgacctggagaagcggcacgtcctcgggcgcctgatcaccgtgaacccgatcgtgacggagaaggactcccccgtcaacatcgaggccgagccgcccttcggcgacagctacatcatcgtgggggtggagccgggccagctgaagctcaactggttcaagaaggggtccagcatcggccagatgttcgagaccaccatgcgcggcgccaagcggatggccatcctgggggacaccgcctgggacttcggctccctcggcggggtcttcacgagcatcgggaaggcgctccaccaggtgttcggggccatctacggcgccgccttctccggggtgagctggaccatgaagatcctgatcggcgtcatcatcacctggatcgggatgaactcccgcagcacctccctgagcgtgtccctggtgctcgtcggcgtggtgacgctgtacctgggggcgatggtccaggccgacagcggctgcatcgtgtcctggaagaacaaggagctcaagtgcggcagcgggatcttcatcaccgacaacgtgcacacctggaccgagcagtacaagttccagcccgagtcccccagcaagctggccagcgccatccagaaggcccacgaggagggcatctgcgggatccggtccgtcacgcgcctggagaacctcatgtggaagcagatcacccccgagctgaaccacatcctgagcgagaacgaggtgaagctcaccatcatgaccggcgacatcaaggggatcatgcaggcgggcaagcggtccctgcgcccgcagcccacggagctgaagtacagctggaagacctggggcaaggccaagatgctctccaccgagagccacaaccagaccttcctgatcgacgggcccgagacggccgagtgcccgaacaccaaccgggcctggaactccctggaggtggaggactacggcttcggggtcttcagcaccaacatctggctcaagctgcgcgagaagcaggacgtgttctgcgactccaagctgatgagcgccgcgatcaaggacaaccgggccgtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgcggggcccgtgtcccagcacaactaccgcccgggctaccacacgcagaccgccgggccctggcacctcggcaagctggagatggacttcgacttctgcgaggggaccaccgtcgtggtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcatcctggggatggcgctgttcctcgaggagatgctgcggacccgcgtgggcacgaagcacgccatcctgctcgtcgccctgagcttcgtgaccctgatcaccgggaacatgtccttccgggacctcggccgcgtgatggtcatggtgggggccaccatgacggacgacatcggcatgggcgtgacctacctggccctgctcgcggccttcaaggtccgccccaccttcgccgccgggctgctgctccggaagctgaccagcaaggagctgatgatggccacgatcggcatcgcgctcctgtcccagagcaccctgcccgagaccatcctcgagctgaccgacgccctggccctcgggatgatggccctgaagatcgtgcgcaacatggagaagtaccagctggccgtgacgatcatggcgatctcctgcgtcccgaacgccgtgatcctccagaacgcctggaaggtgagctgcaccatcctggccgcggtctccgtgagccccctgctcctgacctccagccagcagaaggccgactggatccccctggccctcaccatcaagggcctgaaccccacggccatcttcctgaccaccctctcccggaccagcaagaagcgctcctggccgctgaacgaggccatcatggcggtgggcatggtcagcatcctggcctccagcctcctgaagaacgacatccccatgacggggcccctggtggccggcgggctcctgaccgtctgctacgtgctgaccggccggagcgccgacctcgagctggagcgcgccgcggacgtgaagtgggaggaccaggccgagatctccgggagctcccccatcctgagcatcaccatctccgaggacggcagcatgtccatcaagaacgaggaggaggagcagacgctcaccatcctgatccggaccggcctgctcgtcatcagcggggtgttcccggtgtccatccccatcaccgccgccgcctggtacctgtgggaggtcaagaagcagcgcgcgggcgtgctgtgggacgtgcccagcccgccgcccgtcgggaaggccgagctcgaggacggcgcctaccggatcaagcagcgcgggatcctgggctactcccagatcggcgccggggtgtacaaggagggcaccttccacacgatgtggcacgtgacccgcggggccgtcctgatgcaccgcggcaagcggatcgagcccagctgggcggacgtgaagaaggacctcatctcctacgggggcggctggaagctggagggggagtggaaggagggcgaggaggtgcaggtcctggccctcgagcccgggaagaacccccgcgccgtgcagaccaagcccggcatcttcaagaccaacacggggaccatcggcgccgtgagcctggacttctcccccggcaccagcgggtcccccatcgtcgaccggaagggcaaggtggtggggctgtacggcaacggcgtcgtgacccgcagcggggcgtacgtgtccgccatcgcccagacggagaagtccatcgaggacaaccccgagatcgaggacgacatcttccggaagaagcgcctcaccatcatggacctgcaccccggcgccgggaagaccaagcggtacctgcccgccatcgtccgcgaggcgatcaagcggggcctgcgcaccctcatcctggccccgacgcgcgtggtggccgccgagatggaggaggccctgcgggggctccccatccgctaccagacccccgcgatccgggccgagcacaccggccgcgagatcgtcgacctgatgtgccacgccaccttcacgatgcggctgctcagccccgtgcgcgtgccgaactacaacctgatcatcatggacgaggcccacttcaccgaccccgcctccatcgcggcccggggctacatcagcacccgcgtcgagatgggggaggccgccggcatcttcatgaccgcgacgccgcccgggtcccgggacccgttcccccagagcaacgcccccatcatggacgaggagcgcgagatccccgagcggtcctggaacagcggccacgagtgggtgaccgacttcaaggggaagaccgtgtggttcgtcccgtccatcaaggccggcaacgacatcgccgcctgcctgcgcaagaacggcaagaaggtgatccagctcagccggaagaccttcgactccgagtacgtgaagacgcgcgcgaacgactgggacttcgtcgtgaccaccgacatcagcgagatgggggccaacttcaaggccgagcgggtgatcgacccccgccggtgcatgaagcccgtcatcctgaccgacggcgaggagcgcgtgatcctggccgggcccatgccggtgacgcactccagcgccgcgcagcggcgcggccgcatcgggcggaaccccaagaacgagaacgaccagtacatctacatgggcgagcccctcgagaacgacgaggactgcgcccactggaaggaggccaagatgctgctggacaacatcaacacccccgagggcatcatcccgtccatgttcgagcccgagcgcgagaaggtcgacgccatcgacggggagtaccggctccgcggcgaggcccggaagaccttcgtggacctgatgcgccgcggggacctgcccgtgtggctcgcgtacaaggtcgccgccgagggcatcaactacgccgaccgcaagtggtgcttcgacgggatcaagaacaaccagatcctggaggagaacgtggaggtggagatctggaccaaggagggcgagcggaagaagctgaagccgcgctggctcgacgcgcggatctacagcgaccccctggccctgaaggagttcaaggagttcgccgccggccgcaagtccctcacgctgaacctgatcaccgagatggggcggctccccaccttcatgacccagaaggcccgcaacgcgctggacaacctggccgtcctccacacggccgaggtgggcgggcgggcctacacccacgccctgagcgagctgcccgagaccctcgagaccctgctgctcctgacgctgctcgcgaccgtgaccggcggcatcttcctgttcctgatgtccgggaagggcatcgggaagatgaccctcggcatgtgctgcatcatcaccgccagcatcctgctgtggtacgcccagatccagccgcactggatcgccgcctccatcatcctcgagttcttcctgatcgtcctgctcatccccgagcccgagaagcagcgcacgccccaggacaaccagctgacctacgtggtcatcgcgatcctgaccgtggtggccgccaccatggccaacgagatggggttcctcgagaagacgaagaaggacctgggcttcggcagcatcaccacccaggagagcgagtccaacatcctggacatcgacctccggccggccagcgcgtggaccctgtacgccgtcgccacgaccttcgtgacccccatgctgcgccactccatcgagaacagctccgtgaacgtcagcctcaccgccatcgcgaaccaggccacggtgctgatggggctgggcaaggggtggcccctctccaagatggacatcggcgtgcccctgctggccatcgggtgctacagccaggtcaacccgatcaccctcaccgccgccctgctgctcctggtggcgcactacgccatcatcggccccggcctgcaggccaaggccacccgggaggcccagaagcgcgcggccgccgggatcatgaagaaccccacggtggacggcatcaccgtcatcgacctcgagcccatcccgtacgaccccaagttcgagaagcagctggggcaggtcatgctgctcatcctgtgcgtgacccaggtcctgatgatgcggaccacgtgggccctctgcgaggccctgaccctggcgaccggccccatctccaccctctgggaggggaaccccggccgcttctggaacacgaccatcgccgtgagcatggccaacatcttccgcggctcctacctggccggggcgggcctcctgttcagcatcatgaagaacaccaccaacacgcggcgcgggaccggcaacgtgggcgagaccctgggggagaagtggaagtcccggctgaacgccctcggcaagagcgagttccagatctacaagaagtccgggatccaggaggtcgaccgcaccctggccaaggagggcatcaagcgcggggagacggaccaccacgccgtgagccgcggctccgccaagctgcggtggttcgtggagcgcaacatggtcaccccggagggcaaggtggtggacctcgggtgcggccgcgggggctggagctactactgcgggggcctgaagaacgtccgcgaggtgaagggcctgaccaagggcggccccgggcacgaggagcccatccccatgtccacctacggctggaacctcgtgcggctgcagagcggggtcgacgtgttcttcacgccgcccgagaagtgcgacaccctgctctgcgacatcggcgagagctcccccaaccccaccatcgaggcgggccgcaccctgcgggtgctgaacctcgtcgagaactggctgaacaacaacacccagttctgcatcaaggtgctgaacccgtacatgcccagcgtgatcgagaagatggagacgctccagcgcaagtacgggggcgccctggtccggaaccccctgtcccgcaacagcacccacgagatgtactgggtgtccaacgccaccgggaacatcgtgagctccgtcaacatgatcagccggatgctgatcaaccgcttcaccatgaagcacaagaaggccacgtacgagccggacgtggacctcggctccgggacccggaacatcggcatcgagagcgagatccccaacctggacatcatcggcaagcgcatcgagaagatcaagcaggagcacgagacctcctggcactacgaccaggaccacccctacaagacctgggcctaccacgggagctacgagacgaagcagaccggctccgcgagctccatggtgaacggggtcgtgcgcctgctcaccaagccctgggacgtggtcccgatggtgacccagatggccatgacggacaccacccccttcggccagcagcgggtgttcaaggagaaggtcgacacccgcacgcaggagcccaaggagggcaccaagaagctgatgaagatcaccgccgagtggctgtggaaggagctcgggaaggagaagacgccccggatgtgcacgcgcgaggagttcacccggaaggtgcgcagcaacgccgccctgggcgcgatcttcaccgacgagaacaagtggaagtccgcccgggaggccgtggaggacgggcgcttctgggagctggtcgaccgggagcgcaacctccacctggagggcaagtgcgagacctgcgtgtacaacatgatggggaagcgggagaagaagctgggcgagttcggcaaggccaaggggagccgcgcgatctggtacatgtggctcggcgcccggttcctggagttcgaggccctggggttcctcaacgaggaccactggttctcccgcggcaacagcctgagcggggtggagggcgagggcctgcaccggctcgggtacatcctgcgcgaggtcggcaagaaggagggcggcgccatgtacgccgacgacacggcggggtgggacacccggatcaccctggaggacctcaagaacgaggagatggtgaccaaccacatgaagggcgagcacaagaagctggccgaggccatcttcaagctgacgtaccagaacaaggtcgtgcgcgtgcagcggccgacgccccggggcaccgtcatggacatcatctcccggaaggaccagcgcgggagcggccaggtggggacctacggcctcaacacgttcaccaacatggaggcccagctgatccgccagatggagggcgaggggatcttcaagtccatccagcacctgaccgccaccgaggagatcgcggtgcagaactggctcgcccgggtcggccgcgagcggctgagccgcatggccatctccggggacgactgcgtggtgaagcccatcgacgaccggttcgccagcgccctgacggcgctcaacgacatgggcaaggtccgcaaggacatccagcagtgggagccctcccgggggtggaacgactggacccaggtgccgttctgcagccaccacttccacgagctggtgatgaaggacggccgcgtcctggtggtgccctgccggaaccaggacgagctcatcggccgcgcccggatctcccagggggccggctggagcctgaaggagaccgcctgcctggggaagtcctacgcccagatgtggaccctcatgtacttccaccgccgggacctgcgcctggcggccaacgccatctgcagcgccgtcccctcccactgggtgcccaccagccggacgacctggtccatccacgcgaagcacgagtggatgaccaccgaggacatgctcgccgtgtggaaccgcgtctggatccaggagaacccgtggatggaggacaagacgcccgtggagagctgggaggaggtgccctacctgggcaagcgggaggaccagtggtgcgggtccctgatcggcctcaccagccgcgccacctgggccaagaacatccagaccgccatcaaccaggtccggagcctgatcggcaacgaggggtacacggactacatgccctccatgaagcgcttccgccgggaggaggaggaggcgggcgtgctgtggtga

SEQ ID NO: 9157 - RNA, 9876 nt, synthetic construct
  misc_feature 1..9876: note = derived and/or modified CDS sequence (opt1) from DENV-2__JF730044__SS-prME
  source 1..9876: mol_type = other RNA
accgccggcgtgatcatcatgctgatccccaccgccatggcgttccacctcaccacccgcaacggggagccccacatgatcgtcggccggcaggagaagggcaagagcctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacgtacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacgtggatcctgcgccaccccggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaaggagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagctccaccgaggccgagctgaccgggtacggcacggtgaccatggagtgcagcccccgcaccggcctcgacttcaacgagatggtgctgctgcagatggaggacaaggcctggctcgtccaccggcagtggttcctggacctgcccctcccctggctgccgggggccgacacccagggctccaactggatccagaaggagacgctggtgaccttcaagaacccccacgcgaagaagcaggacgtggtcgtgctcgggagccaggagggcgccatgcacaccgccctgaccggggccacggagatccagatgagctccggcaacctcctgttcaccggccacctgaagtgccgcctgcggatggacaagctccagctgaaggggatgagctactccatgtgcaccggcaagttcaagatcgtcaaggagatcgccgagacccagcacgggacgatcgtgatccgcgtgcagtacgagggcgacggcagcccctgcaagatccccttcgagatcatggacctggagaagcggcacgtcctcgggcgcctgatcaccgtgaacccgatcgtgaccgagaaggactcccccgtcaacatcgaggcggagccgcccttcggcgacagctacatcatcatcggggtggagccgggccagctgaagctcaactggttcaagaaggggtccagcatcggccagatgttcgagaccacgatgcgcggcgccaagcggatggccatcctgggggacaccgcctgggacttcggctccctcggcggggtgttcaccagcatggggaaggccctccaccaggtcttcggggcgatctacggcgccgccttctccggggtgagctggaccatgaagatcctgatcggcgtgatcatcacgtggatcgggatgaactcccgcagcacctccctgagcgtctccctggtgctcgtgggcgtcatcaccctgtacctgggggccatggtgcaggcggacagcggctgcgtggtctcctggaagaacaaggagctcaagtgcggcagcgggatcttcatcaccgacaacgtgcacacgtggaccgagcagtacaagttccagcccgagagcccctccaagctggccagcgccatccagaaggcccacgaggagggcatctgcgggatccggtccgtgacccgcctggagaacctcatgtggaagcagatcacccccgagctgaaccacatcctgagcgagaacgaggtcaagctcacgatcatgaccggcgacatcaaggggatcatgcaggccggcaagcggtccctgcgcccgcagcccaccgagctgaagtacagctggaagacctggggcaaggcgaagatgctctccacggagagccacaaccagaccttcctgatcgacgggcccgagaccgccgagtgcccgaacaccaaccgggcctggaactccctggaggtggaggactacggcttcggggtgttcacgaccaacatctggctcaagctgcgcgagaagcaggacgtcttctgcgacagcaagctgatgtccgccgccatcaaggacaaccgggcggtgcacgccgacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagagcttcgccgggcccgtgagccagcacaactaccgcccgggctactacacccagacggcggggccctggcacctcggcaagctggagatggacttcgacttctgcgaggggaccaccgtggtcgtgaccgaggactgcggcaaccggggcccctccctgcgcacgaccaccgccagcgggaagctcatcaccgagtggtgctgccggtcctgcacgctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcgtgggcaccaagcacgcgatcctgctcgtcgccgtgagcttcgtgacgctgatcaccgggaacatgtccttccgggacctgggccgcgtcatggtgatggtgggggccaccatgaccgacgacatcggcatgggcgtcacgtacctcgccctgctggccgcgttcaaggtgcgccccaccttcgccgccgggctcctgctgcggaagctcaccagcaaggagctgatgatggccaccatcggcatcgccctgctctcccagagcacgatccccgagaccatcctggagctgaccgacgcgctcgccctggggatgatggtgctgaagatcgtccgcaacatggagaagtaccagctcgccgtgaccatcatggccatctcctgcgtgccgaacgccgtcatcctgcagaacgcgtggaaggtgagctgcacgatcctggccgccgtgtccgtcagccccctcctgctgacctccagccagcagaaggccgactggatccccctcgcgctgaccatcaagggcctgaaccccaccgccatcttcctcacgaccctgtcccggaccagcaagaagcgctcctggccgctgaacgaggccatcatggccgtgggcatggtcagcatcctcgccagctccctgctgaagaacgacatccccatgaccgggcccctcgtggcgggcgggctgctgacggtgtgctacgtcctcaccggccggagcgccgacctggagctggagcgcgccaccgacgtgaagtgggaggaccaggccgagatctccgggagctcccccatcctcagcatcaccatctccgaggacggcagcatgtccatcaagaacgaggaggaggagcagacgctgaccatcctgatccggaccggcctcctggtgatcagcgggctgttcccggtctccatccccatcaccgccgcggcctggtacctctgggaggtgaagaagcagcgcgccggcgtgctgtgggacgtccccagcccgccgcccgtggggaaggccgagctggaggacggcgcctaccggatcaagcagaaggggatcctcggctactcccagatcggcgcgggggtgtacaaggagggcaccttccacacgatgtggcacgtcacccgcggggccgtgctgatgcaccggggcaagcgcatcgagcccagctgggccgacgtgaagaaggacctgatctcctacgggggcggctggaagctcgagggggagtggaaggagggcgaggaggtccaggtgctggccctggagcccgggaagaacccccgggccgtgcagaccaagcccggcctcttcaagaccaacacggggaccatcggcgcggtcagcctggacttctcccccggcaccagcgggtcccccatcgtggaccgcaagggcaaggtggtcgggctgtacggcaacggcgtggtgacccggagcggggcctacgtcagcgccatcgcccagacggagaagtccatcgaggacaaccccgagatcgaggacgacatcttccgcaagaagcggctcaccatcatggacctgcaccccggcgcggggaagaccaagcgctacctgcccgccatcgtgcgggaggccatcaagcgcggcctgcggaccctcatcctggccccgacgcgcgtggtcgccgcggagatggaggaggccctgcgcgggctccccatccggtaccagacccccgccatccgcgccgagcacaccggccgggagatcgtggacctgatgtgccacgccaccttcacgatgcgcctgctcagccccgtgcgggtcccgaactacaacctgatcatcatggacgaggcgcacttcaccgaccccgcctccatcgccgcccgcggctacatcagcacccgggtggagatgggggaggccgcgggcatcttcatgaccgccacgccgcccgggtcccgcgacccgttcccccagagcaacgcccccatcatggacgaggagcgggagatccccgagcgctcctggaacagcggccacgagtgggtgaccgacttcaaggggaagaccgtctggttcgtgccgtccatcaaggccggcaacgacatcgcggcctgcctgcggaagaacggcaagaaggtgatccagctcagccgcaagaccttcgactccgagtacgtcaagacgcggaccaacgactgggacttcgtggtgaccaccgacatcagcgagatgggggccaacttcaaggccgagcgcgtcatcgacccccggcgctgcatgaagcccgtgatcctgacggacggcgaggagcgggtgatcctggccgggcccatgccggtcacccactccagcgcggcccagcgccggggccgcatcgggcgcaaccccaagaacgagaacgaccagtacatctacatgggcgagcccctcgagaacgacgaggactgcgcccactggaaggaggccaagatgctgctggacaacatcaacacccccgagggcatcatcccgtccatgttcgagcccgagcgggagaaggtggacgccatcgacggggagtaccgcctccggggcgaggcgcgcaagaccttcgtggacctgatgcggcgcggggacctgcccgtctggctcgcctaccgggtggccgccgagggcatcaactacgccgaccgccggtggtgcttcgacggggtgaagaacaaccagatcctggaggagaacgtcgaggtggagatctggacgaaggagggcgagcgcaagaagctgaagccgcggtggctcgacgcgcgcatctacagcgaccccctggccctgaaggagttcaaggagttcgccgccggccggaagtccctcaccctgaacctgatcaccgagatggggcgcctccccaccttcatgacgcagaaggcgcgggacgccctggacaacctggccgtgctccacaccgccgaggccggcgggcgcgcgtacaaccacgccctgagcgagctgcccgagaccctcgagaccctgctgctcctgacgctgctcgccaccgtcaccggcggcatcttcctgttcctgatgtccgggaagggcgtggggaagatgaccctcggcatgtgctgcatcatcaccgccagcatcctgctgtggtacgcccagatccagccgcactggatcgcggccagcatcatcctcgagttcttcctgatcgtcctgctcatccccgagcccgagaagcagcggacgccccaggacaaccagctgacctacgtggtgatcgccatcctgaccgtcgtggccgccaccatggcgaacgagatggggttcctcgagaagacgaagaaggacctgggcctgggctccatcgccacccaggagccggagagcaacatcctcgacatcgacctgcgccccgcctccgcctggaccctgtacgccgtggcgaccacgttcgtcacccccatgctccggcacagcatcgagaactccagcgtgaacgtgtccctgaccgccatcgccaaccaggccaccgtcctgatggggctcggcaaggggtggcccctgagcaagatggacatcggcgtgccgctgctcgcgatcgggtgctactcccaggtgaaccccgtcacgctgaccgccgccctgctcctgctggtggcccactacgccatcatcggccccggcctccaggcgaaggccacccgcgaggcccagaagcgggccgccgcggggatcatgaagaaccccaccgtggacggcatcacggtcatcgacctggacccgatcccctacgaccccaagttcgagaagcagctggggcaggtcatgctcctgatcctgtgcgtgacccaggtcctcatgatgcgcaccacctgggccctgtgcgaggccctgacgctcgccaccggccccatcagcaccctgtgggaggggaacccgggccgcttctggaacaccacgatcgccgtgtccatggcgaacatcttccggggcagctacctggccggggccggcctcctgttctccatcatgaagaacaccaccaacacccgccgggggacgggcaacatcggcgagaccctgggggagaagtggaagtcccgcctcaacgccctgggcaagtccgagttccagatctacaagaagtccgggatccaggaggtggaccggaccctggcgaaggagggcatcaagcgcggggagaccgaccaccacgccgtctcccggggcagcgccaagctccgctggttcgtggagcggaacatggtgacgcccgagggcaaggtcgtggacctggggtgcggccgcgggggctggtcctactactgcgggggcctgaagaacgtgaaggaggtcaagggcctcaccaagggcgggcccgggcacgaggagcccatcccgatgagcacctacggctggaacctggtgcggctgcagagcggggtggacgtcttcttcacgccgcccgagaagtgcgacacgctcctgtgcgacatcggcgagtccagccccaacccgaccatcgaggccggccgcaccctgcgggtgctctccctggtggagaactggctgaacaacgacacccagttctgcatcaaggtcctcaacccctacatgcccagcgtgatcgagaagatggagaccctgcagcgcaagtacgggggcgccctggtgcggaacccgctgtcccgcaacagcacgcacgagatgtactgggtctccaacgcgaccgggaacatcgtgagctccgtgaacatgatcagccggatgctcatcaaccgcttcaccatgaagcacaagaaggccacctacgagcccgacgtcgacctgggctccgggacgcggaacatcggcatcgagagcgagatccccaacctggacatcatcggcaagcgcatcgagaagatcaagcaggagcacgagacctcctggcactacgaccaggaccacccctacaagacctgggcctaccacgggagctacgagaccaagcagacgggctccgccagctccatggtgaacggggtggtccgcctcctgaccaagccgtgggacgtggtgcccatggtcacccagatggccatgaccgacacgacccccttcggccagcagcgggtgttcaaggagaaggtggacacccgcacccaggagcccaaggagggcacgaagaagctgatgaagatcaccgcggagtggctctggaaggagctggggaagaagaagaccccgcggatgtgcacccgcgaggagttcacgcggaaggtccgcagcaacgccgccctgggcgccatcttcaccgacgagaacaagtggaagtccgcccgggaggcggtggaggacagccgcttctgggagctcgtggacaaggagcggaacctgcacctggaggggaagtgcgagacctgcgtctacaacatgatgggcaagcgcgagaagaagctcggggagttcggcaaggccaagggcagccgggccatctggtacatgtggctgggggcccgcttcctggagttcgaggcgctcggcttcctgaacgaggaccactggttctcccgggagaacagcctgtccggggtggagggcgaggggctccacaagctgggctacatcctgcgcgacgtcggcaagaaggagggcggggccatgtacgccgacgacaccgccgggtgggacacgcggatcaccctcgaggacctgaagaacgaggagatggtgaccaaccacatggagggcgagcacaagaagctggccgaggcgatcttcaagctcacctaccagaacaaggtggtccgcgtgcagcggcccacgccccgcgggaccgtgatggacatcatcagccggcgcgaccagcggggctccggccaggtcgggacctacggcctgaacaccttcacgaacatggaggcccagctgatccgccagatggagggggagggcatcttcaagagcatccagcacctcaccgccaccgaggagatcgccgtgcagaactggctggcccgcgtgggccgggagcgcctgtcccggatggcgatcagcggggacgactgcgtcgtgaagcccctcgacgaccgcttcgcctccgccctgaccgccctgaacgacatgggcaaggtgcggaaggacatccagcagtgggagccgagccgcgggtggaacgactggacgcaggtccccttctgctcccaccacttccacgagctcatcatgaaggacggccgggtgctggtggtcccctgccgcaaccaggacgagctgatcgggcgggcccgcatcagccagggcgcgggctggtccctcaaggagaccgcctgcctgggcaagagctacgcccagatgtggtccctgatgtacttccaccggcgcgacctccggctggccgccaacgcgatctgcagcgccgtgccctcccactgggtgccgaccagccgcaccacctggagcatccacgccaagcacgagtggatgacgaccgaggacatgctgaccgtctggaaccgggtgtggatccaggagaacccctggatggaggacaagacccccgtggagtcctgggaggaggtcccctacctcggcaagcgcgaggaccagtggtgcgggagcctgatcggcctgacgtcccgggccacctgggcgaagaacatccagaccgccatcaaccaggtgcgcagcctcatcgggaacgaggagtacaccgactacatgccgtccatgaagcggttccgccgcgaggaggaggaggccggcgtgctgtggtga
